United States Patent 11,549,145 (METHODS AND COMPOSITIONS FOR INHIBITING AND TREATING NEUROLOGICAL CONDITIONS) - sequence listing, part 129

SEQ ID NO: 2385 - DNA, 1169818 bp, Homo sapiens
caacagtccaaagaagcaaatgggatgccacctccgcggggctcgctcctcgcgaggtgctcaccccgtatctgccatgcaaaacgagggagcgttaggaaggaatccgtcttgtaaagccattggtcctggtcatcagcctctacccaatgctttcgtgatgctgctgctgatctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtagggaagaggggctgccgggcgcgctctgcgccccgtttctgcattcggatcgcccggcacgggcagggtgagggggctttcggggggtcggggcctccggtcgcggcggcgaagacagatcggggctcggtagggaggtcattccgagcccagagatcctaggcaccccccacacacaggctcccactctggcgtgcgtgtgtgtgtgtgtgtgtgtgtgtgtgtgtgtgtgtgtgtgtgtacgttcgttaacgggaggaggagagagctcccagtccttttttgctagcaggggcgacattctcgcccacatcaagtggggtaactttggttccctcctccggaggctcggtgcattggagaaagactcagttagaggcgactccaacgagccgcggttttccccagcccaacgcccagcggccgaagcgctgctcgggtccggattgcgggatgcggggctggagaggccgagcaggcaccaccgacttcccagggcgcccgggccccctggtacagcccggctgcccgctggaaggcgcctcggggcagcagagagcctcagcccggctgctgctgtcgctcaaaggcgccggcgccggccgcacccgcatcggggtccttttgctcccagaccccgggcccgaaagggccggagcgtgtcccccgccagggcgcaggccccagccccccgcacccctattgtccagccagctggagctccggccagatcccgggctgccgcctctgctgccttccctgagcgggagcggagcgcagagaaaagttcaagccttgcccacccgggctgcagctgcttgttaaccctcagagcgccacggcgcgagggaagggcacgccaaccaggagagggggcgagggagatgcggtccgcctgcagtcacctctgcacctcagagatttcgggaagtttgagtgcaggaaagcagcgctccgaggccaggcctggggtgctggccgctgcggggggcacgccctgcgctgctcaggggcctgtggtttcggagagcaccccgatccagtcccccatcgcctctctggcaggcgttgggacttggagtgagctggcagcctgcaagtgggtggataagagccagggcagggcagggccgggcagagtaaggagggaaagagacagggagtgcctcagggtgctaggaatgagtgttgagttcctggccggggtagaggctcaggtgagagtttgcgggtgaaaggcaggggaagggagttgggttcccaggtagggactgtctgggatggggagactggtgcagacttctaagggagaccactgttagagcaatgttgggtttagactttggaaatgggctaacatctcagaaatgcagtgatgggtgatagtaccaggggagattcaagtgcccggctgctgagcccgctcccaagctcctgacttctttcttggatatacagtcccgattaaggactgcccagttatagctccttttctaccaggcttttctggttgattatcttggggtccctacagccttgagtcttgccatggatcccaagcctggctgtgaaccagttttccagatgtcctgtaccctagagaccccaaggctgtatgtgtgtacatataccccaatttagcaaggcggtttggagcatgcctcagacagaaaggattcagacagatccttcctgccatctgctagtggtaccaacccgggcaagttgtttaacctctttgagcttccaagttctccattgtaaaataatctgctgccttcctaggactgctgagtggataggattgcattcaacaggatgtcctatgcaatgcatgccagtctgggagctgtcggtgtctgagagcacttaccattgccttgtccaggacttcacagtcctctttctttcttggcaggtttcaacctcagttcatattccagggcttgcccaaagttatgcctcctttaaagcaagacagaccacgtgacagggccccaggatcgatttttatgcactaagggctctgcgcacggttctttttgcaaatgaactggtgtgtctcctcacccagggccaggctggcacaggtgggttctgaaggctcactctatttatttagatgaaggaagcagagattttgctgtgaattgaaatgattgccctgagaggcttatttctattttcaattgttatgcatatcagagcaaatgtccacattaggatagtaattgatatcctggtagcaatagtacctcacagagaaatcattttgatgcaatccagttaaccagcaagaagttcacgtgcagaactctgtgtgccatagaaaaaagtggggaaagtcttcgaggccttgagtcgacgagcaaaaacacaactttcctgaggcagagagaaaacagaagggaaaaacaatgtaataaaacaaattagtcactcggccctggtggtgttcaggcaagcctgtatgtttttttccaccacagttgtaaagcatcgggtctggctttggaagccatcaatctctgtaagcttattggcttggttgttgttttaggcattttggtaggaggtgaggaattctaagcaacaatgactggaagctggcaccgttgaacagtcacctctcctatcccctggggtgttttgggaaagtctgtcccagaagtggcttctggaatttgcctatgataagtaatgactgtgaaacaaatcaagaaagaaatgagcaagaaattccatggtaaatgtgattcccctccctatttgggtagcacttacaactaaccaaaagttctaacaatgagtgagtaatcccccaagaattaggaatttagggaggggttcaggcttggaggacagtcgcttgggagtgactgaaaatgttccatggaattctgagatttcgctataaagtggggagttctctctaggggtcagagtcttgattttcaggattttcaatgagaatcagtgtcttatagtgctcctgcaaatttgtgtgttatgttttaagagcagtgtttatttgcagaactttttggatgaggaaaaggacacagggttgaagagggtgctgccccctccccccctagggtcaatacatgacagcctgtaagatttccagagcactagggaaatggaatatgtagtgaaaggagtcagtgatagagttcacctgtctgaatatttttttttagcaagtcccaaaacaggtttaataaactgcaaagctgagtatgtaatctggaatttgtgtaattccacagtctatactaaaagccccaacagtcatcttagctgatcgctcctactctgcctccctcccttctccccttttctatctttagcccttgggttttccgttaagtaaaatctgtttacttccagaagtatcctctatgtgttatagtgaaattgcccaacaaaccaacatactcaataactgcattatctaaaagcatcagcacttggatgtgtaaactgagcctcaatctgaagttcaatgtttaggttaaagtgtagctaggttcttgaaaacatccttatttccttccaaaaatacaattgcttggggagtctagttaatttatatttagtggaatgtaggaaaaggacaaactatggatttaatttacacctgaatgacagtcatatcatctacgtagccaacagtgtttctgtgtgcgcgtctgagtgagtgtgtacatctctgcattttgatcttgtaatacctgttgaaaaatttctccagaagagggctccatccacagcattacaaaattctgaatctacagctcattttaaagaacttcaatgcagcaactccatcaaaacaaaactattctccttattccacattaattgccacaatcacccccaaatgagaaatcctgccatttttcactgtatttatttctgtgtctctctctttcttgctttccttcttttgctctcttgctttctcgctagctttcttcttgctttctttcttttcccctattgtagttggttctgttctaattcattctttgactctgtatcccctctgagtattggagcagggaaaatttcaaagatgtttgtagacggtgcaatacgcaatgtgaggaagttctgaaatttcctggcatttgactttggttggacttgatttcattctttaggtagccaaaaggcaggaacagttctgcctgtggaaggagataaccttcccccttacataaccacccagaagggtgactcctgagctaggtccactcactttccatcactcattgaaaaggagaaggaaatatccccctgtcatccaattacaataatcagctggacagaatcaaaccaagtgaccagtggttttggcattgtttctatttagctgtcagccaggtacccatgcacctgtgagaatctgaccctcctgaaggatgctgccaatataattccccacagcccgcttcttctgcagccacctgggatcccaggcctggctcctcaggtatgaacaggctgcacagacaatgaatggctgggctgtaggatctcttgctcctgcagtaggcactcagcagtggccttattctagagttagggtggaaagtcatctttctctgctgagagaggcagcttgggggaaggcaggagaggagaagaaaggacatttctaacttgaagtgctgactgagccagggtctgtggaggtgaatgtgtcaccctctggcttagcaagttgaacctcgagacatctgcttggtggtaatggaactcatctatcccaaacctgcaactctggcttctgggcagaggttgccaagtagcagccacaggctaaatttagccatggatgcagtttgtttggctcaaatgttttgcaaattgtacattaataaaaaagaaatccaggtttctagcatttctgaaaaagtcaggtcaggcaaccctagatccacacttcaacatggccgtacttgacagggctgagtcactactgccctctttaggcaggacgtgcctccgtagcttgccataatcgtcaccactctctactacccagccttctgtgctcactaattttgcctgcttgcccctagggctttttgagtttgggacctctgctttcacaaatgttgaggtttgatcaaattgatgcagtttatttctcagtgatggactatttggaaagggagggactggccttttctccttccctgtgattgaattccattgatgtgtgctttggaacagcatgaccaaggggactgcagcccctccctgagcacattactggcagtacttttggacaggcacccagagagacatagcacccagatcattgcttcaggtgtaagagtcatgcagagaagtgacacgctgcagctctgagtcagtacgagccctggcacaccagtgtgttggtacaaaatgtcatcacgcaccagcagccaagggactctgaaaccctgggatcatatagaggcctgcataccctctctgtcagcagtcctcaaccattttggtaccagggaccggtttcgtggaagacaatttttccacggactagaattggggggatggttttgggatgattcaagcacattacatttattatgcatttaatttctgtattgttacattgtaatatataatgaaataattctacaactcactataatttagaattactgggagccctgagcttgtttttctgccactagatggtcccatctgggggtgatgggagacactgacagatcatcaggcattagactctcataaggagaaggcgacctagatcccatgcacgcacacagttcacacaggattccaactcctatgaaaatccagtgccacggctgatctgacaggaggcagagcccaggcggtaatgcgagtgctggggggccattataaatacagatgaagcttttgcttgctcacgggccactcacctcctgctgtgtggcctgatttctaacaggccatggactggtactggcctgtggcctggaggttgggaacccctgctctacgtagtgttctaccaagagcatggctgtccttggagaacagtgacagctgagcatcatcattccatgagtgttgctccctcacggtatagacataaccagaacgtcacaataacttactctacttagacttgccaaggcctccgggaacactgctctaatattcagcacctttgtaacttcaggataaagctgaatctgcagctctgtcacctactttttttctttgagacggagtcttgctttgtcacccaagccggagtgcggtggcgcgatgtcggctcactgcaacctccacctccagggtttaagcaattctgtgcctcagcctcccaagtagctgggattacaggtgcccgccaccaggcctggctaacttttttatttttagtagagacggggtttcactgtcttggccaggctggtcttgaactcctgacctcgtgatccacctgcctcggcctccccaagtgctgggataaacagacgtgagccactgcgcctggccaagtacccttatccataggacactgtcacatcctagcaccgtcctggagcttgtgtgatgtttttatatctgttttaacagttaacacccacggccgttctacatacagtgttaatgctacaattaatgctctctggctctgtaaatactagactaatctgtctgcctcatcccataccagcaggtgagcctcagatgattcttgttttccatagctacagaccccaaagatcagagtaaatataactccatatacacatatgaaaaaaagtgattgtttttcctctgccagttgccaacagaagtcaaattctagaaaactaacattaacaacaggcacgttttgacttgtcatgtctcatttcaaagacaccaatgagcatcacccgatctgctgcagaggcacaaagaccctgtgtctcctagctgaacgcagcccgggctggggcggagggcagcagctgctcagccatcaacagccctgccacatgcctgggcagggcccggaaatgagctcagcctctggaggagcctggggaatggaaggaaggaatgtggcagcttccatccttgccttacggggccttcaggccaatgtctctttccctcaaggtgtcagggaaccgctttcttgtgttgtgtgctgcaggaagaaggtggtggctgcagacacctgaagcttgagcttctgtgattgtctccctgtggactgattgctgtagggcctgcggaaagttgctggacactgccagcggaaccgaggctgactcagactgcccggagtatccctcctcaactgccatcagccgtcgggcatctgggatcatctcactcaggggttgcaaattatggcccgtgagccaatttctccctgcagtctggttttataaatagttttattggattatagccacacctattcatttatgtaattgtttatggctgcttttgtgctataacaacagagttgagactgtctggcccctgaagctgaaagtatttactatttagtccctaaaagaaaaagtttcctgactctttatctaacttaaagttacagccaaagaggcttctgggcgtcttctcaaataagaggggcctgagaagttcagccgttggggacttttcctcctaggccccaagcacttgagcaacttgacttcagggagattcacctgagaccaaatggttccaataaatatctatgatctctatggaggatctactatgttccaagcaccacttgtgtgtgcaggatacagttgctcataaggcagactgagtctctgctctcctggggctcacagcttggcaggaaggatcaatagcaattaatgaataatttaagatggagacaactgtgatgagggaagaaagcccagctgtgtgaggtcatgccgttctaaatattttgcctaggtgttctttgtctttctcctccactagactataagctctgttgtggtccacattgtggcttgatttgttcatttctatactcccagggcttagaacagtgcctggcacatagtactcagcaaacatgaatgaacaaatgaatgaatgaatataagaaagacatcagaggcagatgaaggatctgggcggcttccctgacaacctgatgcttcagcccaaatctggaggagcagtagggcttacagacaaagacacagtagagggtgtgggtggggaaaggcattccaggaagaaggcacagtctgggtgaagcctctattcaggggaaacaccacacagccaaggcagtgatgtgaagtgtggctgggaggtgccagagccaatggggccatgtcagccactgcaagaatattggtgtttttctcagagcaagtggcagccattgagggtactgagggaaaggtacagagtgatgtgatcagatttgcattctggctacaagtagcaaatgggttggagctgggtaagaatggaaaggaaaggccagtctagggctgagatcatgggaagctggattcaggaacgacggtgcagagatggggcaggtgattgaagtagactgatatggtttgggtctctgtccccacccaaatctcatgtcatattgtaatccctaatgttggaggtgaagcccagtgggaggtgattagatcagagggcggatttctccttgctttaatcgtgatagtgagttctcacaagacatggttatgtgaaagtgtatagcacttccccctttgcgccccctctctctcctgcttgctgtgtgaagacgtgcctccttcgccttccccttctgccacgattgtaagtttcctgaggcctttgcagccatacttcctctacagcatgcagaagcaagccaattagacctcctgtctttataaattacccagtcccaggcagttctttatagcaatgcaagaatggactaaatcctattcagataatccaagagacatttaggtggataacttgacaggctttgatggtggctgggtatggagatggcagggccagagagaggtgaaggaggcctgcttgagttctgactcttccaattggcaggaagagtcaaacaaggagaccaggtgtttgacattgtaaacagggtcggtctgagggcttctctatgtgggagtgtaattcaggctgcagaacgttcctgggagaggcacctaaggcctgcattacagtattgccagcagatccagtccatgcctgcatctaggatgggcaccgtgggggcctggaaatgcccttgaataaagtgaccgacgtgcagcctgtacaattaaccaatctctgagacttttcatgcacaagatatttgagagaaacattgccaagccctttaatcgtttcttgaacattcaatcagcagcactggaaatatgtcttacatgaagcaaataatgatcttctaccctcagcaatcgctttgccaatgctaacaagcctctgcttcagcatgttgggtgtagccttggtgacttctgtttgtggtgtagtaggagaatattcaactgggtgccaggcagtggtatattggtaaatgtttaacaactgggccactctaaagaaacacccaaaccagaaagcaaaacccaaaccaagacacaaccaagtaatttgtagctcttgccaatttctgtgatgtaaatactcccgtcatgggcaatttgaatctgccaacctgagagtttcctaaaaacttaacaaggggctcttgctacctgatactaactggctccagcacaccatggacctggatcctgtttctagctcaccccctcactcgtggtatgaccttcagcaagcagcttgaatgttttcatctgtaaaatggaccaggttacttggaggttcaagtgagtaaaaagatgttagaatgcagggaagtccaatttgctgcaaagatgcatgcagattatctaaatcattatcacttacaaggaaacaggacctttggccaggatcctacagctgtctaattgggccctgtaaaaatactttgattcagccactgaatgaagtttgatgtgtgagaaacagagggtgtacctctgcttcctgcagttctgcatgtttttgcagtaagaaagattattgcgttctgtggcagtattgattccgaacgtgtctatcttgtttttctgctttcccttcttttcttccttttctcaacaaagatatttagtgagtgctgtatgccaggcactcacctaggtactttatcctcagaagctgaggtctgtacagttactgtgccttttttttttttttttttttgagacggagtctggctctgtcacccaggctggagggcagtggcgcgatctcggctcactgcaagctccgcctcccgggttcacgccgttctcctgcctcagcctcctgagtagctggggctacaggcgcccgccacagcgcccggctaatttttttttttttgtatttttagtagagacgggttttcaccgtgttagccaggatggtctcgatctcctgacctcgtgatccgccagcctcagcctcccaaagtgctgggattataggcgtgagccacagcgcccggcctatcgtgccctttcaacagatgaagaaactggtgagtttaaggaactgacccaagatcacagaataataagtggtgagctgggatttgcacctgggtctgtgcgtgggcgagtccacctggggcccgtgtcttcactcagcgagtatttattgagcatttagggaattcagaggtaaacgagatgaactgaatccctgtctcatggagcttacagttttgtgggaacagcagataaaaacaagtaagtacttgaaataattacaaatgtggtaattgttacaataggaagcagtagaggctgaaatccattgaagggagaagaggctgctgtgccttcctttgctcctttgcttcctttcatctgccttgcctccctctttctgctgtctttctttctttcttcccttaaatgttacctaccaactatgaagaacgctgcaaacctgggaacccagaggtgaacacgacagtccaggccttcactaggaaatgtgctggagcagaattagagcctggggctggcctggacccagagctgctggtgccttggactgcttagggactgctgagcagacctcctagccctttagaagtgagcttgaatccctgcccagccatttacacactgtgttgcctcagataattgacttcatttccctccttttctgttttcccctgtattaaaacaactgaaaaggaatatctatgcttgccctgcaggatttttgtgagaattaaataagtgtatgttaatgatgtcatcctatgcttaagaaatgttggttgtattacttttcaccctatgctccaaggaattttatggtctgaaggtgtcatggggtcttggctttcaggatgtgactcacttaaggggggaaatgactgtgcatgtcataatgcgtggacattaaaaaaaataaagtttgctccccagggaggatttgccaattcccatattagtaggtcccccaagattgttcccctcgggattcatgcctcataaaatcatttgatctggtgggatctcatcttcttaatgtgtctgcccatcatctgttcctgggaggctttattagggcagtgtgtgcgtgtgtgcgtttgtgtgcatgcacgcaccagtgccatgagtacttgtttaaagtacctccatgtaaccacaattcactgtagttgctatgcactagttacccatgttatctggaatccttcctgcaacccttagaggcgactcttattcccaattttatatacgatgagaagaagttttgagtggtggagtcatttgctcaaggccacacagtcactgagaactgggaccagggtttggacccatgcgtctttattcctgtgcatatttattttcctctatgttgcactagtatataaaagttgcctttcccactcccctcattatataaaaattctttcctttgtctattttgttctctacctcccttaaagtcaagatagctgcctgggatgactacttttttgagttcctagtctctcaaagtgggtctgggccctggacttcctgtctgggctactgattgcaaccttcagaacagggtcagcccggggtcatttgtgttctttgtctccatgtccttgcttttgaccagggccaaacaacccacctgcactgcatggttcccccagcaagaacatcccagtgagaatggcccacagatgcctgggcgtgacccacctgcagcttcaaccatgcaggtaaatttgcctgctgctgtgtcgtgtggctggatggaattcttccctagggatgctaagaaaccctgttgcctaagtcagtgcttcctgcaagctactctttgtaattctttccccaaacaaaaagaaaacaagaaatatacagtctgtagctatatagagacacctggatctatattgtgtggcaattggattgaatgtaacttgaagtttatttttgtcttaccagactagtgttttttcctgttaatttaagtgctttagtgagggttgccattgattgagcaaacatgtgttgagtgcttattatgtacccagctccattttccgtactagccacagagcagcgagagcatggcctttgccctccaatcctgttctggtggacagacactctctcccttgacagggtcctcaccactgtgtgcaccgtcccgccacctggtggccgtgcctatctgtgcattccctatttggttaactcattcacttaacaaatatttactgggggaagacaatatctcaagcacaattctcagcattgagggaggcagcagtgattaagaaagacaagattgcctgcccccgtggagtttgtgttctgatagcagagaaagacaggaaacaagaaaaataaataaatatggtagttttgcgtagtgatagtgctatagaaaaacgttcaaatggggtagagtgatagacagtgttgttctgagcttgtccaccacaccctcttgggacagaggattctttgttctgatggaatggcctttctatagcatagagatgaaatgtgctaccgtttgtgaaaggaagttagtaatacatacatggcatttttgtcttcactgataaagtgttgttggtcaacttttgtcaactctctactttttgtttgtgttgaaattttactgttgggaatttacgaatatggcaactaatgatttaaaccaggggtaggtatcctttttctgtaatgagccatctagtaaatagctggtttctcttgaaactgttcaattctatccgtgtagcattaaagcagccacagccgatatgtaaatgaatgggcagggtaataaaatgttatttacaaacacaagcagagctagattggtccttcaggctgccatttgccaaccactaatctaaaccagtagctgccttaccagttggtcaaacttgtttaagacagggatagggcagaggccagcgaggggaaccaggcattctctttggcctcagttgccatgaaaatcatggtacttctttagggtcacatatcactagattatttgcattaacttttatcaaggtaaagatgctaatagtcaactatggaacataattctcagagtagatctaacataggaataatttagctttgtaatatttatctggactacaatttttaaggcacttttgctacccaaaagtatcttggggttaaacacgctcttggattgaattcctctaaataaatagagacacagaattgggttcagggggttaagttggtaaatgatctcaaggtccataagtgagcgagtggggagagtgagaccaagaagaaggaaagccagcaagccaacagtgaatgtgtcattgaggtggtcacagtcatgggaaactggcttcttgctgctgggtctctacaaaagcactgtgtaaagctcatttccgaatggtccctccacagaataggtggctgagggtgtattcactcgcccttatcttctgctggtcaggggtgacccctgccgtcattaacttctctgtgcttccctgctgagcctttgctgtcatggggagcagtcatgactttggaagcatcatagcagaaaaaatggaaaggtatggcaagttgttggactgtcaggatatgccctgggtagggtatgaatatatgtgatttctcttgccaccattacatgttactggaaacttcctcagtagagctaatggtaacagaaagaattatggtagtggtaatttttaaaaccttctgaatttggttaagcaccctcctgcagatattctctttcccactagatggtaccagtatgccaaagccctagaatgctaccttagggcctcgtctttgacatgtgatatattctcattacttttcaacaatgaatgaataagccagttgaggtcaaaggaatcaactatggatgttttagggacaggagatgggagaaaagtggaggctgtctaaacagttaccctcattcacgcattcagtcatttatcaacaaatattactcagcactgactgagtgctcaacacttttctaggcactgggaatacagaaatgagtaagacaggccaagtccctgctctggtgagcttatgtactggctgggagagagacaataaaaaaatgaacaggtaggtatgtgatgtctgcaggagggtgatgagtgccatgaagaatgagaaagcaggcgagggggtagatagcgacaggcagaggtcatggcgcttgccttcgctgttggctgtagggtgagagattattttcatctgcttcccaaacccagttcttccattcaccaactccttatgacacccctatgcggtttatttttgaaatgaaactaacagctcatggagggcaaaaaaaaaaaaaaaaaaaaagtggtgcttggcaaatgtgtgttcactagtcggggcccactgcagcctaacacctaactcattggactgcttgttggctgatttaatttgtctggaatatttctgaattactattgttgttgacacacaatagagttgcatttaactcagaggttagactataaggtcagggttttaggcaaacacagttgtcattagccttgaactcttttaagttgcccattaaagtacagtaggcgtggtttagtctatgcatccccgtattgtaatcaatagggaacaatgtataatgcacgcagtaatgtacagggcataataaagaatatatgcaagatataattttatagcatttaattgcagtatttacattgttctttttctctctctctttggtgggagagctggctttccattagttaaatgtgcatatgatgagacttgactatattcatttaagccacattcctaatcatacaatctccaccagactgtgcattacgtaaggcaagacctgttttctctgttgtgttctgtttatctttggattcccactaccagtcagatgctttggggtgggggaattgaggaataataatagtagaagtggcagtaatagtagctgatatcagtgtggtgctgattttgaaccaggcctggtgtgagtgcttcagatgcattaatcagcacatgtaatcctcatagtgactctataaaatatcttctatggttttaatcccatttcataggtggggaaacttcaggagaacttagtaaaagaacctaataaagctttaggactctagggctgagattcaaactcaagacaattccagacacacaagaccacatgttgtatgattctatgaaatggaacaaactgtccagaaaagtcaaatccagagacagaaagcagattagaagatgtctagggctgggggcaggaggaaatggggagttactgctaatgggtatagaattgctttggggaagatgtaaatgctctggagctagatagtggtggtgattacattagctctctgtaaataaaccccaaacctgggaatcatatatcttaaccggctaagctttatagtatgttacacatgtctaaataaaactggtattgaataggaaaacaagcaaaccttgggcaggtcagcctcagggctcctgtttgttcatgagcacacaccacctgtcttacagttgttcaccacctgctggtgatactctacttgctttacttatattaacactgcgactcctcaaaagatccccattgtccaccctactgagatcagaaagcggaagcagaacgatgttgagaaacttggggctggcaagtggtagtttcaggattaagacccaggctgtttgggtctaattccttctggctacactggttcttacatgtgtttcattcattaaaagcaacctgtgttatttggaactgcaggtcaccttggcctattggaaataaagcaagggttcttcacgtttgttttgctgatttgtaaagtgaattaagaaccatcttttgcctcactggttattattctcatagtagcctaccctggtgtagagttctggctgcaaagctctcagagactgaagaaaaggagatggtttagtgttactgactttttttaagacagggtctttctctgttgcccaggctggattgcagtggtgcaatcatagctaactgcagccttgaccacctgagctcaagcaaccctcttgcctcagttctggaaatagctaagtgggactacaggtgtggaccaccaggcccagttaattaaaaaaaaaaaaaactttaagacaaggtcttgttatgttgcccatgctggtctcgaactcctggcttcaagtgatcctccaggagtagctggcattacaggcttggctgacttttaaaagtagtaagtggtttaggatggggggtggtatggaggtcgggtggggagaaagaggagagaaatctaattgatatgctaattgtcattgtactcaagttgatagcagattgctgaaggatttaggatttacccaaattaacatgaatgtttggcaccctttggctggtgcggctgaagaattcaatagcctagtaatgagaagtcaatctaaggtctaaggctgggaaaggagctcccacttcttacattcagtgctcatcactctgcaaatcaaggccccccgaactcctcccacccctgccttctgcgtctccctctgtgctctccatcacccccctacggagttcctttgattctcaggtcccttaaccatggaacgtactcctgtctgccctcactcgtgggttgatgatttctatcctttgtcatgttgaaaatgctgagtgacaaagccattagccatgcacagtgaaacaaggaaagcagcctagagctggtccccagaccaggcccagtgcacgagtttgggtgctggaaggggaggctttatggaggcaaagctgaggggctgtacgtgtcttcataggtctccagtctgtaaaagcaaccacgctttgggctggggcagaagtcaggacttgaactggctctggctgggacccaggctcccaggtagccagctcccaggtgacaggagtccgctgggctccctctgattcttaaagcctttccaggtagcaacaggagatcacgcaaagccacgtaagtgtctgattcagtcctccctggtcagttttccagcatagcgttttgcaaaatgtgttctgaagagatactggttccatgggaggttaatatgggttctggggaaaaaaaattaggggaatcaaaaaattacttgtataaactaatattttggaaaactctggagttagagaagtggaccagattgggttttgttttttcacaaatgaaagtctctgagattgtagtgtgtttcagtttcagagggctcttcccaaacccctgaggttaaggaaactcttgtacacagtgggtctcgggcactaactcacagatcacacttctgaaaacaagctcctaggatgccatatctcagagtacgggcttcgacggggcccttcacccagctccaggaccaactgggagcctgttaggactgcaaatcctgtcctctggacctagagaatgaaagcctctgggggcaggctcagaaatctgtgtttccagattccactgggttttcaactccatccagaataattcttctggtgtcactgtgaatatttgctgatccttctgacgtctatccgtggtgcttgtttctgaagtgtagtctaaaccgttggctctcaactgttggggtgaggggggttgtgaccctcgggacagtttgcaatatctacagacatgcttgtttttcacaacctggggaggggagtgggcatctagtgggcagagctcagggatgctgttcaacatcctacaatgaacagcacagctcccaccacaaaaggttatcctgacccaaatacagtagtgctgaggtggaaaactctgatccaaatgcatagcttcatactcacccagcacacacagggatttttatccttatcttatcctgttattactaggaggctggaatctgaagctggggctgtgaaaagatacctcacagcaagccgctattcatgtataatttttcaaaaggtaaaaccaagactcttgggtaaatacgcacttcaactcattaatttatgaagaaaccagtaagatgccatggttattccaaagggcatttaagaagctaaggtattcgtaaggaatttagcaaagaaatgtgaagacgagattgctgagttagataaaaagtggttaatgttcatcatgcctaaacttttgggggttatctgttctattagataaaaagtatttgcatctctactggacaaaagttgaccacttaagtggtgacttcacaaagtctgggatcttcaagagcaaacaatgagatgaactaagagcatgctcctaaacaacttcaggttgtccctgactgataaccaaaggatgtgccatcaaccatttgggccttgtttgcaagctttgaataatttttctggtgctttaaacacattattgttagtattttgagacggagtctcgctctttcacccaggctgaagtgcagtggcgtgatctcggctcactgcaacctccatctccagagttcaagcgattctcgtgcctcagcctcccaagtagccaggattgcaggtgcctgccatcaggcccagctaatttttttttgtatttttcattgagatggggtttgaccatgttggccaggctgatttcaaactcctgacctcaagtgatctgctcgcctcgacctcccaaagtgctaggattacagacatgagtcaccgcgcctggcctaagcacatgacttttaatttactggtgctgcatggtctgtgaaaagtgggtcaaagaaatgggaagtgatgggaggagaggtcacaggaggccaaggttgtaatatggttagaagccatttcttacctgtcttctatgaagtgtgggttgtgagcgatgctttcattcaaacctatgaggtgcatcttgtcatcatccccatctacagatgagaaaactgagtcagaggaagagttaggtatgtcagtagcaggcatgggcaaaggaaggagaaagtaatgatcaagatgatagagggagaattgcaattaagccagagagaggaaggatgatgttataagctcgagggaagcctgagtccagatctgaagcagatatactcacagcacgttcagggggtaatgaagaggctgttatgggtgactatgaatgtgaaggcaacgtgagattggatcagagttagaaagatgacagttgttaatagcatcagtgttattttagccaaaggactttactattgctgtagtgcagtgcctcgcagtacaccatgacagttaagagcccaggcctcgagggaaggttacagtttgaagcccagctctgccactgtagggctgtgtgaccatgggcaagttgcttaacctctgtgcctcagttaccagatctatgaaatgtcggcagtgaaacctagctgatatgactgggatggggattccagagaaccttgtaaacacttggtccagcaaataatatggcctcagaaaatagaagctggatgtgtttacgtacatgaggaaatggacagataggacttaacagaccatggttgtgagtgacttggctgtaagtgtcacagtctcagtttgagtttcctcaaaagcggatgctgtgaggaggatttgagtgcaataaattctcttgggaggtggtccaaggggaagtgtagaggagtgggaaagtgaggcaaggaaggaaaaggaaacagacgaggggtctgttactcaggcaggtactgctctgggtgtctggagcttaactcccctgggaacctttgagaatcagtgtggaatacctgcttccaagccatcccacctgaggggcatgggagctccagattttatgccacaaatctggttggcattgattcaaagctgccccagggggcactgattttgagactactggactactccagcctcagagaaagcagtcagtgaagaggtgtagatatttgcagttggaagttgagccagccctgtaatggaaaagccagaagagacaggagcttggggttgggtggtgagctgtctgtcagtgtctaatgtggtaagtatctgatatggtttggctgtgtccctgcccaaatctcatcttgaattatagctcccatagtccccatgtgtcatgggagggaccctgtcgggggtaactgaagcttaggggcaggttttccctgtgccgttttcatggtagtgaataagtctcacgagatctgagggtttcataaggggcagttcccctgcacatgctctcttgcctgctgccatgtgagacatgcctttactcctccttcgtcttccactgtgattgtgaggcctcctcagccatgtggaactgtgtgtccattaaaactctttttctttataaattacccagtcttgggtatttcatcatagcagtttgaaaatggactaatacagtatccaaaggcataaaaatagtcatgcactttggggaagtaatacacatctgagaagttaaacagaggtaaatacaggaaaatatgtacaaaatacattatattaaatgatatatgaatattgtatatgttttatgcattgtatgtgaaatagtaataatagccaacgcttaggaagtagttgccacatgcctgactctcctaaatgctctgcaaataggttagatttccagcaaatgaaaacaggttaggcagctcaatagaatattacataaccattaaagaggatggttataaagatgatgataatggcatggaaaaatcatatgaatgagaattgaatactaaacaggagattgtgtgtgcagtaggattcctacaaagcaaaacaagcctctaaataaagaaaaagaagggtggaatctgaaaggaatttatcaaaatcctaactgcaattttgttcatgcgttgggattcagagttgttttttcccctctggtttacaagtctccattgatacacttgcgttacatctataatgaaaaatacaagaaacttgaaaaagtacaagaagaaaaaaccttctaaaaaataggtggtaagacccagtgaaagttttaaagaagggaataacataatggaaaatgtatttcagaaaaattaatctgggggcagtgtggaagatggattgaatcaggaaacacccaaggtgagaagtccagcttgaaagcttgtatgagttactgggagtatggaaaagaaagagccaattttagatggttgatcatgaatgagatgatggggaagaaagagaaaagtgccagaaatgattccaacattttaaagcattttgaatggaagaaaataagcaatggaactaatataaatatagttagagagtgagcgcgcaccggctttctttacatttgttgcttgtttaaacctaacagcaatcctatatgctatgcttttaatattcctattttacaaatgacataatagaagattagagaaataaagccacttatccaaggtcacacagggtccaaactcagattattgtgaaatgaactggctagatagaaggatagatgatggatggaaggatgaatgcatagatggaggatggatggatggatgatggatggatacattgataactatatgaaggggaaggaatctggtgaattgtaatgttatagtggaaaatagggcatttcaagaaggaagtggcagatagtcttaggcagtgaagaaggaagggaacagagaaagcactagattcaacaaaaagaaccagtcactggtcctctttgagaaggtccttccagttaaataatggaaagtgggcttaagcagcatgggggactgaagggccaggacatgttggggaacctgtgaaatggctagtcagagcatggcatgtatgagcttaaaaccagatctgaacctaaggaagagatccaacaataggaaggagaggggatgtaagagagaaaaatgatggggaagggagaggagggtaagaagacatggaaaaatggaaaggaaagaaattactggttaagaacaaggacaccagactgcctgggtttgagtctcaactccgctgccctgtaaccttgagcaaaccccataactgtctctgcttccgacccctcatctgttgaatgggaaaagagtaataagctctatatcctggggttcctgagaggaggaattgaagcatgtaacatgcttaagacagtgcccggtgtgctgtaagttgaaactgtgtagggatcctgttgccttagtcatcacaacaaggaccatttcctgggcaacaacccaaagctatagattaagaaactgaggctcagtcacttaaagaatgttctctgagaaagtacacttggagcctcaacattgctctacctgcaagtagttacctctcctgtcttccagggagaaatagattttgtgtaaaataggatgcatggctttgttagtggaaactaaccttcagcaattgtaataaatgaggtacgtgaggttgcatttttttctcctttttgaaaaaagagttaataaacagaggctgttcaataaagcagagttagaaggagtttaggaagcactggagagtggctgaggagcaaggtagtgaggacttggaggacctggagaaggcagatgagatccatcagatcccagaaagctccatcaactcagtgccctttctctattccagaaagtcttatgctcatatcattgatgcttggagaagcctgcacaccacagacttggcatgagaagtcctaaaagcctcattaacccaaccacttaggctttctgagtgcaacccctaccctattctatttgggctcagggtttgctgggccccaaaatgtcccgctgttgggatgaggagattcagttaatacctttctttggttggctctcctcccacatccccctacctctctagccttggtttccagaaaactgtatctgtgctcagcctgctccctcctgcccttggtgatcatgaaacctgccaaagaagcattctctctgaggctgagccactggagaagttgcacatccaggattgattttgcatagtgtagaaatcaatccggtgaacctggcagcataggtatcctctaagtttggttgtaagcccagtggggcagggcagtaaacagtttaaattggaaagttaaaacaataaacaggagagacaggtgaagttggggtttgaaatttgctgggctagaatgggttttctctttctgtgttaatcttatctggcagctaatctttacctgtcatgtggtttttgggggagaaaacggtaccctctttagactgcttccttttctgggaggagaaccctgagaaagactatcagtttgaagttgtccctcctgggatagaaatttatctaattttagtgggtggcaagactatgaacaaccatcattatctgtgctccaataattattaatttaatgacattttaacaaataagaaataacttttattgagcactgtctacatatcaggcacccagctaagtactttcacatgtgatgtctaattaaagcttctgaatatgattaacttcattttatagctgaggagtctacagcctatagggcacacacacatataccatcttcattgatcttcacccaaccatcagaagcctgggaaagacattttgcagttaagaaaagtgaatctcagggacttgtcttcttcagcaaacaattggcagaaccacggtttgaatccaggtcttctgactccatattactttgattttattgggagagtatatgggtggcgtatcttcttaaattcctctggccaggtcctgagaaaagcatttactgtgcattgtctcaacacttgtaataaccctattagggaggtggtgtttttccactttacagtgaggagactgaggcttagagagggtaggtacgccattggaacaaagccactcaggcagttgtaggaagtacagctggggcttataccttcccattctaccctccaggttttccctgctataagcatttcttacagcagtgccttcaataggagaaacaatgacaagtgatttttccagtgggacagcaagaaggtgattgtggtcttggaccttgggatttaggacgggctattgacattaacagttggataggctgctaggtcagtccagggaaaagcaggagggaagataagacatgactgagaattcaggaagggccagcgccatccaatcagaacaagttggagcttttcgtcttctttaagcctactagtttcacttctcattttgaaagaaacaacttgctcggccaacctattgttgctgcctttctctgcctaccacagctatgaaagcaaagttattggaacatgtgaacgtcactagcatccgaggcaagatttaggttctgaaaagaggtcatcagattgtagagttggatctccatttccctggagagtcttgtgcttcagaaaatcattattggtttgtcatcctagcctgtcatggtggaacccctgggctctgaaagattacaggaaaatagctggtccttggcagttctcagaaggttctgtttctcacctgggccaggattgtgcctgtggtttttgttcatgacaagatgagaagagcttggttaaataaggaacgacctctcgttatatatcttctatcctgattgattgcatcagaaaagccattcatctggtttgaagatagacaggtggttgctgtcactgcaccagcagcttttgaagtttgctcagtgatatgattacagcccatacttaagcttctgctccaggaagtgagattgacctttgatcctactcctcatttaaaaattacagatcttggaaaatgaaccaatctagaaagatattggaagctgctgctgctgctgctgctgctgctgctgaggttggctgtcaaaccaacttaactggcctgcattacctagaattgtttttttttttttttttctggttaaaaccaatgacctttaaagcctttttatttttcctctgacaatctctagtggacctatggtcttttgtgagttctgatgggaatcccagaatctttctgtaactgtgggttccaatgagagaggcacatttaacaaagaccagaagaaaatcaaaactgttgctcaaactgacagtgtatgttcttcatcccactccttcattagctcattcattcattgattcgttcattcatgtgctggctctttgtagaagttgggggtaaacaggcgaccaaaaggtagtccgtgaccccaggatgttgtaattcagaagggtaaacagacaaggcagtcaacattgtccattcagtgtgaatgagcttgggagtacaaccactttggaaacccattttgttaatttacctttgatagatacttattgaacggtttttccaagtgtctgtgaagaagacatggtggtggtagggggtgggtggatggtttctgaggacctgataatgtttctccttgattttagtgccagttacgtggcaactcatggaaaacattgagctgaatacttgggcttttgcacctttttgtagtgccttagtgtattttacacaaaaaaataaataaaagtatgctcagcctcaggtgtgttggaaatacagaggagagaccagcccaactttggaggagaacagagagagggacccaggaaggccttctggggaatatatttgacttgggccctgaaggagcaacagaaattaggcactgagtaaaatgggactggatgtacctgcacaaagccagcagcagaagaaaagacatggagtggagggagctggcagttcatgcttgggggaagctgagagttgcttgtggggctggaggccaaggtgcagggctgcaggggtaggagggagcagccagggagggggtggattggttaagaaacacgatgtgcatgtcatgttgagaaacttggatttcaccctggaggcgcaggaactaggggggatttttcagcagcagtgacagacgctcttaaatctgggttttccaatgatcagcatgcttgtgcctgcaccggggcgcaggatgggagacagatgccttttgcagtagttccggagaagaagactgaagaccacattcaaggccctgagagagaagagaaggggacagataccacagagatcatgagatatagcacaacagataagacttgctaattaactgtacggggttacagggagggacagggagaaatcaggtttcttccagcccagcttctggttggaatcactcaggcagagacacatgggcctgagagaggattccccttatgacataaagccgcaaaaattctcattagtcattgcaaaaacatctatttccggcctacactgcaccagccagtgggggaggtcctgagagatagagaaaggatgaattcttgcccttagagagtcacctagagattctggggagacagcaggtccgagtctctctgcctgaaacctctggacagtgtctttggctgacacttacatggtggtcttggtttcttattcaaggtcggtttcccaactctcatagcatcagctttagggcatccccaaatctcttgcagaagagatggttctttccccttgagttgttttgagccaagcatataacattgtgtgaatgtttgaaaacttctcttggttctcagaatgcaattctgacagtgctgaaggctgccaattaaatgaagatttagataaaggctgtgtgggaggtggaatgcaatattcttaaacctaataatggcttccttctgtctttttgaagctctcaaataatcctgattgactgactctctgctttgggcattcccattttctggacaatttaataccatttaaaatgtttgacaacttttatttgggggcagacatccttaggggatggggccgtgggcaaagatacaaatgctgtaccatcaaaggaaccatggatttaaataaggatttttttttttttcatattcagaagaggtgggtacagaaaggatgagggcagcttctcaggttatagtattaaccacgtgaagcagctaacaaaggtatgtgcctggccttgtgctaaaggctttcctcgtatcagttctttcatccctcccaacactactgaggtagatggagtgactagatccattatacaggcaaagtagctgaggcccacagccatagcaaataaactgtggagctggtggtcccagatttcatgcttttagtcattctcttggctctggggtacaggtaagcttccagaactggaggatggagtccaaaagaaactcaagataatttccctgcctttcccattgtatcaggggattcatctgttcatacattcattcattttcccaacacatttactgaatgcccgcaagcaccaggaaaatagcaatgggcacaaccaggttcctatcttcatggagctattgctttattggcagaggcaaacagtaaagaaaattcattagtaatcagtgttgcaatcaatgagccggtcaatcaagcaccataaaagggtaaagtgtgacgaaggtgctccttgtgataggggttgggggtgaggggaggtgtcctggagaggagacatttcaactgagatctctctgaagtagatgagatggccatgtggatctcaaaaggaaagtgtatgccaggaagagcaaaaagcaagtgcaaagtcctaaagcaggaaatagtgaggctaccgcagtgtcgggtccaagagtaggagatgagatcagggaggcagattaggctgcagggagggtgtgcgtgtgatgctgagagtgatgggaaaccactggtggggttgggggagggcaaggcagtgacatcatttgtttttatgtgcagcagaggaagccaaagcaattcagaagaagcctacagaagcttacctcctccacaggctatttttttcttgtttacatttgttaattttacatatatattaactcagtcctcacaaccaccaaatgaaataggcattgcccttattatcattctttcccattttaacaatggggaaactgaagcttagagtaggcaaggtcgcccagataggaagcaatgccttcgggtcatggctcactactcaagtgcctgaaatttcagctagcctttagtgggcacctgctatgtgccaggatctgtatgaggtttggcaccacctagacagccccttgaaccagtggcatgtctcaggacagtgtgagagacagaaacttcagctgagagttaccgtgcaaggcagaaaatgctggtctagcaaaaggaactctgatttcgatttggaagtacagagaaagagcatctgccttggacagagttatcagtgaaaagatgacatatgagctgagactgaaaatcatgttgaagatagtcaaacaaaagctggcagtgtgggagtgggggcttcaagcagagaatcagtggttcaaaggcacagggtagaaggagaatggcagctggctcagtgtggctggagaaagaggctggagtgcacctggttgcatttgaatggtgtgcgtgtgtgtgtgtgtgtgtgtgtgttaatgatggtgatgagatgaggggctagagaggaagacaggttggcacctggtagcattttttaaaaagcaagtaaaccttattttttagagcaggtttaagttcacagcaaaatttggtggaaggtacagaagtttcccaagtacctcctatccccacaaatgcacagccttgtcccactatcaacatcccacatcagaatggtacatttgttacagtcaatgactctacattgacacatcattatcactcaaagttcacagtttacatgagggttcactcttggtgctgtacggtgtatggtggatacatgacaaatgtgtaaattcatgtatccaccattatgatatcacacagaatagttgtacagccctaaaatacttgctctgcctatttgcctacccactcccttctccctaacccctggcaatccaccgatctttcttctatttccatagctttgcctttcccagaatgtcatatggttggaataatatagtatgtagccttttcaaattagcttccttcacttggtaacatgcattgaagtttcctccatgttttcttatggtttggtagctcttttttttttttttttttagcattgaataatatttcattgtctggatgtatcacagtttatccattgacctacttaaggatatcttggttgcttctaagttttggtgattacaaataaagctgctataaacatttgtgtttcctcatatagatcttgtatatatacagtagttccccagttttcatggggaataagttcccagacacccaatggatgcctgaaactatggattgtaccaagccctacatacattatgtttttttcctgtacatacctgtgataaagtttaatttataaatgaggcacagtaagagatgaacaacaattgctccataaaatggaacaattatgacaatatgttgtaataaaagttacatgcatgtgggctgtctctctcaaaatctgttgtagcgcactcacccttctcttttaatctgtcagtctgataaccaagatggttactgagtgactaatggatgatgggtaagatagacaggatggatacactgaagaaaatgataattcacattcccggcaggatggagtgggatgacagaagatttcatcatgcaactcagaacagcatgtaatttaaaacttatgaattatttttggaatttttctatttaatattttcagactgtgattgaccacagttgagtaaaactgtagaaagcaaaccttggagaaagagagactactgtattttgtacatttcatgtacacagtttgctagatttatatgtaaatattccaatttggggagggtaatgtaaattgtattgtgttttaaattcctgatttcattcattcattgctggtacataggaaagtgattggcttttttacattaacctcgtatcttgtaatcttggcataattacttattcttggagtttgtcaatttttttggatttcttacatagataatcattttatctgcaaactaagttttgtttcttactttccaatcactatacctttgttttcttttcttatcttactgcattagctaggacttccaggacgatgttgaaaaacaatggtaagagggcacatccttgccttgctactgatcttatcaggaaagctagtttcctaccatgaagtgtgatgttagttgtaggctttttgtagttgttctttattaagttgaagaagtttctgtctgttactagtttgttgagagttattatgagtattgattttgccaagtgctttttctgcatctattgatatgtgcatgtgatatctattgatatgtgcatatgagcctcctggtcatcatcccaggcttagctcacaaaagttgtgagcagggaggccaccaggaatgtggggcaggtattatgcttcccattttacagaaagtaatgccagaagaaaacagtgcacagttactgctggttcccaatagttgatttgactcctttaaagatttagctgtcccatttatgtgctggataacatcaattgattcttaaatgttcaacaagccttgcatacctgtgataaatcccatcatggttacattttaatatacttacttttcttcatacctgtctcaagagagaaagtagctcagtggttaagactggagtcaggctgcctgggtataaattgcacctccgttgcttattagctgtatgaacttgggcaagatatttaatctctctgtgcctcagttttcacatctgtaaaattatgtcaaatagtactgatctccaagggtggttgcgtgggttaaattatacctaaagaacttagcaccccactcagcacatggtggctgccatgatggtttgccgtgacctctcttcatttgaatgtgtgcccagtgtcttgtttctctctgtattctcagtgcctggtacaaagtcgatagattttaaaagcccatagaagaaaacatacatttttccctgtttgtgggtatgtatggaagattctgtaactttgactagacacttgatattcagataaaatagccctaaagaaggttctcaagggggtggattttctcagactattgtgagcatagttcctaaagctgactctatgtcttgtgctgactctaatcccctcctggccatcatcccaggcttagctcacaaaagctgtgagcagggaggccaccagggatgtggggcaggtaatatgcttcccattatacagaaagtaatgccagaagaaaacagtgcacagttgctgctggttcccaatagttgatttgactcctttaaagatttagcacctgagttagaatccggatggcagaacttctctattggaacctagtcccactattcctctctcccttcattcaacactgggtttagaatgcttgccagcagcattgtggaaattacctcaaaggtagaaacacgtaactcataagcacacatgaataggtataggtcataatcctggaaagacggccttgccattgagaggggaatagcaggagcaaggctacggaagcacgggactctggttgagtctaggcactgtctgcatgtacttggcacattccttaaaaatggcagcaagcagtccattctcaaatggaaattggaacaaaaaataacgtaaaaccataaataacagaaaagaatatatactcaaacatgtataatccatatgcatgaacataactcccctattgggaatttctcataaagaatccccccaaaatataataccacgtccacaagaacccacccacaggccaggtactgtgcgaggcactggaatacaatgggggtaacatggactaggagactcatgaaaacgtcatgacaaacacctgggaaattctgaacgttaaatagtagggaagggtttctccaccatggcatggtggccactttgggcaggaagattgtggtgaggctatcctgtgcatggcaggatgtccagaagcatccctggcctctacccactagaggccattggaagccccatcctcactgtgaaatccaaaaatgtctccagacattgtcaagtgtctcctggagggaaaggggggaaagtgactccccattgagaaccactgctttaggggaatacttaagaagttgaggcatatctgctcactggaaaatggaaatgagctaatttggaggcttaaaacagcagcactgggaaaatgacataaattttaaaaagcagaaagtaatactgcatttattctgtggtttggctgaggttttgggtttcagaggaagctgctgagaaaagagagggagggaaaatgtgacccagaaatcacgggaaccagggaatctcaacaaattgagtatcttggtttgtgtaagattaggaacctggagataaatatgggtcaggcagatgcaagtaaaatgatcacacgtggggagcatggaaattgggtcttaaaagtgagttaagtcaagggtggtatttaaaatatgtcatatgtaaatatgacagagaaaccaccaatcaaaacagccatctgctgaaaccacccactatgggcgttcctgtgcctgccggggcgtgcggggaaacccaagagggagcaccagttggtgaacgtcagtcaatccacaaaccatctaacagaggcacagggattaaattcagagcaagacctggcaaaacagaaacagcccgaggccagagatgaagtgaaagaaagatgacaacctagggcccaggagggaagcttccagaaggttgagttatatttaagccctttcactgtatacctgggaccaaagaccctagagcagcttcagacataaattatgtatatacatgaacaaagacagaaagggagcaaagaaaaatgaaaacagcttgatttgtagggctttcagcatggcgggtggttttctttcccccctcgttttatttagacgtctgctgctgctgcttcaattttgttccggcaatacaagtaaaatatatgtggatgttaacaaagatgtaaagagccttttgaagtatataactgattataatttaacattcattaagtttcttttatcaaaaaaaaaaaactattaagttcattgaagaagtcataaaaacaaaccaaacacccaccaccttctcccctcctggggacatggcagtggccacttcaaagtgggtcaggtctccgtgaaggaaaggggctcttgagagagtgatggtggcccaggggccggtgtgatgtttcatgctggagggatacagctgtccgtttcctttgcctcttttcatcctgatggagcaaacggctcattgtttacgctgacctagtgaggttggcttcaagctctcccctcaccatgttgtaatgagatagtcctgaggacacacgctctgtccattgaaacagattagctctgatcacagcttaattatgtgaagtacagccaaaccctatttatgcttttcctagggatggggtggaacagataggaacgggtaattgacagacattaagaaatagacttaaatattgtttgtcctgctttagtacgcacgatattaatgagatgttattgtgagtgctgagtaaagaggttgctgccggctggttctcatgccaggcagccagcagaccttcttcccaagcagggaattagcgcaggtgttcccttggtgaaagcctggctatcagcatcaacaccttctagaagatccgtgcctcttggtttatttcagggagcctgtgcaactccaaaaggatggatgctggatgcatatggaggttccatgccttaaggctagcttacaaatgtatgaactcgtctgtcttttattccatcagaaatgaatgtacattgtaggaaccagacttagcagagaacacggagtattgggggaaacctcaattagggaataaagagctagtacacacacagatgtgtgtcacatcagactatgtaatggacacaatttaggaacaactaaggtatgtcctgtaattaggggacttgttaaatctgcactgtctaatatagtagccactagttacatgtgactgtttacatttcatttaatcaaattaaagaaaattgaaaattcagtgtcttgatcacaggagaggaattttaagggctcctttgtcacaggcggctagtggttctcatgtgcagatgtaggacatccccgccatcacagagggatttgctggacaccactgagtcaaataaatggtagtatgtccatagaatggagtattctccatattctcaatgaagtaaatgcagatattctggcatagaaaggtcacccttgtgtattgccaggtaaacaagttacaaaactttatgatattaatttcacttaaaaaacagatgcaacacacaggcacatactttttggataagagtgcaaaaaacacagaaaggatgcacaccaaattgtcggcattagttaccttgaggaggcgggggtagatgtttactttttattttcttcacatgtgtattgtctgaacatatttcaatgagcatgtgttactgttgtaattaaaaagagatttatgtgatgaaaactgatgaaaatgattgagaaacatgaacagagggttttctctttgcctctttagagactggttaatggtgctacctgagtgagattgaccagatggcttgttgggagaagaagggagctggtttggagtaaatccatccccaccactatcaggtcttgcccaggcataccctgcttttcctgaatgtcctgaatgttgttgtaggacaacaaatgcgctttataattattcataggacctctcactactaatctttgagtcgataacagcttctgctatagaagggggcagatcactgggcttaaatgtcaaatagcgcctgagaggcttaaacaaccaccagtatgtgtccctctgggagggcttctctgccatttagaagatcaatgagaagatgtcctccaggccagtgtgaggtggtagaggtgtgtgcttgcgtgggcatgcctgtgtgtctggtacccttacccactgaaacagcaaaggacatgccttctcccatatgacaaatcggtacattgatgatttcgagttaaaaacattggataaattgcagtttcagaaagggctagctgacttgtctcttcctacatgtagcaggccagaaagattcctctctgggaggggcatcctccccctgccagggcaagaaaatagcccttatcgccagagactgcggattgcaggctgcagtgggcttgaataaatacccttactgaagtggcccttagcctccactaggttttttgtttgtttgtttgtttgttttgagagggagtttcgctgttgttgccctggctggagtgcaatggcgcgatctcggctcaccgcaacctctgcctcctaggttcaagcgattctcttgcctcagcctctggagtagctgggattacaggcatgcagcaccaggcccggctaattttgtatttttagtatagatgggtttctccatgttgttcaggctggtcttgaactcccgacctcagataatccacacgcctcggcctcccaaaatgctgggattacaggcatgagccaccatgcccagccaccgccactcattttacacagtcccctgtatgtctcctagtgactcccctagaaattcactgaccctagccagatcccatttgtcctgtctttgtcagatttatcattctttgtctaaaaagttcaaaagcatcttgctttggccgcttcttcagacatcactctcttgtgaagatcccttgtacctggaaaactattaagatccgtatgcttttttcctgttgatctggttgtctgattcgtgtccatttggtttctaggtccagccaaagagcccacataagaaccaaggtggggttgggggtgatctctggtcccctttgtgatcctcttctaggagatttacctctctgctagcttacatactatgtgaatatagcgtgggctttcttcttgctcttcagaaagtcttctctaccctccctcctcctaccatggcgcattctgcagcatgacaggcattccactctgaggtgtgagccatgtgggctctcaggactcttttggctccacttctgcctttgtagctgtggaccacgaggcagtgactttgaaattcagtcttattctgcggaaatattacttactcgtccctacctcatagggtggtttttcgaagtcagtgagacaaggacagtgaagggttgaggcagtgctcagcacatagtaagcgctaaataaatgttagcttttgttgaaattaatcttacttttcactaaattgtgctgcaaagcaacgtgccattgcctgttcttcacatggctgtgtctctcctcctcagatggatggagtaggagggttgttggaagacaaaagcatcctgcttcactcttgtctctccaggctcctgacagtgatttgcactagctgattagtaaattcatggcagtgcctggtgcctgagagagcgagggttgggtgcagcttggctacagctctgaacacagcagtgggggctcagttgcttggaaaagctgccagccagtgagcccagcacagtcagagtcctgtcaatgcagtaggtgggtaaaataagacaccagtgtgcctttgaagcatgactttctgagggagaaggctgggagcctttacatttgatgactgggagaaaggacccaagtttttcctgtgtgtttccttaaaacagccttattctctagatgtgatttgttttctgttttattttcaaagagaagaaaatcttgttaatacttgcttattaactaacaatttcactttactggtttggtatgtaaaactgagggttttcttctacccagtggcagtttttgatatgaaacagtaacaacaacatcaacgtaacttgtatttttgaatatatttgatacagatattggttaaaagcattttgtacatatatattcttacatatttgtgggtatgtatgaatacatgtatatatgcatatatatgtgtgtgtgtaattgattctcattattcatgaattctgtctttgtgaatttgcctactcagtaaaatgtatctgtagctcccaaatcagtggtcatggtagtgttgtggtcacttgcagacatatacagagctgtgacaaatttgaatcatatgatgtatatgcttccaggtgcattcaaactaggtgagactgccttcttgttttagctttcatactacaaacaaatatccttttcatgaaccatttaatgccacatttgccacaattttatgctatttcttggcaattttgctgtcaaaatggccccaagtggactgcagagtgctctctagtgtctctaagtgcaagaaggctgtgatgtgtctgactgagaaaatgcatgtgttagataagctttgttccagcatgagttacagtgctgctggctgtgataaattttaagtaaggcatctttaaaccgaggcgcacgtaaaacaaggttatatattgactagttgactgaactgtgaccagaggctcacaggaacctaaccctgcatttctactaggagcaatggttcaatatatgttaagtattcatggtgacttcatagaacataagtaccataaataagagaatcaattgtatgcagacactccttgatttatgatgagattttatcctgataaaccatcctacatcaaaaaggcggctgcatgcctacctcaaacatcacaggtactctgcttcaccttcctcaactatgtcatgcctcaactctgcttggactctgcccaactccagacagggacaatgtgacagtagccagctcctctctgaactgacaccctgtaaattggacctactgaacagcaatagtttagcctaacctactttatatgtgcttagagcacttgcgttagcctacaggagggcaaaatcattgaatacaaagcccattttataatgaagtgttgactgtctcatataagagtattgtaccacatatttctggaccaggaaaagatcaaaattcaaaatctgaaaaatggtttcaatggagtaagtatttcttttgtaccattgtaaagttgaaaaactgttgtctagtcattctaagtcagggaatatctgtgtataaatcgtgtaaaatcctcccagaacctttatgagagggtgtggactgtgattcttaagttaatggcatccctctctgcctataacgatctcacgtctgtttttttgccaaaaaatatagctgctggggaacctgttcagggaagttgggatgtgtttatccttaggtgtttattcatctttccaagctcctgcaatcaaccagaaacacaggggaatggaaggcttagtgtttgttgtaccaattatgccacaggcagtatcttgtgtattttaagtaacagcactgctttggtaaggcagttgatcctactttcaaaggcaaggtacctgaatcatggacaatgaggccaccatcagccctccctctccaatcaatggatgaccatacactgtgcttgttccttccacatggagacccatacttgaatacttggtgggtaccttgagctaacctctcactttgtgtggaataggcagtgggctataaggggaaagcacacactttgaagccagactcacttgcattggaatctgggatgtctgacataacaacaactactactatttttttggccatttactataacctagtcgtaggttaaccatacaacaaccatggtaactgaggcacgaagaacatctttcttatttgtggtgcatatcacaatgtaaaggtagtcctgttgatacacccatttttagaaatgttaaatggtgtgctcaaggtcacacagatggaagctggtgaatccagaatttaaaagtagaacatttaatcccagagccagcctgccttcccaccatccaaacgatgctatgccacatcttgaagaatcagaaccaccttgtcaagatgggtgacaattacaacagagaaatgatgtaaaatgcagtgtgtagtttctgcccctgagatgagttcaggaatgggtccagttcctgttcttaaacacgctttgccctactgcttgcaagccaactcggagccttctgatgtttctctccaaactgacaaaggaatcagctgttccttctagagggggaatactttgacttgtgtcttcagaagttatctgatgccagcttattcacatcgcctcacctcctagcagctggagcaggaatgcagcagtagggtattgaaatttaagaggttggccttgagtcactgacttagctgggtatcccataaagcagagagcttatacatttctatcgtattagggagacaattccagagagtgagagtgaaggaagaggggattgaggcaggtaaggaggggaggcttgcgaaggcgcgtactgagctggccatccccaagtgcaactgattgagaggtttgtagagctttgtccctgagaagcctgcctcaccaggatgtggtgtggggagatgaaataattcctccactcattcccatctgctattggccatatgttggctcaaggggcgttcctttccttgcaccgtaggattgtgcatgtatgatggggctcctctaccgagttaagaaggaagcccttggcaagggcggagaggctctcagttcagagaggagttgtctgatgtcacgttgcccctatctgaagttggacagagcccaggcagagctgagatgtgacgtgagtgaggaaggcgaagcagtgcacccatgatgtttggtgcagtcttgaaagcgcagtcactatggagccgccccccgcctctccccttctgagccgccacagctcacgcttgctttctatgtcctgagcttttctgtacctctgtcttgctatgtcaggcattcatggctgtgctgttagggagccttttcaatcttctcatgctccagtttcaaagctgtctcaaaatgagataagttaaagcctaatacagttttttagaaacacctgtatttgtcacgctgacctaatattaacacaggttctcgtctctacttgaatgttacgcatctatcgcgacaccattaccaggactgcgctctgaatctttagagattatctgtgtgcctgatgtcatgaataccaagtagatgatgtaggatggctataccctgccagggagacctgcctggggtaccagtgagtttacaaagacttgcaggaggcagcatacagaccatgggcttgtagctttccagttcaactacaccaccaaaccctggcacctaagactttggttgttccccgtgtcctatgagccctgatcacaaggtgagcaatgccttctaggctgggaaggcagagttggcaagaactgccaaccccagggatggcatcaggcccgctgataattaaagggtgcctaggacatattgcctaagctgttattggttctagaggactcgacttcattccatgaggggtaaaataagtagatagggaggcattcagagcctgaactggtaaaggggggacagttataatattaccccaaagctacagctcagggaaaaccattagggcaatgtttttttgttgttgttgtttcttccttaagaagggatctgtgctatgtactttagcatcacctgagatggtgtgaacaatgataagagtttgaggccctgtcttttatctacagattcagcattccttggggtaaggtctgggagtctgtgttttggcaagagttctgagtgattctgatgtacactaaagtttgggaatgactgtcgtaggagtgttcagtaacttgggcctcctggaatgctctaagttgtgtcacagcccagctgagtacctgggacagaacagggaaaagcaaggagtgacgatgtcagagaggggctgtgagcccctggctttggagccagacctgtaccttcctggacttcagcaagttccagaatttctgtgcatgtgagtttacccctgtgtaaagtgaagatgacaacagggctggctgttattctagggggctgccccggtgtacctggcacagtgcagtcctgctgattttcatattgctctcattgccatccacatccgagggagtaaattagcgggatccacaagccacggatgagccttgaaccagagaagccacaaactagcatttaggacttcctgaggctcaggtatgagcaatgctgcccaagtgcatggcatgaaacccactacagaccatcggaaacctcttgaggacaccattcctctctggtagcctttggggcatcattgaacattgggtcagcatgttagatacgatgaagttccagatccaaggacaagccctttagatgcctagtatatggctctgccctggcatttaacgcccaggagattatattaccctatcaagcttatagaaaatggacgcaggtacaatatatcttatctactgccacattgataaagtctacagagaaaatagtgggtcttttaggacttacccattgagccttttattttaagtgacacattctagtacggacttaattgtaattctgataacattacttgtaatactgtctccagtccttggaattaatttgactggaaaaaatccagaaggacttaaatgtttctcattaaaagcattatagataacttattagacattgtgactaattgtagtatggcccaatgtaaagccatcccaattaagatgctgtttcttctcttgtgattagttggcaaaccttttccatacaactgtgccctctagaatgtagatcaattaagcatatataattggacggaaccatttgctccccagttatcaccctctccagtgagatataccccagccgggttggtaggcttgtgaagacaaatgtcctgatctcactttagggagttgacaaatggatctctataaggcagcttatgtgctaaatatttctcctggccccattggcagagatgtagtctgttttcccagtacagagaatttcttgcagcctgtacattttccctttaaaagataaagagaaaccattatgcagtttttattcctgacctgcctcaaggagcagatacggactggaaagcagcccctgttggataattgctgcttgtctcagagtttgagattctgccggggtttcttgagtcaccgagcatatggggcttcaggttggactgcccactccagtgcctgagaatttactgggaagttttaataaagtagagcagaaattttccagctgcatccgaaatatttgatgtcatgctgaattgcaaatccctagtcggaacatttgaacatcatctagagggatcaggaaataacccaaaggtttggtaggcgacttagaacaatggctgctcttaagagggaacaatttagagcgatttctttcctcttccttctctccaccttccccactgatttctccttcacgcacctatgggtgtgaaatgagaaaaaaatatcacttgaaaccaaatcaaaagctacagcaattctggaattaataaaagctcacatgtagaaggaagtgtgggtttatgggtagggtgaccatgcactacccaggtttgctttacctgaaggcagcggggcacacgtactgaggactattgggtagaaggacagatggggctataattaggggatgagcttccaacagattctcggaatgagctaggcatttgcaatgttcagagtatatagactggcacgtaatttggggtagtcgggtatgaaacttatagacacatccatggatttccctttaataaatcgtctcttctagtagtcatttgtcatcaacgagcaattcagtaaaagttggaattgagcataatgttgcatatcatttcagaacatctggccctaatatgtagtaacagctgtttagtacctgagatataaacaaaacatttttcccatggctgtcactgttcctcctcctggaggtgcagtatcaccgaggcttctctgtatttcctatcatgggtaatagtaacaatatcaataacacaatgatgattatcatgtattgtttaactatgtgtcatacactatgtcaagcacttttcatatatgatcttggtaaatcctcatgccagcctttcgtgggtattagatggcgaggggaaagtcatcaagccagagactgactactttgaaaattgaatacaagtctgtgcagtgctacagctaacattctttaagtactaaaataaattgcttgtaaataaagtaaatgaaaaaagaacacaactgtgtaagtcacaaatgaagaaggcaacaaaagggaacccagaagggttttttattttttggtgtggtcttcctttgtttgggatgtaagacactgattttcctgctatattatagtatgtacactgttacgaggtggcagtgcagtaccttggtcatgtaagccaatcaacaagacttgttcttttcctgatgttcaagggagtaattccttaagcaaaatcacatttatacacatgtcttttcaaatttttaaccaaatatttcaaaatcagttgtttaagaaaacgattacacctataccttcaatatcaaagcagatcaatttttaaaacaaatttactaacctagtcttcagatacataggtttgtttttctcactaatcctttgtggtcactgaaagagcataggccaccccagtcttttgcccagatagtgatgaaaatgctgatcttcgtgaatccaactgaaattttaacttcgtgcccaagctgttctagaactcaatttatcagatccagatttggtattctaaagactagagtgttttactttctgggtgttctttgggcttcttttctattcatgaccctttggattataaaagaagagaaacaccatggggcagatatgtccaagaataaagaaaagagaaagttgcgcacctgagaagtgccccctgctggccagcatcatttctctgtgtctcactacagaaggaggtctttgtttatgaattctgccctccccctcttgccctgagactatcacctgctttggaaagaatggcatcatttccagaatgcccctaggggcattagcttctcttctacactctctctcttgcttttcaatatggaagttaacaacgcagtctttgaagctgggccgattggatttcaaattctaactcagtaacttcccaactgtgagtttgagcaaggtatacctcttaaggctcagtgttttaatctgtaaaacaggaataaaatagaaataataacaataactatctcatggggttattataagagtcaactgatataatgtatgcacaccattgagcagtgtgtcttcctcattattactccttgatagatagctagaattactgagcatccgacttagaagtctaattctctattttgattttattcctaaactcccatgtatgcaccaccaccttaaactcggtacatctatctaggccgtgatgacccctctactggcagctttagtccctccctaatcactgtatttctatcattgatattaatattcttgaaatcacccggattcgaaacgtccagtatcattcttggctcttccctccactcttctctgatcctttcgcaccatatcatcccctactgcttccccacacctctatctaggtgatcagtcaccaactcctattatttcctcctccatctgccttgtaaatcttaattccattctcctcactgattcactgttctccatagaattccttgtgactttcttggaggtggggatctcatgtttcctttaagaaaggaaatatatatgtgtacacacacacacacacacacacacacacacacatacacacacacacacaaaatatatatatttggagacagagcctcactgtgttgcccaggctggagtgcagtgacatgatcatgactcactgccacttctacctcctgggctcaaatcttccttctgcctcagcctcctgagcagctgggaccgcaggattgcgtgccaccatgtatggctaatttttataaagttttcttttttttttttttttttttgtagagatgatggggtcttcctgtgttgcccaggctggtctcgaactcctgggctcaagcaatctttccaccttggccttacagaatgctgggattataggcatcagtcactgtgcccagccccaggaaacatgttttatttcttgtgcccccatcagtgttcgacgaagccccgggtaggaatttggtagatgcaggtgtttgattaatttccccttccttttgtttctcttctcagccgtgtgtctctttcctctgtcattcattcaaccattcattcattcattcaataaacacttactgaggttcacactcagtcaaggaactgagaacactaatgccattactagttctctctagaaactcactagcaggaaataaaagtatccccaaggagaaagccttgggaattaaaattttttgcacaacaaacgtttattgagcactgactgtggcactttgctttttagtgatgaacaagatggacacaaccccagccctggtggagcttaaaacctcacaggtattagatgagcatgagataaataattctacgagccatgaaagtcatgaaagggagaatgcaacagcacaacaaaaaggttttcatttctgagatggcgagagcctccctaaagaaatcatatttaaacctatgttgagaaatcgagtatagtttagttaaacctgtatatgttgagggcaggaggcagagtgttcacattagagtgggcagagaatgattgctccacaactttacaggcatgggttcttgacatatgcatacaagctcatccatgtggaagtgttagcaacagaggcaactgtatgggcagcaactccaggtcctcaaaaactgagaaaactaaaattctatccaggtccggcaatgtgtgctttctgcatctttagtatgtgagttggtttagtttgttaattaagcctatggaacaaaagtgttctttctcctccagactttcaaaggatgtactctagggctcgaagaaggggaacagagctgattatgttggtcctgttgtttgtgtttttcttcccatttaagaacgtacatttgaaggtgcagtcttgaaattcttgatatggatggcagacacttgtaatgagagaggaattagcagaaaatcacacctcatttcaataaatcttcaccccttaaggcagcctggtgcccttcctgcattggcctatggaagtcaccatctggactgggaggattgatgacttcagtttcacccctttctaaatagtgtttatgaagatccctttcttcaggtcagactagagattgtacctacaaataatattgtaattggaccacttagttttcatctttgatttgaggtatttgaaatgaatgtgagattaaagcaaatgaaggggcatgagaagtgttagcaatcctccagacagggaaaatttcttttcattctgtctccatgatatcaaactgaaatcctcagttaaccacagcaggggcaagtgcctgagttgaaaatgtcttcatccttgtattcttaattcatcacctgagaagtccttggatcaggtacgtgaaaccagaagagagatctccctggggatttcatagatggtggatatttaaatatgcaaaacattattgagaaatatgagatgtgtcagccatctcctgtgctaacattttttccaagtcaattactttgtggatgtttgaggtgggggcacactggaaagaaagaaagaaagacaggaggaactaaattatttataattatggtatgtgttggcgggacgggggctgccttctgagacacaaatggatgacaaagaataagttatctctttatagatagaatgtggcaataattgcattgtctctggattcaaaaagtcataatctattaatttgatggatatcaaaaagctataatctgtcaatcaggtgtcagaagaaagagtctctcaaagctttgaagcatggcatttagaatacccctggatacctttatttctattctaatattaataggaaggaaggatacaaacatttttggcatagttagggaatggatatcattttagctgtcttaataattttgcaacttaaaaatcgtattggataagggtgccgtattgaaaaaaatgtgtaaaagacacactacagtgaattagagggagataatttcatcctaagatttctctgacattaggcattgtggcatcgctttcttggtttaaatgtgaaatagaacctgagattatttttcataaatttatctagcccatctattatttctctatattatatggctgtatacttgaaacataccaatggggactgaagaaaatgcttaagtctataaatggaatgtcaaactgatggaaggaggaaattggagatgtcacacacagtaaaaacacagcttttccaggacccagtaagcttgccattaccaaggaattaaggtattctcctctggtaggaaaagaatttgactccttggcccagcacagtttcaaagctgcatgaagtcacgtttgcctcattacaattcctttggttaaagatgcttttctaagtacttcagaaaatgtatgcaaaaatattttttggtgcggaggccaccaaacctgctggactcacgttcctgcttttggcaagcaaagcaaaagaaccttctgggttcccttcctgcctttcctactgagatcaagctgaaggtggaatttttctatatatccagtccagcctttgtgacctctgcctttaacacaaacaccttgtttaaaaagtagacttgagggagggcacttgagttcagaagccaaaagaaatgggtattgctctttccgcgctaagcagttctgaacctagaccatatccttgggagaccagagcagctgtaagcagcaaactgcctcttttctgcctccctgtgaacctgcttccctggagggtatgctcaaactcaattccctgttttattgttcaaaggacagggaagaaaggagggagaaaagattgattaagcccccagtctgtgcctggcaacattctaggtgctttgtatctgaaaatctattttattttcacaatgatctcatccatgtccatggattcaactttatctacctgaccaccaataattcatatatttggtctttcggtttagtcatcttggtgctccagagctgtatacccactgcctacttgacattcttcttacatgtctcaaaggcaccttggattccacgttttccaatttagtgtgtgatcttccctcctaaactcaaggctttctagtgttccctacctcattctgtggcaccattctccatccagtttttcccctttctcacagtcaattaaaattctgttgattttgtctgctaaatatctcagcaagaatccatccagttctctccctctccattgccagtatcctaatctgagctaccatcatttctttttttttttttttttttttgccttgaatatcaatctggccccccagatggtcataccacaatcactcttaccttcttccaatctttctcttctccccaaccagaatgattctttgaaagcttcagtatgatgcatatgacgatgtcattcatttgatcaaaatccttcagtggcctgccgttggttttttttatgaaatataaaacaaaacctcggacatgagctataagaccttgcatgagatgcactttctgagaccagcccctccattctcctttcatgccactctacactttcaactccagccaccccagtccttgttaagttgctgagactatcatgcacaaaggtatttacacagttttgttttgggtttctttgttttttgttttgttttgttttgttttgtttttttcaacggagtctcactctgtcaccaggctagagtgcagtggcgcaagctcagctcgctgcaacctccgcctcccaggttcaagcgattctcctgcctcagcctctcaagtagctgggactacaggcacctgccaccacagccagctaatttttgtatttttagtagagacggggtttcgccatgttggccaggatgatcttgatctcttgacctcatgatccaccctccttggcctcccaaagtggtggaattataggagtgagccactgcgcctggcctacacagtttttatgcatattgctctctgtacggagaaaggtaatgcagactcattcatcctttgtatttcaggtctattgccacttctttgggaaacatcacccctcagtctagatctgatacccctcttattccctcttctgttttatacctcttcttcctagcccaggtgtttacaattcccatttatttatggggaatatgtgattattgtattttccctactgagattcaaagctatacaaaggaaaggactcttctgcctttttttttttttttttggtttttaactcattatgaaatccccactgctgagcacaatgctgaacacctttgaagtaattaataaataacgactaaattactgctgtgtagataaggcagataggattaggttctttcaacagtgaggaaatcagagctcattctaacttaagggtttagaagtatcagaggcaggactctgacccgggtctccagactcacaaaacacaatacactataaggtgtacaatagcactgacagatattttttaaaggttcctctcatctcactatactaacacaaatgttttcagttctacaatctacatttccccctccaatttttctcctcttttttgactgccttgatggtttcagtgggtcctggttaagcctgtctttaagtttctaatcaaactaatccaagtgaatttggcttctgaccttgctctcacatatttgccatctctaaatgattgatgtctgcttgatccctgttggaaaagcgtctgaagatatgatccagaaaatctatagttgcaaatctagcataattttaatgaatcgtggtcagaatagtaagaagcattgcacagaaggcttgcataaaaaatatgcatcttctgtcatcttcaccctctacactggcctcccaagtccccatggaaggtatctagtacgggaaactttcttttcctgtaagaatgttgtggccaaacatgctgtgtattggatggatggatgggaggatgatttatattttcatctcggtatagttcataggtctaggatcagaaataaactagaataaatataaatattgcttttcttaacgttggtttaaaatgcaaatgcatggcatacagaaaaaactttttttttttttttagctctgaaagctcaatttttactacatgatttccctagtagaagtactttttgcagggtataagaattttctgtttgcttatctgttttcagtctagaatgttcacttcttaagggcaaggaataggttatgtttaccttcttatctctggagacttgtataatcctagctggtcctaagtactcaaaagttttcttgaatgaaacaaagccttctccggatgaggaagcttgtcagaagcttgagtgactggtaaggagggtgaatctctgctgctgatttactaagaaatatttggatctttccttgaagctaagggtatatacctacttctgtgcaaaacaggtggcatggctggcccttgaagagtacacagtttaaggagacagtaatgggtacagttatcttcttaaagatctgggccactttgttcctgaaaaagtgtgggaagtttctctcttaggcagtctatctcttagagcccagtactcacagcaaaatatttataaaagaaaacaactctttcatcatccctgacatagcctgccctcagcctagaaagaaaaggccaataattgggactgtgtggttccaggagataggacagaaggatagggccaattcaacaggtaagaaagacagcacactcaagggagcagactccagttgatcaccgctgtgggcagctgaggcacactcctcccaagacagctatagaaagtgcctcagaaatgtctgtctctaggacacggttcccattatccatgggtcaaagcttgcccgaggaacgccagctcctttgcattcccaaactttgcaagcatgtgtcatcctgcaggttctcttgggtattccattgtaaggagtctgagaagctccaaggaagaatgcagaaatacggggtatagctgaggccaggtgctgtctgatcatatacctgggaagctgttgttgatcacgtacctgggaagctgtctgatcacatacctgggaacctggttgttatatccatggctggggagcagggtagcagggagcaagaactgtccaacataatctagtttacctatggactttcaaaggtttgcaaagatttacctcctactaaaatggcttgtgagcatggaaggcttaaacattagcagagcaggtagaaaaataacgcctggtaagatgccaaatggtggaaaccgaggcagaagatagtcctctggacaaggtcagcataatctagtacatatgaactcactcacgctcctgcatcagactcccctggttttggaatctgtctctgttgcttcccagtggaacctgagaacattgtttaatcagccttggttatgtattcgtcgtcagataaatagggacgttaataccaacctcatactgtttagattttggatcatttacaatgagaatgtgttcatctgttacctgtgtaactgaacataataatactatgtttgaacagatttcaaaaatgggtttggatctgattttaaaacatttgaaacagatgtggaacaagtttttaaagaaggaaccctatctcataagattgtcaggatcattaaacatcacgagtatgagcccacaggaaaccttcagtatatcgtgatcttcttgacggtggtgaagaaggacaaggaagaccaccaccataacacacgggtcttctttggaatggaggttccaggatctatggggaatttgcttgtccctatccactctcatccctccactggggaagagagagttggtgccagtcttccagcgtaggtcattgttggctcagcatctgggaagaatctgggcctgcaggaaggactcctggacagtgccatgagcagctgataaagaccaagagaggggaatgtggggcctggtctaatgagagttactgccataactggcatttactgagcacatcctacatgtgactctgttctaagtactttctgcatgtcgtgtgttagacatcaagagtcgaggcaccctcattcacattctacacatcatgaaactgagacttgtagaggttaggtagtttggccctcatcacagtgccaggaggtgcgggtgtaagatttgaacccaggaagtgtgattcttgtagcaattgctgtgtggttgagatctggtctgggaagtggggctaacacagaagtgtggataggacagattatttctgcgctccaaagttatgaatatatatactccaaaatatgcttcagtgactgagtgagacataaatgggttactctgtcagtgatcattatattactccccatccctgcatgcatgttagaaaggcacacacaagctggaataatatgaatgacatttaatagactacttacaaaaatgttggaagatctggggaaaactaacgaaggaactttccgtacttgaggcctatcaatagcaggaagttattactacctctaggcctgaaagggcaaggagaagggggccaatggaaccaggagatagaaggctggtggagaggaccgcctaacctgggtggtggccataaagcgagggagctggagagaaaaagacaccttaaactcacttgctcagtagctcccatgagccaaatctagtggaaagccagagaagaaagtgagaagagaagggagcccataaagaagacaggactgcctacaaaggccagtgtctcagagcacaaatgaggatgcagatgagagcaggtctgttctggcatggcaaaggggcttgcccagcactatcagcaatctgcaaaaagatattcttgggaagactctggtgtctgaaagattaaagggaaaatgcatccacgtgataaaatattattcagccagaagaaggaatgaagtactcttacatgcaataacagggatgaaccttgaaaacctgatgccggtggcaacgaccccataccgtgtggttccatttagatgaaatgtccagaataggcaattccatggacacagacagtagattcgtgattgccaggggcgtggaggaggagggaatgggaagtggctgctactgggtacaggatttccatttggggaggtggaaacgttgtgaagctagatagtggtgatggttgcacagcattgatagtgttccagatgtcattaatggccaattttatgttatgtttgttttctgacaattaaataagcaaatacataaatgagaaagaatttttctctcataatgtttgtttgcctcttactcattttctgagctagtcaccaaaacgtatctgacactttcttgcttaacctggcgggagtggtagcggatgctcctggtgcccccgttgcattccctcacctttctgccagctcagcttccagtagccagcgcctgcctgtgtttctctgcctgagggctctctccggctgccaaagcccgtgtccacgcacagcagtaccagagaattaccaggtcccaggagcagcactcgggtgaggactgacatgcgtcaatgtgtaaacaccaacttccctgcactccaggtggggtccagagctcagtgcgtcttgctggctcccagaggccccagcccggttgagctccagttgcctgcagcagttcccaggcttagtgcacttgactgtgctgccacctctcctttcatttcccctcttccctcctggtttctccttcaccttccaaatcaggtggggctctcaagcccttggctcaggatttataataactacggagtaataatagataacatgtattgaatttttattgttaaaatgtgtatgagaagacactggcttgtgttcattttgcctctcttgttcccaatgataagactgccttcacgcatcaggcaaataactataattggttcctggacattagcataaacagaatcccctagggaaagtgctaaaagtgcagattcccaggccccacccatcaacatgctgattccatctgtctaggtgtgagccttggaatctgcatttatcaagcttttctggttcttctaatgcagaatagagtagaaagttttcattgaaaaacactggacactggcatgatgagaaacagaggagaggccacctattggaggcaggcactggcatctggtcagtatttcaacaaatgtggtccctcaagttctgcagggagaaatactccattacatgtatacatttactttctcttaaactgatgggatccatatccaagtatgaaagttaatttcggtatttaataatcattaagtaaagagagagtgaaatatctacactatgtaattacataaaacatgcttctggcaatatttgccccctaggaaattcaaataggaagtctccaaggagcaaggttgtattcttggaggtggacacaaagtaattgagctttgctaatggagataattaattaggaaacggatgtgcttgcttctgagaaaaatattggaaagatcttctgagaaggcctagccctctgctcttgtaattttccgaagtctgtgccaccctgaggactggtgcttcccctgagccatgacccagccacagttaggaattaagggagcagaaaacacacagccattgcccacagttcaggctggtcctaagaatgcctgggccctaggaacacactatctccaggaagcagctctgaattagacctcgggttcaagttccagcccccacttatcagctttctgaacttagccaagttattcagtttccatggagcttagtgttctcagcttaaaactaggggttgtaatagcagaaacagtcatcagtatccagtgaaacaatgctctgcaggaaaataagtcgtagatcagaagatgtcgccctggtgtggtcttactaaaccttccctgtctcagcccggggtcttgtttattgcatctgggttacctgtttgcccctttctgtccaggtttgatctgcaggaacctagccttctggtctaacctttctagcttgtctgcttatcaccccaacctccccgctttctggttccagatgctagcctgttcttgccttgtatatctgacttgctgagctcactcttggtgctgcaaagtggccatgccatgaatcttccatagcccgatgcaatgtcaccccagtgacacggaaggatggccgtatggtgagagactgcattcagaccactgagccttctcttccctaattatatcatgccagaaacagctagaccaaggagtcaagcacacaaatatagttggaccagaaggaccagcagctctcaaggggtaagagaataaggaatcatgtgagcattcatggattgaggaatgcatccattattcaagcaagttgatagagataattaattaggaaatggttgtcttactgtcctattcaccaagctatccacaccatctagctcagtccatactttcttaatgagggagaaaatgagactcaagccaagaaggcaaagacttgatgtggatgatattttttctatttttgctttctggtgatggtagacattatattacatattattaggttaaggtaccgatggttttgttttctgtgttgataaaaattgtgcgctttttattcttttacagaactaataaaaacatgacacattaacctttgacttgtctagtctcctcttttattaaatctgctctaagcagttggatggggagtgccttttcgcctgtctaccccttcccaaggactatttatattgaggcaaccaaatgatcaaggaagaattcgtgaatagccatgatcaaagtaaccagacagggagttagaggttcaatcgtatttggggaaaatggtccaatgatggggaaagggcccaggttttgacacctgaagacatccctggatttcaggaatttgaggcagatccctagagctcagatctaggattcagaacgaaacggtgactgtgagagtaaaccatggtgtctgacataagggtttccttgattaccctttaagggcccctatgaatgtctctgggtcatcagtcccttagataacatcatgtgtctacagctgggatagcaagtaggttttgttttgtgggtcaactcacatgaagaggatgcctagatgtctgcggtgagcaagattctagagctcatcaggaaagtatgctgtagtcaattagtgatgtctgccatgtgcacgggtagagaagttatgtcatgcataccacagactcaccatctcagcttaatagaccatgaagtcaggatctggggagctaccttaatgtatgaggactgtttccaaaatatttctgaaaactattgatactagatcctacctggagtctctactggttccatagcatggaactgtttacaattgcttttgatcctttttccaaatgattgagtgctttggcataaacaggtcaggtacagaaagcacggcatttgagaattatcctctgcaaacatgacttgcaggcatagcctgagcccactcagagcccatacccaagttgtgctttcttaaggccacagcctccttctgagagctgaggaagataagggtggaggacaaacaacttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacattgccaggcaaggcctttctgggagaaatgatccaatgaggggaaaaaatacttcagttttgttgagagatgatcttaatctgtttgagctgctatataaaaaaataccatagactaggtggcttaaaaacaatgaatgctcatttcacagttctggaggctgggatgttcaagatcaaagcgccaacagatttagtgtctggtgaggtcccgctttcctcatccatggtgccatctagccgtgtcctcacttggcagaatggatgagggatctggatggagcctcttttataagggtactaatcccattcataatggctcatcctcatgacctaatcacctcccaaaggccctgcctcctaacactatcaccttgggggttagacatttaacatatggatgttggggggaataaatctttagcctgtagcaaagataatgagatcaggtgtaggtgattaagtgacatctggagaaagaattattagctgctaagaaagatgtgtttgtgcctgtgtgtgtgcacttgcacatgtgtggatgtgtgtgtgtgcatgtgctctgtgtgtgtgctttgtacacaaggcagagtttgcagtctgtgagggggccagcaggtgttcaaccccgcctggctcaggcagctttcgcttcagttggcttttatctcttcctatgtgccctcagccctgtgtcccagggagaggtttaaccaagtctagaatgttccactctgcttagatgccacttcagaggtcttaaaacagaacctttgttttaagcagagacagtcctctttttgatacgtggttttcaggtgctccctttaggaatggccgccacccacatatcatggttcctctagtggttaaatcatgatgaataggcacagagagctgataattaaggtaggaaagagtaccatatttctcttctgcattatccctagtgaattacaattttttctcccaactgcaagtagaaatgataatcacccttagctccacttccacacccttctcagaaatttgggtaatgcatcctcatcttaattatcaaaatacagggttatcatttgcagagaacatgtgttttgtgtttgtggggtctggagagagtgatcatacaatttctaattcaaagcagaatactcttgaaagtaaatcaggactttcctgttgaaactagaacaggaagtcaccttagcagtggtagatctttgaattcgtctcctcctggttctgcggagagccatgagagactagaacacaatcaccagttaggatcaatacacttataaatgcagagggtcttagcatccatttgggtgccagcttcccttgtgtgattggttactggtgtcaacggagattgtatgggagaggaactaaagaatgcaggctcggcttttcccagaggcagcagtgcgatgcatgggtcacagaatatgccagagaacaacgaggccagtcgctcactgactatggaagatgagtccattatttaatcactctggccttcggtttttcagctctaaaaatgagaatattcctttcctcaatgattattgttatgattcccggagataacgtgcatgaaagattttagtgcaggcctttcttccttccgttgacaacccagaatgttgcttgatgcacaggggaaatagagtgatcaagaagagcctttataaatgagagttgatgttgagtaatcattttgggtattatcaatacccatggccataacacccccaccatgtggaacaacacagggaacacgacttcttactcaagctacaacaggagaattcttccttggatctctcttacacagacaacattgtctgtttttcatcaaaatgctagaaatgagagctcaacatttgtaagctcttgcttcgttcaataaagattgtgtatgggaaatccactgcttctctcccttcgtagatgtaggaatctgcctcagacattgtacaaatgggcagagaggggaatggaactgagtcttacccattacgtttaggatttcagggctgcaggtcatctgtttacctaagatggagaggccaagtcctctctcatggtagctttgaagctggtgtcagggaaaggtcagtgcctgtgaacagtgatggaaggtgtgtaaaggaggaggcagggtttagcacaaggggtaactaaatcttaacttctgggatactgggtggtggtggggttactatttccaatttatagcaagatgtaagtgatatcagctggaggacaactttactggtctatgtgggtgtattagtcggttctcaagctgctaataaagacatacctgaggcagggtagttaataaaggcaagtggtttaatggacttacagttccacatggctggggaggcctcacaatcatggcagaaggtgaaggaggagcaaagtcacatcttgcatggtgacaggcaagagagagcatgtgcaggggaactcccatgtataaaaccatcagatgtcgtgagacttattcactatcacaagaacagcatgggaaaaccctgcccccgagattcagttacctcccacccacttcctcccatgacatgtggggattattacaattcaagatgaaatgtggctggggacacagagccaagccatatcagtgggatagatatcatttggaatatggttgccttccattctgatctcattctatcaaagttggtagatcctaacatggtgacccagcaagagtctcttttcaaactggctgtcctcgggggtaggagcagagccagggcaaaccgtcagggatgctaagtaaggagcttcaaggggatccaaggcacctccttggactcagacatgcttgggaccgcgttcgtaggacaacttttactgtccattgccacaatgaaacatggcagtgacagatgtaggccctcagtgatcacagatctatatggcagcaatggttcaagtgcagaaatgacaacagtgtttgtgattttacctttttgtgaagctgggttactggggtttctgtcctggaatctctaaacaagtaaccacagggtagttgcttggctcttgcctcaagtgaaccagccaagagatctcgtccaacactggtatagcctggcagcaactgctacttccaggctgtgtctcgaatgccctgctgggctccatgtgtatctgggaacatggtttctgatctacaaatctaagcccctaaatacacaaaagcgctaaggcaaaccatatgccttaggctcacttttaaacctctctgagcttcagcttcctcagctgtaaaaagaagccatgatcacaggcatgtttatgcactaaatcaaataatgaagctcacaagttcagccctggtcatcaccattcaagactctgaagtctatcaaagcagaattcatgttctctggttgcattttccatcaatggagactcagaaatatttattgaataaaacatcaactatgacaacatattttacagtgtaatagtgaaaacatcattcatctgatgacatgcttcttttgaaccattttgggatggttctgatattgtttgtaacaagaaataaagatccgaggatgatcaagtgagcattcaattattcttaccttcatttaaaaaatatattttcaatattaaggaatttgttgttattgttatttacaaagcaataaaataaggtaagaaaaatggagaggcctgggttggtgatttggtcaccaggcagattgagaatggaaagaaaagggaacagggtaaccatgtgaccaatttgcttcttggaaaagggaccaaataggacccagagaggggcttggtcaggcttcctggtcactgccagtgctgagacattaaagatccaggccccacggagaaccagggcacctggactttgatcttgccataatggtatgcctccatttaagaactaggtcagctgtctttcacaccagctgtgttcttcatgcttagggcaataacatgtataaagtaatgggtatttttctagtagggttaacacacttactcaggtttattcttctaacttgcctgcatccaaacatttttttttttttttcaagataaaaccagcctgtcaaactgtgcagttgacattacttggtaggatgcagaaaatatctgaattagaaatgggcccatacaggttccagtgggaatggctttctcagcaggtatgaatcactgctattaaaaatgtattccgtaggtaaattgttagttatcatattcatccactcttacagaaagccaatgttatcatttgggtccattattaagactatcattatcatagtcagtttagtaacctccttttacataacattggattttttgtgggttttcaagtctcttccaaactgaatctcacaatctaggtttatttttgaggccaccttgcctgaaggctcgaggatgacaggagtgacttccgtcactgccatatttcttctacacttgaagattgttttctgggatgttgctgcaaatggcaaatgtgtttgatgccctaatgtttaacataaatcaggatcatggatgtgcatagccccctcccgtttctgtaaagtattgtaaagggactcctgtcctcagagtgccaggcctcacatttacattctggacaaactgggctgtctgcttgaaagggcagataccacaggttggagcaaacatagcttctgaagaagatgtaatgcatttctgtcccagtaagttgtgcctgattaagatcttctcatagctgggggcagtggctcacgcctataatcccagcacttttggaggccaaggtgggctgatcacttgaggtcaggagttcgacaccagcctgaccaacatggtgaaacgccatctctactaaaaaaaaaaaaaaaaaaaaaaaaaaaaaaaaaaaattagccaggcatggtgttgcatgcctgtaatctcagctacttgggaggctgaggcaggagaattgcttgaacctgggaggcagaggttgcagtgagccaagattgtgctattgcactccagcctgggcaacaagaaactctgtctcaaaaaaaaaaaaaaaaaaaaaatcttctcatgaccccgggtgggtggctggggtggggttggtggagggaaataaatatgaagaagaatggtgagacaaccagtgggcatatactgtgtagactaccagaaagctttggaaatgtgtcaaccctaaagcattgctatttttaaatatttagttgtattttaatatttagctataaatgaagaacttggcttggacacaaaaataacaaaaaattaatatctaagagtcatgttctctgtggaataatcttagggctggtctgtctttacacatttattgatgatccagaagaggaagcacacaagtttgtagattagcctaagctattctggatagaaaatacacagggccctagcacagcctcgtgggcagaagagttcatctcgtgagaatgagcaaagagacacttaagaaaaaaatctgatgcccaaagcctttcatataggtgaccattgtacccacagtaatgaagcagaactactgtgctctggaagccactatgcccaccgttgttcatgaataaaagaaacatggtagatatccttatgcatgtgtgcacatgcagcacacctggcctggcacaacctgctcacacctctgggagtcacctgggtgttggctgacgcagcctggcctcggctgagctgactgtcaaccccgcaactgcctgtcccatcatggaccagaagcagagccagggatgaggatgaacgctctagttgcctgtggcagataaagaatcagtcatctagctgggaaggtaaaggttgagaggaaagccagccaatgtctataaagacacataggaaatgggagaatagagccagtgagggacatgcagagaaacacctagattttggattcatttacacattcagcaaatatttattgggcatctatggtgtaccaggcgctgcactggactcagagatataacaatcagccaaatgaacaagtctggaccttcagggaccctcgtggaggtgttacctacaagtgaggaaaggaagaccaaagtgtttgttagttagttactatgcatcaggtactgtgcacctcagaggccacctgcagtcagtctccctatatgccaatggctgccagcatcttcctgctttggggaattctcagcagccagtagcagcttgcatagcctgagcatgtggcaggtgggacttgatgcaaaatccatacccaggaaaaatcttcaagctataggggtgaaagttggtgaatgggtgtcccagcctccctgccctttggtgggacaattctgaggcctgtgccattaacttcggcagtaccttactcattaatgcaccctttactgacattttctccttctctgtctcacttactacttggggagattgtcttccaaataaactacctgtatccaggtccttcttatagatccactctggggaaaggcaagcaaagaaaatacattataagcctgttgtactattagggatggtgacttccagaagctgactgtgataacctttcctcgggcttcagaagaggctaatggagagttgaagggagaaatcaggaaagatggtctcccctcaatattctgacatgggttaataaggaggcactggttcttaaattgggatctcgatgatgctggactagcagcagcaatatcacctgagaacttgctggaaatgcaaaccctcaggctttaccgagacctcatgaatcagaaaagctgccagcaacctgtattttcacaaggcattcaggagattctgatatatgctgacagttaggaaacactcatgtaaagcatgtctatcttcccttcaattatgtttttcataatctgcaaatagttctgtcacttttaggggatatggctggacaatgaattatctgtggcttcattagaaaagtacatgaattatattgtggacagcaaagttatactgaagtgctgaagggaagtcaaatgcttaggagtgtaagctgcaggaagaaataggcagagaagctgggatagtttacccagcatggtaacttctatgttattaggctcaaatgttcacactctgcctttgaaataagtcattagaaactatattagtctgttctcaccctgcttagtaaagacatacccgaggctgggaaatttataaaggaaagaggattaattgactcacagttctgtatggtagcggaggcttcacaatcatggtggaaggcgaaagaggagcaaagtcatgttttgcatggctgcaggcaagagagcatgtgtagggaaactctcctttataaaaccatcagatctcatgagatgtattcactaccatgagaatgacatgggaaagagccacccccatgattaatttacctctctcttgttccttccatgacatgtgagaattatgggagctacaattcaagatgagatttgaatgggagcccagccagaccacatcagaaaccttctgagaggatgccttgaataggtgatatggcagtgtggtccttagcaatcagaggagagagaacgtgggttctctgtgaatgaaatttatattcctagtttccgtggagctgtgtgcatgaaaaacctaggttctcagtagctgggaggagacctgcacaggcatttttagtatatgtggtaggcagcttctaagtgaccccggtgatcctcacttcctggtcttcacggcctcaggtaatcctcttcccttgaggaactggcttctagccaatagagtacctcaacattgagggaggtgtcttctgtgatcgttttacaaaagattttgccttccaccttgttagattctctctcttgctggctttgataaagcaagttgtcattgttgaggagggccatgtagcaaggagctgggggtggcctcctaccaagacctcaccagaaactaggagtctcagtataatagcctcaaaggaaatgaatctgccagttatcatgccatggactttgagatgagaccccagacctggatgatcctttgaagccttttgaagcaccttgaagcagagaagatagctaaggcatgccctgtttcctgacccagttaacccatggttgaataagtacctctttattttaagcttcttagtttgtggcaagataactaacacatacatgaaagtctaggcttgggtatcatcaaaggacctgctagcagaattcttgtacatgaaaacacagttgtgcaggacatatctgtgcacctctttgctgaaagcaacatcctcaggaagaccacttcccagcttgcgacctaaacatttaggtctaaacacttgagctctaaacatttagttactcgctctcccctgtattaatgtatgctgcataaaggacccccattttcctacattaaaccctgtataagaacctccaagtagacacttatgcaaacatgccaagatgcaggaccacatccaaatgataagttgctgtcagtgaatcattaatgagcactgctgtgcaccctgccacatgttaaaaggtaaaattacattctgatgtttatttgagctattgcctattgccacttgaggcatatttcatggaatgataggagtagagcaaggtatttattttgcattattgacccaaggtgccatcagagtcatgaggtccccattaaaattccagtgaactcttagattctgccattcctagaaaatcttataacattcttggttcaaacttctcatctgtgatttaatgggatacactaaggtacagtgaaggcctggattaaaatgatgtcatttatttgctgcgtacatggtcctgggcaagtaattgaaacaaactctgaacttcaatgtccacatctggattaaaataaaaataaaacatatacttaaacactatgatcataaaaaattcagtgcctggcacttagtaggtactcaataattctgtctccccagttaatttattcacttgcatatagagctatttatgcagaaaagtttatgtgacaactaccagatatggatacttttatagaagagtatccataggaaatggctcagccttctgtcctgcaataaaaagtaatgtttgactccaagtacatgagattgaacagagttatttgagctacttttgataaaatgtgacaggcagactttggtatttcaccaccccaacatttttttatggactgctcactatcactgcaacattcagcacttttttctgtgtcaatgtgatagacaatattcatattcttcttgggtaattgcctttttagctgaatcaatggcttgcaggcatgagaaggaggctgttttatctcaactttatttatcttatgattatactaagactataaaactgaatctcccctccttcccttcctcccaggcccattcccaatcatcttctaaaacctctgttaatactcagcttttttggtgaattttcccactgccatgcttcatgttaccaaaatatttcccttttctgacaacattccaaatataaataaggacctactgaatgaatgaaccaccagtatgattcacccaatcactcattcaaaaaatattctttgaggatttactgtgggcagaccctggagatataagagggagggaggaggatgactatgcctacttgtaaagtggacagctgtggtctcttctagaaaggaggagtgcctataaaggaggcgccttgggtattcttactgagcataacagatggaactgaggagtcaaggagggaagccttctctgattatatgaccatggagctaagatttgaaggaaaacacataatggtgcatgtgtgtggggagggtggagacaggaggcagtggaggagctaagtatcccaaggtggaggaggcagcgtgggcaaagtcctgtcggctggaggaagggcatgttcttggtaccagaagcagctcagtggaaaggatcctgaagcggaggctggtgggccgagtccagaccctgggggccttgtcaacctagctgctttgtgcctggggcaatgaggaggctgtgaagcatcaacagggagatacagtatttagagtatctcaaagtctccctctgtgtggtgtttggatctttctgaatcctcagatgtaatataaattatttgaaagcaaataccaatttgcttctaattctggatctcttactcaggacttggttgcccagaggaggtttaataaattctttttaactctacttcccaccaatttttctcccttcgatctgttcctatatctctaccattcatggcagggttagcacgtggctccaatggtgagcaggaaggacttcacctcttgtctgtcccttagctttggtgtgtgctgctcctaacgtagctttggagttggagttaagaaccatctcatggcattgttgggttaggtattctctgggtccactcaagcttcctatcagttttttagggacagaaagctactgtgctgacctcagtcaaagcccctatctgaattcttgaaagagacatgattgttaggtcactaattgattctccatagtgttagaacagcaggagatttgaacacaagggcatggtgctataccatgcagcctggtagagttgagctgaataacttttaggtttgtaagacagcacatttaatttttaacagattatgtacaagatattgagtgacattaaacacagagttaaatcaaccataacccatttaaagcagccttgcagataaatgtctcaaatctactagcctgccaaatgtattccttatctacacacatttatcaatttttccacaacactaagcctttctaatgtttctctgacagttactttctctcccaagcctgaaattcgggtgacatctactttctgtaaactagatgtgcttgaccagggaaagcccctagatttgtgttaatcttttggggccactgacccttctgggactctgatgaaatctttagtttgctgtctaagtaaaaaaagaggtgatataaacatacacagatttctttttgcataattctattgtgttgcttttgaaattgattttattcacgttatatattattcaaatacatctttactaaaaagtgtcactcactctatatattttatatataaatgaaagattactttctaacaaaaattagaaaaaacacagtcaatgtaagttaatcagaaagtaaaccttaattgtattcaaaagtaaaactcaatgggaacaccgttgttttgtaagagtaagaaattttggtagtcacaaggtctttgacatggcaacatgaatgacagctttgcagttaagttctgcacctttggttttgatggcagcaaatatgtaaaaaaaagtcattgattcaggtgatagaaacaaaatcagaatgcccatagctcatgttgcaacgaaggctgtaacaggaaagcaggccctacatgactcttatcatttcatttatgtcccatgatttcttcaactcagttaggtcaactgtggtggtttcagtgggatgctatctatgtatgttaattatctattgttgcattagaaattttccccaaatttagtggcttacaagcaagtattattacagaaacattgcaatgaggtacttgtagttcagagtctttcacgatactgttgtcaagatgttggttgaaataggagtcatctgcaggcttgactggggctggaagatctgctttcaaagtggcaccctcacatggctggtggtaataggcctcagttccttaccacaataggctctgcataggactcttaaggtatttacacaaaatggcaagtggctttctcctgtgtgaaatatcccagagagaaaaccaaggaaggaaccagaacaccagttatgtcccaattttggatgtcatatattgttacttttaccatgctatatctattagaaatgcatactgagtccaggtccacactcagagggaagggaattaaactctatgtcctgaagggagaaagatcaaataatttgtggatatatttcaaaaccaccacactatgtcatcaaagaaggcgttgtatattcatgattcagttttaaggtggtttgggtaaagttaatagcacagttgatccatattcccaggtactggtgatttccatctgaagagaacaagatgaggctttgtcactctcaccccagactatcctccaacatcctttaatcacctttaagggggccaaggcatttcttttttcttttttttttttttttttttttttgagacagagtctcactctgtcactggggctggagtgcagtggcgtgatctcgactcactgcaacctctgcctccgggttcaagcaattcttctgcctcagcctcctgagtagctgggattacaggtgcccgccactatgcccagctaattttttgtgtttttagtagagacgggatttcaccatgtagaccaggctggtctcaaactcctgacctcatgatccacctgcctcggcctcctaaagtgctgggattacaggcgtgagccaccgcacctggctgggccgaggcattgtgtgtgtgtgtgtgtgtgtgtgtgtgtgtgtgtgtgtgtgtgtgtgtaagttttttcatgaattcaaaacatagccaaatggttttgaatatatagaatttatatttgcactgctgataatagcttgtaataaagctgtggaactatactgtttattgttgccccaacatgacagtgctggtgaggaggaaacaaagactggaggatgtaatctaccccatagatgagctccttgaggatatggctgcatgttaatgttccagcgcagtgattggcacataggggctataaagaagtatctgttgaatggatgaatgaatgaatgaatgaatgagtggagactcatggaatttaacttggacaggcaggttctaactgttgctgtaggcctaggaataccatgttcaaagtatggaagattggagcattggtaagaatgagctcttgaattctaaggcagtgctatctctagtctctttagtgttttctgccaggttggaagagtctttgcatgtcaagcatatgtttgccttcaaaaacaaaggtgaaagctggttgggattgcttgcttttagtgaagaccaaggcaaagaactctatctcctgggtactctctgtagatggtgggaaaaaggaagagaatgtatcaggtagcttttgctctgtgacagacaactacaaaaccttggtagtatattaacaagcagtgctcactgcccatgcatatgggctcagccatcagttaggtggctctgctgatcttagctgagcttgttcacgtatttgaggtgggctttgctccgtgactttcccatattgtagcagtgtagcttgggcatgtttttagagcattggaggaggcatgagagacaagctcaattctacaggtgattttcaagcctgttcagcaagcaatctactggccaaacatcccatggctgagcccattgtcaaagagggagggcactgaatagctccatggcacaggggggcgtgaagaatcggaacattttttacaatctattacaggaagccaaagaaatagctagtttttctctgtttaagaagggttcacacacattgcctttaaaaggacagatagtaaatattttagactttggggccacgtacaggccctgttctatattctttttttacttcttttccttttcttattatcctttttcttttaataatcctttaaaaatgtaaaaaaacagagatattcttagcttccaggctgtataaaaatagactgcatgccacatttggcccgtgagccgtagtttgttcatccctagtttaagaagaaaaaacatcttcatactaataataatatacaatattctgttggcaaaagacattttgatacttgtcatttaattgatcttcatagaagcctgattgttgaaggtggatatttctaatagctcccctttcatatggggagagatgggaacttatgtgatgaaactgggattcaggctgtagtagggccagggagggtcactgatgattacctgaggttgccctgccaaggacagctgcttgtgtcctctgcctctgagaactaagcttccaggaggaccaccggtagtagggagtgcattcagctccatcctcctgagaacatacactctgcaagtggagagaagccatctcattatgttaatttcaacccagcccagactgagaggaggctgatttcaagggcaaagaaggtgaggcagccgattcccaggtcccatttcccttgctccacttcattaacatggccacccttaatgcgtgtcataactctgccttccagcaagatttcctctccactaagaaccttttagaaatggtatttaagagaatgtgcataaaacaagtcttcatggtgattatgacatttctgctgaaccaaaatgtaatcagtacacacattttgcatccttacacttaatccacaaacatagcttttactgttttaccttctcccacccacaatccaaacagtgccacagaacaaacgtaacaggatattaagataatctcttttgtctatgccaaatgtcatttagctgttgagagaggaatgtcccatctagtttttacaaacaataaataatacagcttatgaaggtccacatgggtgacactgatgcaatgtttcaacagttttccgaaaaaggaaaataaaatgagtcatccaattagttggctgggcatttgcctgcaagttgccagagagctttgttgatttatcccaacttggctaagattggcttactctagaagttcgcctgttacagaagtttggtctttactagggtgacacaaagtatattttatggatattagttcatcaggatgctgagaagggttatagcatcaaagacaaatatggctgaacatattggggatcatttaggttaaagaaatttaaatgaatttttcctgcgggacttctcagaggctttaatctgtgaatgtgcatactgaatttccaagaagggtttagaatgtgcagcagtttccaaatctacttgacctgggaacccttttgttcacagggcatcccatgagagaacactttaaagaacagacgatgagaatcagtaccatgcgtaaaacgtgaccaacgttctatgcagaggagatttttgaaagtatccccaccagtgaagagttaccgtgtatgtgtataatgtacataagtggacattagcttgtattttcaaataataaagtcaaactttattattaaggaagatacaagaattagggctagtaagtgtgtgtgtgtgtgtgtgtgtgtgtctgtgtgtctttctatgtgtaaatgtccatccccagggattaagaagtctggatttgggttaaacttaatcatttctaagaatctcaggttttcagtcctgtcctagaatttcaaaaacagtcagagaaagcaactgtgagaagatcacagcttctcatcctgttttgagtctcaccctcctctttgccctcacaaaggatttcagtgattatgttcctgacaggatgcattttaattgttttctggtatgacttcccaatacatcaagttgtgttttctatatagccgctatcccaaatgattactattcagaacactaatctgatctctaaatctacaaagaaaaggccatgtaatttgcttctctttacagtgcattacgtgcaccattgtaagtgctggaacccgcccccccccccccccccccgccccgggcatctccaaactgctgtcctgtggatagccccagttgcatgtgctcaaaagcaaacttcttatctcctccatgagtcagttcctcttcctgtttttttctctcattgcagctaatgacattaccatcccctcaatgtccaaagttagaaacttctgagtaattttttatttctttctcttcctcaccttctactaatattagctgttaaatcctgttgatgctacctctgaaatatttctcaaatccacatctcctttcaaccttgggcatggccctagttcaaggtcctatttttcttagatggaccacggggtccttttgccatgatctctttttccatccaacttataatttttctacaactttgacttccatcctgattactaagacttttaacatttctgtgtgctccttcttctctgggtgtttgacatgcattgtcattctgtcttctgattgcaagtgatagaaacctactccagactagctttcagggaaaagaaaggaggtgtttagtagattgcacaactggcaaacctggagttgatttagctttcatgaaggctagaccttagacttgtcatcaggaatatgtcctatttgctttttctgtcagcagtccttcctttttttttggctgtgctctgtgatcacatgtctcattgtggtgataacgtggcttccagcagcaatcccagactcacagcccatcctcagcatttccagtggagagaagtgttctctcttcctaacactttccatacaaatcttagaaataaattttattggctcttaacatgtcacgtgcccatccttcaaccatttgctatgaacaaggggacaggatgctctgattagccaggacttagtcacctcccctcttctgaagacacagaagttgggacttcatctctacccagccacgtggacttagaatacaggatgggtgggtgcagtttccccgaggaaattggagggctgttcttggagcaaggacatgaataagcggcttacaaagagcaaataatcgttgcttatggcactcaaggtgttctgtcaccccatccaactcacctttcccacttggccttctgtccttgaatgcgaagaaccagagtcccctgctctaaatggctccttttctgtgtgtgctgcgtgtttgctctgctgctgagatccatgcttttcccttgcctgaaacaccctctgtggctgttgcagatgtgttcactctgtaaacgcagctcaaatgccttccaccccaaaaagcctccttaaacttgcccctgctcctctgtgtgaataattttcacagcacatgatctacacttccatcatggttcttgaaatacatgaaatacctaatcataggataggtttcatatgatcccacctcccctgctagacactgacagtgtgacagcagggcccctgtcttgttcgtctcagtgctccccagggcccacatgcagtaccttgtacacagtgcaggcaccataaatacctgttgattgattctggacttgccattcattaagagaagttaatggaggttttctgattcccatcagatgaacaattttggaatgttttatcagtcaaatttctaagaatcaataaaacttccatttggattattctttcccccactcaaattgtattttaaaaatagttttattgtaattgtccccctcaattctgacaatgtgtaagcattgcagaaaatttgtgaatataaaagtatgaagatgatcaaaagcttcttcctgactgatggccattgcatgtatgatttcctctgcctggaaccctgtggcccccagggttcagctccctggtgcctcatcaggcacagcttagtgtgagcttcacctttgtctctagatcttcctgtgcatttagatttttaaaaaatctggtgtatcccctcattggttggctatgaagtaagctccctgtgtgcagggacctttttttagcttggtgagggtgtatcctctccactgctggagctgtggtcagcacacagccagtgagtgctctacaaacacttacagcatcagttcatgaatgcttgcaaacatgcagaggttaccattgcttatacttttttttgttttgttccacttatataaaccacttatatattcagatatttgtgtatatatgcatatatatgtatttatgcacacataaacatactacacacactggatgtatactacacacacacacacacacacacacaatgttataaggtgtatgtaacacactcagggctgccccacagcctctcagtgccctacttatgttccgtccccccaccattccttctggcagcttctcactgtgaaccctgagatgttctgcctgagtgcttgttctagctgctggagcatggcaggccagaagttctggagaactcgtacccccaggatcagctctcaaccagggatgaatacagatggaggataaatttccccactcccttgcccctttggagatgtatttgacaccatttctcagagtctccagggagaatgagctccagtagcccacagtggtacctggactgataatgctttactggctttcttttcatatcactgcctcctggaaccacctcctaaataagctacttacattcgagaactaattccaataatacgctacttaagacaagggagaatggtagaaacaggtttctatacttcacaaaaatgagcttttgctcttcagaaatcacagccaatagattgtgccttctggctgccccctctgctaatgccccctctttgccccctgaacaagggcacccatgtacaacaatgtgtatatacttccttaggaagctggtcattcagagccccgtcagtgacacctgcactcagaatgtaatcctacccagcttcgggggctccaggaattcctgtggcatccgtgttatagactcctttgcattcagctttgcttttatctgtttccaatttgtgttttcaaggcttcggtttttctcctttctgcttcatctccagcccctcctttgcaacagtaccaaataaaaaaacccatgacactgccacagctgaaaaagcctttgaaaaaggcaggtggcgtggcttgaatgtttctaaactctaaaactgcaagccacagacaaataaagaaagaggtgggggtgggcatggggggttgtagtcttgtggaagcaatcctcagccttcagcaggctctaggggcacactgcctctagcatgttttgagcacgttgatttgggcatctgtcttgctgaatttgagtttgaattatggatgttacagaatgaatcattaaggctgtgtccacccggattgctctggctctctggcctgttcacagtgctgttcaattttatgtaagcattacttcaacatttttggtggatgttcttcatttattcattcattcagtatgcactgatggtgactctaagtcttgggactgcaaagatgtctgaggcccattctttactcctccacatctcaagacctaagggagatagacaggcaaatcaataaccacagtgccttgctattggtgctgtccaaggtgggtgctgtgaagaagtgcttaagggcaagtgctgcagaggcaggcacacctggggtccttttcctggcctggggggtccaggaaggtttcccagaggaagaagcagggctcagtcatcaagagctaaggatatgccgtcaaatagccctggcttattagaatctgctttgcactaagcctcctgaatacttaatttccccaagcctcagtttcctggtctgctaagtggccagaataatatttacatcgtggatttgtatgaaataaataggataatgcatgaaccatgcttagcgtgagccataacacgcaaaagcaacataatcagtatttgttaattgtaacaaatcaagcccgggatattgacagacacctaaggcagacttgggagacaatgtctcttgctgctgcctcatgaggaaggtgaatgaccatgcattgccactggacgggaaaataaacggtttcttctttttattcttgtagacaccagtgaggcctaccatatacctatgtcaaaacctgcaatttatcaaaaataaagcccgagatagtaacagtcttgctgaccacaaaggcaaaaggatccaggtaaacagattgcttccaggactattatttcatgatgagctttcaggtatatagcacatgagagggaggacaaggtgcggctgcacttcaagagaccacgttggacaggtgagatgtccaatatattcttacttaagatctgatttcttctccttctctccagcaagggatgcccagagatataacaattagaattcaatacgctaatacagtgtctcattagccaagccacacaatcgcctctagtggtccatatgcacgacaacccgggatcctagaaattagctcggcttcctgcatccgtccccatctgaatctttactcaactactttttgattgtgaagagccaagctcatttgagcagtaggaatttcatggggctggtgatcccaagactaattcaaaaattaataagtttcccattccttttcttatttatttttttggtagggacacatttcaccacacacgcctgcttctttcttgccagtatttcattcaaaactagtcctcaagttttgaaattttagagacttaaaaaaaatcaataatgctttaagaagattaagaggctgtgcttatgtcagccttagacaattctggagagaagatagacttgattgtgcttctcattttgtttatgatcctgcaatgtatcacgcattctctgccaagtgaattctgactgcatgaagaaggggtagatgcttttacaacaggtttagtcatctggcatattatttaatacaatcagtggtgttttccttcgtgagatgcagccttatatacaggctaggtgttaagtttatacccaggttatctacccttccccctcctgtcctctctcccaccctgtttttattctgtcttccctcccttcttcccttcttccttattctctctcttcctccctttcttcttcatcttcctgtcttcctcactcctcccttctctcctccccatcttctttccctttctttccgcctcccttctccctttttcgctccctctttcccttcacaaacatttattcaaaccctattatataccaggcacgatgcaaggcactggaaatacactgaacagggcagatgtggttcccgttacatgatgagtaacacaggtgataaataaacagttaacaagataagaaaaatggccagcgagtatttggaagaaatagacaagtgatagggaatggctttggggagaattatctgcatataaggataagggatgagacagactcagcagccgtttcatgccagggcagagtagaaggccgtggagctgctaggtggttggcctggagaaaaaacaaggagttttttctgcaaagtgctggtaggagtttacagttctctgtaatgttcagaaatgcagaggtcagcggaggtgggtggatcacctgagggtcaggagttggagaccagcctggccaacatggtgaaaccccgtctctactaaaactaaaaaaaaaaaaaacattagccaggtgtggtggtgggtgcctgtaatcccagctacttggaaggctaagaaaggagaattggttgaacccaggagacggaggttgcggtgagctgagatcatgccgctgtactccagcctgggtgacagagcgagactctgtctcaaaaaaaaaataaaataaaaaagaagtatagaggtcatttttaatgtgagaatgttctcagtgaattaggtatatgtgcctgccacattttccaaaccaatgtttttacgaatattctagtttagccctctcttctagagttataaaattattctgccttcagttctacatttagggagtcctcttttaaggaaaggaaaaggatagttaaatcaggggctgtcacagaagcctcagattggaggacaaggcgtggaccatcccctgtttggcgggaaaatagctttagtcacaggcaggttgttttgcttcctaaagcgtaaagttggaaatgtgataatttcgtcaagtagttgatttagttgtatcaagcttaactaattaacaccaattccatgcttgattcttttctccattaactgaacaaaagccattgctaatgaggctatgtatacaaagccagctgactcattttgttatggagatttcaaagagaagggagttgtaaacatttgtagggaagagataggggtagacatgatcttacacatatttaacaacaggtgcaatacaggcactggccaatgagaatgagcaggggtataatggtgccaccagcacatacagaaggagtaagaagtatcctcaaggcacggagagatgatagggtgcagggcctttgcactgggcttattcacaggcaaaatatttttccttattttaaagaaatggaaagaagtcttcctagaagccagggtctgtgatacatgacagagtgaccatagcactcaggggtgcagagggtgtgtggattctgatgacagattgcctgtctgattttgcagaattagctccaacatggttttggtaacacccgttgccctctttaagcttgatgtctctgttttcatgtaatttgcacaaagtaggcactcactaaatatttgtaggtgaagacgtgtatctcagcacaaagcagcctcttggactaccatctgtgtggtattcaaggttcttttggtttcagagaagaggaacacagtaaaatttacccaaagaaaggagcatatgtgtcggttagggaaagaccaagcttccataacaaagagactcccaaatccaatggcttgataagatgagcctttatgtcatgttttggtcccttggtgagaggcaccgactggcaggctggctttgccctgtgtaatcattccatctttttccttccagctgttgctcagacgtcaccttgggcatggtccttgtctgcatggttgaaggtggctcatgtgtatgtctgcttttcagtgcacgcatggaggcaaacatctgtcttttacattagagatgactccaatgttgcttacatcacactgttcgcatcccatttgctcaaatgtggtcatatgccacatacagctgtgagtgacgctgcgaaatctagctggctggctttgtggcatggcttgcattcttctgctgtgggagagaaggaggagagaatgggttttagtggacccacagggagttactataaaagtgcaaatagggcataaggggatgcaagaaacactgaacaaccaggcatcagagtgcaggagcctatggagttcagatgagagctctccttcgtgcttctctagctctcactctccatctctcacactttctctttttctgtgtgaagactccactgtctctgtctctccaccagcttcctctgatgtcctatcttggatctggccccagatagtatcctctactttcttgaccttgggttttccaaagccaactggtatcttcttacttgtctcttgattctaatttatctaaagggaagatctgattcgcccagctcaagatagtcagggtctaaaacaccatgaccactctaaaaagaggggactccgagtcagctgtctgcgcttatccaatcagatgacgctgggcaaatggagaagctgtcagttttctgagacacccctccccagactgacccaaacacaacttgcacagtgtgaatatcagagtactatgtgagaaagtactctgtggagctgaccagcatcagaaattctgctagggctctcttataaattgataacttgtttctcagtcttttatacatttggcaaccgtgaatctattctttagaaccagaagagtcctgagtgatgagttcatagattagagattctcatacttcacagttgagaagtggggacaggcccaagggtaagaatcagagtgagctgccagttacatcgctggtcagctcctctttcactgcagtagatacaatgaacataacaatggatataagctccaattctatccagttttccacgaatgaagatgagtctttgaatacgcccttagcagttctcaaaaaccaatcagcagaacaagtctggccagctcccactttacatggacattatcatcaaaagctattttaatcccaggaaccaagaaaaagaaaaaaattctgaacttgcaatttttttctgttttctgtttcatgccacaggaataatttttaagaaattctttaaaatagacccaattctatgtcttatttaaagcaacagatatgaagcagtctgtgtagcagacaaatttaatggttccaatcaggggcttggaattagactgcctaattttaaattctagctccatgcttgcaagggatgtaactctaggctggttactcagtctctctgatgtttctgttacttcatctgaaagtgtggataacactaataggtaccttgcgaggctgtggacaataaatgagataattcatgtcaagtatttggcccagcgactgcgacatagcaagtgttggctgaagataattattaggacttcacatgagcgttgttggaggagcttagcttgtttaacctggaatagaaaagatatggtaaagaggatgcaggagcttccatttagtatctacagggtgggccatcctgtttcctgtggcagagagagaagaggtagaaccaatagggaagaaatcataggcagacagatttcagatcaacaaagaaaggcaaaacagatagagctgtccaaagaaggaatgggtttgaaagaaataaagccccagaagggctctagatgaggatgtgaggttggataagctacataagggatgtcccaaagtcagaccatcttctgggcttgatagcatgggttaggatgggctgacaaagactgccttaaataaaagtatgcatacacacacacacactacacacacacatacacacaatacttatatgtaaatacatttaaatatattatatagatttaatatataatatatagttctatataaatatattttaaatttataaatttaatttataaattaaatttattatttatatattacattaatttatatttatattcataaatttatatataaatatatttatataaaatataaaatatattttatatgtttaattatatataataggtggaggcgggtggatcatgaggtcaggagatcgagaccatcgtggttaacatggtgaaaccccatctctactataaatacaaaaaattagctgcgcatggtggtgggtgctgtagtcccacctactcgggaggctgagacaggagaatggcgtgaacccaggagggcggagcttgcagtgagccgagatcgcgccactgcactccagcctgggtgacagagtgagactctgtctcaaaaaaaaaaaaaaaaaaaaatatatatatatatatatatatataaatatatttctatatttataaaatatataaagtatatatgatatacaaatatatttacatataatataatcattttatttgatttaaaaatatacagtatatttatatatttgtatatttataaatgtattttatatattgtatgtttataaaatattagaaaaatatatttgtatatttataaaatatataaaagtatatttatatacaaatataacctataagtatatatgtatgttttacatacacaaatacttttatacataaatgtgtacacatttcagaatcaaacagcccattataagcatatatgaaagaacagtttgatttggcatattttataaactgtcacctgattttttttttaccccaacattaaaaaaaaaagctagtgcataaacaaggtgcagaaagaagctagtcatccattcatctcttcttgtgccagtgttacaatatctagtagctgaaagtctgggccagtcatttgcccggaccgcattatgtctgaatacctcctggcagtttctacgtctttctcagggcttctaaataggaatgaacatgaaagggccgcgtggcagtgaccgcagtgtggaggttctaataatgactatgagggacacacagttttcaaggagatctaacagtgtttatgaaagattctgtttcatctcaccagtgaagagcccttcatcatctaccattctcttaaggatagagtcttagaatctccagtgatcctgcaggaccctcatcccgtggttttaaacctgtgttctccagaggtctagcattgagcggtggcacttgggattctggaatggggaggatgcaagaggaacacagtgaagtaaacagcttggactctggcccttcaagcatacttcatccactttcatctgttttaggcatgtgggttcaagaggtgatgccacttgaaaaaagattagagggttctgaaaaaatcaggtgtagaattaattccaacatagacctaccttcttattgcacagacaaagacactgagatccagagacattgaggggctctcttgggctcccccaccttgtccaggggaaagtcaggactgggatccagcgtatagtcacttgctacggctattcccattatgttttgctgctgctgaaacactggaacacattctaaagttcagacactcaggaaataccccacggtgataaggacaaccggtgatgccgatgagttcccaccaggtgtcagtgcctcgaggacttgtttaatcttcacaacggtgctctgagttaggtgctcatattagttccatttaacagttggagaaaatgaggctcagggaaattaaatcacttgctccacatcacacagctactaggcagtcaatgctggttttgaggctaggtgatctcagtccagaggcctcagccttaaccattctgctctctcgccttcctgcattttatactccatacttctcttgggagaaagatactatcatattatttcgtccaaacttaccatatcttaaaaaaaacttaccagcaaacaaatcatccaactgcctttcatctattgaatgttctacagacttaacgccattatctcgcatgaccttgatgaagatagtaaccctccctttatcaaaatggtcaatcttcattaatttattttactaattagttaaaggctggtgtaatttagagaaagtctaaattatagaatacattttattctgtcactttgaagcacaaacctccacaaagatttgtataaaaatgctcccttctgggactcacttcagtgatttgtagctaccattcatactgcctctatgtaaatgaaagggaggcataatatcagcaccttgcgtattcttctccatggtaataaatcgtgcctgataacctatgaaaatggcttcatttttctcttaccacgcctatcatggtggctttcaaactcactaccctgtgccccacctatcacacctgtcctttgtccctttctcacatggatgtctacaaaatgcagcagtaaagtgttccataatccacacttcagtctacataaatgtttaattcccctgccccttttgttttcgtcaggccccctgaagccgcagctgagatggctgactccctgaactcttcttatgttcttgactgttcgcatagcctttcctgggattacctcccagttccaagtttgcccattctgcaggcagtcttcttgggttccagcttttctccaccatcagcttctcccctagggctcttattaactctccgctctctgggggccactctcattttcagcttcatgtggatcagtgattacttgtcctatctcctctcctagaacgtgagcttcatcaaggaatttctctctattgaccctcaggcatgagcacaatgtcctactccctgggtgcttagttaatgcttatggagtgaatagaaccccggcgtgtgtgtgtgtggtgtgtgtgtgtgtgtgtgtttagggaaggcaaaggacgtttggcaaaaaaacaagttacctgagggaatagcaactcgaagtcattgtccctcaatttgggatcccggtaccacccgcataagaatcttttggatgctgaataaacctgcagtttctccagcctggccaagacctatcaaagcagggttcctgggtatgaggtccaaggatctgcaactggaacatgctctccaggcaattctatacacactggtatctaagaaccactgcgctcagaactaggatatccatcaagcctgatttgaagtacctgcatgagtcccagtgtcatgatgagatcaagagagcttctgtgtccttgaggggctggagtatgcgtccccctgaaaccctttccctgcctgcccccagcactgttgggtgtcccttctctgtgcttcctctgccaacactctgtgcggtgtttccgggagtcagaatggcagggtggtcaagagtacggactcagaggttgcagaaagataaaaagatgattgcattcatgattgttatgatgtcttgtacatagaatattgtcttatttgctctaagactccattaaaaagccagcaaaagcaaatgcataccagaaaaacagtggtgtgctctttgaatattaggtggcctagtgcatgtttcacctaggtctctgactaattctatgagcttgggcaaattatttagcttctttagggcttctgtatttgtgaaaaaaaaaacaaacaaaaaaaaaggaaaacaatagtttccctttaacagggctattgtaggaatccagtgagatcatatcttggaagtgctcagctgagggcctgggcgggataagtactcaaatcatacccttaatatcattattcttttttgagatcaagtttcactcttgtcgcctaggctggagtgcatgttggccaggctggtctcacactcctgacctcaggtgattcacctgtctcggccttccaaagtgctggaattacaggtgtgagccactgtacctgaacaagtgggtgttgttttaagccactacatttgtggtcatttctcccagcagccacaggacactcatacgtccataaaggcagcttctctgctctttgatgcctctgactccacttaagccctcttccccagggctgaaccaacatacccgcttccaagtctattaagtattgaattgtgttcccccaaaagatatgttgaagtccaaatccccaggatctgtaaatgtaacactatttggcaacagggtctttgcagataatcaaataaaaatgaggtcattttggggaagaagctaatctactgttactgatgtccctgtaagaagaaaagagggtcgggcatggtggctcaggcctgtaatctcagcactttgagaggccgaggctggcagatcacctgaggttaggagttcaagacaagcctggccaccatagggaagccctgtctctactaaaaatatataaattagctgggtgtgttggcatacacctgtagtttcagctactcaggagcctgaggcaggagaatggcttaaactgggcaggtgctggttgcagtgagccgagatcaatccactgcactccagcctaggcgacagagcaagactccatctaaaaaaaaaaaaaaaaaaaaaaaaaaagacacaacgacacacagagaacttgtgtgatgatggaggcaaaaactggggtgacgcagctacaattcaagggacaccaaaactgccagcaatgaccagaagctaagagaacagcatgaaacagactgccatctagagccttcagaaaggacatgacttttctgacactttgatttcagactttttgcctccagaactgtgagcgatcacatttctcttgttttacaccagccagtgtgtgatactttgttccagcatccgtaggaaactaatacaaagtcccaaactctttccactatgtctagatccaaagtcaccaagaggcctggcttggggcagcactgggaacttagacaggaccctagctaagttccattctgagttaataattgttattaactcactcagttcatgcccagttagcaagcatcatgaagcacattaagccaggatatggcctttctaaatgtcctgagtatcaggagaagctttttcacactgcaaaagccagtctaattctatgacttgcaggctgaaaatcaactatggctgcaaccaagtcacttagccatcatcagcgccaatcctgcagtgcttatagccaagtcagggcgtctgtttgttgagaggcaaaggcggccccgccccatgctctggtttctgcttgcaccttattaacgggtaatgaagagtaggttctgctttattgatcttgagaccagagctacgtgcgatgctgcctaagaaaagccgcaaaggattttatttgatttttgcacacaacaataatctccctcaccagattagctggtgaactggtgggcttttcaccttgaaattgttgatagggtagccaaacaggaatttctatatttgctaatccttcctcaaatacacatccccaccgtctgtgccctgtcaagtgggtacctgggaaatagcagagaccacactgtggaaggggagacactccagtgcaggaaagatcagaagaaagaggtgacaatgacatgcagcacgaagcagcgatgatggggttttttctttgcaaaattacaagccacagtctcacctcattcctacctgccttttttatttcccctgctctcaaaacatacctgactagaaaatccccagtccaactccaggaatgccctttcttctttagccacatcacagtgttaccagatgccttttatgagctctttggtagaaactaagccatgtgtcactactgggtgttgaaaactcaggagtcagcttccctgcagtctgctggcgctcagttctttggctctgcctaaagtcggataaggaaatgaccttccaggcatggtgagatgagtccttaggacacagaagggcaggctggcctggcctcaggagactgcaacagctgccagagagccatggcactcctcaatcccccgaggagcctggaaaagacttccctcttgggttcaggcatgtcctctgcttcctgcctttatggaaactggattttcgggaccttggaggacctcctatggggaatagaaactaacagcccatcccgagcctgcttttccatgggaaaggtggtgggaattctccatgtcacctttgcagagagagagagacaaacatggatccaaattagagatggcttcaggttctgacggattcatctctcccaattgcctttgtaacacatctgctaaatttagataagtcacaaatagagccaaaagaaaatccagaagggagccacaaaaaattattaaacagttgtaaaagttggggattatgagtggaggaatcggggttatttatcctggaaaagagaaggctgaggagggacatataaagacttcatactagattaattatgtaaataagcagacacccagctggcatggaatttcaaccatttggcagggagagtgggtattaaggggggtgactagttgttttaaaatcattagttgcctgcacaggtttctggaggggttcactgttgctgagtaatacaagttatgaatatgccaggtctgttttaatgagcccagacttcacccaccaaaaatcctttccagccaagcacgtgataactatagatcttctttgtcctttgcctcaagcagaagccttacacgggtccgtcgtaagatgcacctctagggctcattccttcttcaagtcccggtgtagagtttggtgttagaagggacaattagagacttagagattccttcgtccagacaggaagatgctggaaggagtgccttttggggaatgagctgagcttggccagatgctgcagttgtgtccccttgctgaagttagtcacacttggctgctggagaagtctgcccaggtgcacttcataaccacactgccatcttctgcctttcattcaacaggacatgaattgagcacaggctggtcctcctgagccctggcccaacaaggctcctgaacctgggcccagagatgcataagaggatgccaaatcacataaaaaataagggtatggtgaaatcccatctctactaaaaatacaaaaaattaataaggtgtggtggttcgcagctgtaatcctagctactccagaggctgaggcaggagaatcgcttgaaaccaggaggcggaggttgcagtggattgagatcacaccactgcactccagcctgggcgacagagtgagactttgcctaaaaaaaaaaaaaaaaaaaagagcccccccactcatccacacttactctcttacaatcctggaaggcaacttgtttcaatgggctagaggcaagttgttggctagaggagattccattgctggactcttttagatcctggtggttcccgacattccttagcttatagccacatcagtctagtccctggctccgtggtcccatgaccttttgtgtccaatattcctctgcccccctcttatgaaggaatttgggattctatttagtggctacccagataatccaaaataatctcttcatttggaaatcattaatttggccacatctgcaatgtctttaccacaaaagttaatatagatgagttctagggattaggatttggtacctttggggatcattattcagcctactgtagtaggggttcatcagttagtgggggggaagtagccagtttattcccaaaatgcatgtgtcatcacaaaccaagatgagtttcctaaaagaaaataagatactactgcgaatgtcacccaatgagacctgacccattctgtgtgtgcagggatgctgttttagttgggttcccacagaagcagaccctgcaacgatgatttgtgtgcaaggtgtttatttgagaggtgatctcaggaaaccggtaaggcagtgggggaagtgagacagggaagaaagggcagccagtgatgggagttgctttcaagcagttgcttgttcttatgggcagctggagctgaatcccactggggactctgggagacaatgaaaaccacatctcatagttatccccactgaggaatgagggacctggggtatttatctaccaactccccttctattattggttgagtccctcttctgacgagtcacaggtattcccagtaagcagcctctgtagggcacaggtgagtgatgatgggattcaccgctgacagctctgctgtagatttccccgggcaggtgacctctgaactgccacctgaagtagaagtaggaagtaaccagcaactggggtggggatggtgaagaagaaggagaaagtgttaaggaaggaaacagaaagtgccaagccctgaggtaggtggggcacagtgtagtgttgtattagtccattttcacgctgctgataaagatatatctaagactgggcaatttacaaaagaggtttaacagactcacagtgctggggaggcctggcaatcatggtggaaggtgaaaggcacatctcacatggcagcagacaagagaagagaactcgtgcagggaaactcccctttataaacatcatcagatctcgtgagacgatcacaagaacagcatgggaaagacccagccccatgaatgaattatctcccaccaggtccctcccaaaacacgtgggaattatgggagctacaattcaagatgaaatttggatggggacacagctaaatcatatcaagtgtccagagtgaaaggagttgagatggaacagcatctcaccagacctgagagccatttggtgcgtgttggatgcatgtggtccgtatctgttctggttgattgatgcctgtgccttgacatttgttcaatattttgaatatccttcacactgaggtcaatatctctttccctgggtggttatgagccttaaatcagctatgccatgtgaaagttatttgcagtttgtgaagtcctgtggaaaggttgttgctgtttttctgctggggctgttttaagatgaaacatggtatgggggaaagatgcaagctctgggtcccattctcaggagtttccacgagcaggaacctcacatcactgccattggcctgtaatataattttggcctgagtctatctgggacaggtggtgtggagatgcactgttactaaagacttaaagcttggaacttaaaagtctacattttctttggagtcaggtggtcctgtgtgcaagtcccagttccaggcccttccactggctgtccaatggcttggagtctgaggctcagttttcccacttgcagaaggaaggaatgatgccaacttcgtaagttacatgagatgtgaaggcagtgatggaagtggagctggggctccttccccctctgttttaagcatttgattaaaacaagttaggatgggcgcagtggcttgtgtctgtaatcccagcactttgacaagccaaggtgggtggatcacctgaggtcaggagtttgagaccagcctggccaaggtggtgaaaccccgtctctactgaaaatacaaaatttatctgggtgtggtggtgggtgtctataatcccggctactcgggaggctgaaacaggagaatcacttaaacctgggaggcagaggttgcagtgagccaagatcacgccactgcactccagcctgggcaacagagagagactctgtctcaaaaaaaaaaaaaaaaaaaaaaggtcttactgtaccatatgtcctcacttaacttcattgctaggttcttgaaaactgtgactttcagggaaatgaaatataatgaaagcaattttactgtatgctaaatggtataaacaagagttaaattcttacggcacgttcctggtcacaaaaacattaccaaacttcttaataaagacccaaaacacttctaatattaaacattgaaataaagatgagctatacatacatttaagaaagatgaataaaaacaagtaagataatcgtttgctcaatttttggtgaatcagtgagtgacggtggtcgtagtggtggtgggttaaatcaaggaataaaggtttgcaaagcgaaaattgtcaggggcacctcctgccaccgtgcagtttgaaaacaaacaattccaactaatggcagactgactgagtgctttcttactgcattgttttttattgtgcatttttatgattattatacacagtacttcatgagtttttgttttacaatacttcgtattaattaattcaccttccaaattgcttagtctataatagtttagggtcttgggtggccaaagcctctgctagcacagggtaggaactgaccctggacaggacatcattccatcgcagggcacacttacacccacgctcacactcactcatactggggcaatttagatgtgacagttcacttcacatgcacaactttgggatgtgggaggaaaccagaggacccggggaaaacccacacaaacatggggagaatgtacaaactccacacacagggtggtctgggccaagagttagtgtttttttttttctcatcaacattataataaaacaacattgaagaaaacagcattatatgatgtctggatgtatttattgttcatgatggccaggtcttcctgcattgttgtttgagtcagtcacagtgagttggcattgctacaagtcactgagcaaaaggccctcgcctggctcattcgccaatgagtctcctgtgcctgaaacaaagcttggtaaatagtagatgctcagtaaatactaactgaataaatgagtgagtgaggtttactggagaagggatcaagaacctgaattgatttagctctccccacatgattatgggatgaagccatgataattactggcacaaaacattcattttatacataatggaagtataaccagggatgcaaagtgatttgctccaagggtgctcagttaatttattcaatgaccagtcattcctctccttgatttaacaaacattcattgagcacctacagtgttgctgatgatattaaaacctcagtttctatcaaaaagcataagacattgcccccacccttgataagccatgacttggtagtgggttcacatacataaacaaaggatcatattgcaatgtaccatgatctagtatttacacacatgatgtgctgaaggaatacagatgaaggaacatcaattctgccttggggcccaaagaaaccagttgggaaagttatatttaggatgagtgagggacacggaggttcagaggtcctcaggcagttaaagagggagtagggtagaaggtgcaggataggtatgggcacatggaaggtcatggaactggccagtcacccagtgaggctagagtggaacactgctcacgtaggcaggaagaaaggtactccaggtagaagtaacagcaaagtcaaagaaagcagtcggcaaagagatttgtaagtttgaagaattaaaagatgaaccataggaatgaaggagagtgtggcaagaaatgtactttgacagagagaacttgtgccaggtcattctggtctttgtaggccatgatagagagttcagattttgttctaaatacaatcaaagccattaggaattgtaggcactgtacttccagtgagctaagttttggggtcagtctggtcactgtgatggagcagagagggcagggaggagagtcatcaggaggctgtaggtgcagaccaggggaaatgccagttagactacactatgctgtggcagtgggaatggaaggacctgatgtgctttcctgaaatgtagttggggcgtgtcacatgcttgagttctgtgtccctaccctctctcactgacccatagtcggacagaccacactgccactgggcccatcgggaggcagggatgggattcaaggaagacttgttggtttggatggaaacacaacagagtatagaataaactttttttcaaatgttgtttcaatttaattcagtaagcattggagatgtattttcatcagaaccctctcaattttaaggggttaatgtctaactcaaatgggaaatgtatagttcacttaactgaaaaggtccagggagttgagttttaggcaaaactgaatacaggggcttgaatcttgttaaatggtttctctccatctcttggctctacttttttctatggtgacttcactctcaggcagggtcttcccatgtgataccggctattggcagactcagatctgtagccttataatttcacaaccccagcagagagagagagggctgctattactgaacagtccttgcagagggctggcaatgatttgcccagtttgggtcccatgaacacggtacaggtactgtgccagatgaactgctggaattggctacgctagggtcacatggccagctctgcagctggggatggagtcacccttattttcatggaccaagtatggagagtgaggtgatttcccaaagacccactaggacactggtatgtggagaacatgagagatggcaggtagacagaaggacaggtacctactacgagcacctgccattgtatgcaagctctgcctagttctcctgcaggaagttcaggagtgaataattcagttcctatccccaagatgctcacagggtaccagggatgcagatacatacatataagcctttttcacgtgagcccacctgtgaagagtgccctgatttgatggcatgtccagcaccaggaagctctgactgcttttactcaaatggcacctggggccaaggcacatgttttctcacatttctattttaagagtcaataaatcatttctggtaccttaactggatattaaatcagggtgtttttcttgtcccctaatacagggccaagatgtctaaagttgaccttcagtctagtccaacatctggaaatgagtactaaagccaccagcacagacaaaaatggagaacaggtggacctggggaacagtctggggaaggaggggttccacatgagaagttacctgcagggagcagttgggtggcttgagttccagcctgagaatgattgtaatgtatctccttaaatccgtgtatgtaggtggcactctgttcctccttatccttgtatttcatctgctctcagggctgtgtttctttgcttcttgtgggcttttgcttttcagttcagcacatatttattgaacctttttgtggggactggctagttattcaccagctctcttccttctttgtcttgggaacatagctaggttatattccccagcctcccttaagttctctgtgactggattctggtctgtgggatgtgggatgatgtaaagtccaccttacttcagcaaaacctcctgtgaagttctccatgcaaatttgccctattcctctgtctgccacctggaagaagaggatctggtgggggacagtggagccacaagatggaaagaggagtctaggttcctaaatgacagcaaggagttgtcaatcatccaaactcctgtgcaaatacaaaactccacaccagattgcgacaggagtgaaagataaatctttacaatgttcacttgttgaaattttggagttattttctttttgtttttgctttagaatatagaatttagcctaccttgagtaatcagagttaaaaaaaatataagaaattgtgccatgtgctaggttctcagtgttgagcaaagcaggtgctgctctggccttgatggagttttcagtcttacctgttattttttctattcccactccgtcttccactccttgcaggcaataacagatgatgttgggggcaatagtcttgaaataactctggtaagtgcccagcagagccagatgctgggctgagttttgaaaatgaacaacttcattggtactctctgagcctttcttggagtggggcttgtctgtgggtcacagcctgatcctttaggccttgtgaagcttgaaagatcctacaattgtgcagggtaaagaggttttttgttatatacacaaattgtactttttcttatttctcatttttgttctcagacaagtccttctaattagttagaatttcattaatccagtcatccttccatccatctatccatctatgcatccttccgtccatccatctatccatccatccatccatatatttattctttagaggtagttttattaataatagttgtcttttgtcaaatgctcatttgccaggtgccatgctattgatatgactagtcctttttaattcaaatgacagtcctacaaggcaggtgccatgattatcacttaataaatgataaactgaggccttgagacatttcttcagagtatgatcccatatatgttttggtagagcctagattcatagtcatgatgctgtccttcattctacatttattgggatgccctcaaatgccatgtctgatggaggcatccccacctagagtagctgacttgaaggagttcacactgtatgtgtgtgcacatgtgtgaagatggatagtcaaaagagactgtcatgtaaacaagtaatgcaattggaaaggtgctgtgcaaagtagctgagagaatcacagggccctgtgagagactggaaggcacccagatgatccaaggtgatggccaaacctacaaacaggggagccagggacaagagcagggatgattgaatctagagtcagactgatcgtacaccctcagtcttccagttggatgtccttggctgggtcagccattctctctgtgactcagcttccccacctataaaatcaggataatttagctcatacttaaagggtagttttaaagattaaataagatggcttcttaaggattaactgagataatacattttaaatagggcttggcaatactaagttcttgataaatattagcttattttgtgataatgatggtcatggtgatggtgatgatggtgttgatggttgtgcggatggtgatggtgatgttgatggtcatggtgatggtgatgatgacagttgtgctaatggcgatgatgatgatttggaactagaatcaaaagaatgttttcctgctgtttccctcattgcaaataacgtacatatgtctctttccccatactcgttattgtctctcaagttctgaattgtcccagctctatcaccaaaccaggtttgtggccttgggcagagcataaaagatgtcttggcttattgttctctctatagtgagggagaatagtgggttctggagctggactgtctggcttacaagctagctccaccacttagcagcaggatacccttgaggaagtcatgcaactcctcagagccccagctttctcatctgaaaaatggggatgaaaatagtaactgccacatttaggtgttttaaggaatggtaaaatgatctgcataaaactataagcctcattcctggcacatggtgacctcttaatgaatgctagatatcctcattttgaaattaagaggtgccttcaactttacttggtggcttttctctatacattgtacctttatttttactttggaaagttgtatgcagtgccccgaatgctgacttgtaaactgatttgaacaccatcctcattccttttggctctctgagaaatgttcttttttaatgaatatgatagcaagacttacttattaccaggttatttcaggcaagagtgatttttaactcattaaccagataattattgcagttctccagttacctttctgttcatagacttaataaggcctgaggttatgtggcagagttttcttggctaagatgggagaattattaaagctctcaggtgaaggtgtgaaacctttggtgcacagagggtggccgtgccattcaagcagtccgtgatggtgagagggagctcagctgcttagggaactggtacagggtttcattaatcatgggacatttctggtgtacttgaaaatgttagttttacttatgggaaagatatccagacgtaaatgtgtgtgtgctgtgtgcatgtgcgcacggtaggttatacagcaccaaggggtcaaatagactggttgactgtatcctgtagtggtttggagcaggtgttggcaaacttttcctgtaaagtaaatattttagccttggcaagctataagatcttcatcacagctactcaattcagccaatatagtataaaagcagcaagaagatacatataagtgaggatgtgactgtgttccaacaaaactttattgtggacattgcagctggaatttcatataattttcatggaccacaaactgttactttcttttgacatttttctactgtttacaagataaaaaccattcttttctcatgagctgttcaaaaacaggtggtaggtgggatcttgctggtgggctgttgtttgctgacctctggattacagtctgcatctgttgcagcttatttcaagcaccgcttgtttcattatttactttatcgccttgggcacactccataagtagtcagtgcctcagtctcctcttctgcaaaagagaaatcagagacttcctatgttggtagagaaaatttgtaagagttagcagagattaagtgccttaaacagtatctggtgcgtagcacccccttgagaaatactagcttttattgttttcattgaattactgtctcatggaattcttacaactacatcatgaggaaaatagtattaatagtattatccccatttcccagatgaaaacactgaggcacagagctgtattctgtctgaggccagagttagaccatgacttacttatttacacaaagcagcagggacctgtctttgatgatgaacaagtccaaattactacaaaactgcttttgttcttcttctaatgaagtgcccaggattcccatccatcagaaattgcctgtgcctattagaaactgtcatttggcaaggggatgagggcggcggcggtggtggggttacaagatgcgcaggtggtatagggaaggagtggcaaatcaaatgacagcaacagagcagccgttactgcattttatttttttggcattttcttccattgttctcctttgtggacacactctggtgtttgcactgggggcatccctgttgtatttgtaaatccctggaggttgcagttgtaaaatgtgcctttatcctctcccattgcattttttttcctctctaatgcaccaaattagaagattgactgattttcgttttccctggaaggtaaaatttcagcttaaatcacaaatgtctgtgatgcacttagcagccaccgcagcttctaaccagtaaccattcctccttattccctctctacccaggagaatattcaggtctattgtgatttcgagatgcattagccgcacttagagttaaggatcaactttggcttctgtggaagctgctgagatttaaagggtaagagctcatcccatttagaacatggtgtattctttccctccttgctcatatcatttatgaaaggataaaagactggagaaagtgtcagagtagattctggaggtacttatattgctaggacaaaaaaaagaaatcacattaccagtagctggcttagttctgcatgttactatgtgatcagtttccaaagttcttcgtcttggaagacaggcagccccaacctatgggaatctgctcaccctacaatggtgagcagacccactccacccatctttgccattcaagtctacagcatttgaacagatcagcccgttctgtgtcaagaaactccttatgcatgttctggacacagccctgtgtctctgcaggttcaaattcccctgaatgagagaaaagttagaatcttcccttcgtatctcagcttctctactcattactcaaacccttgggaaagctgctctattacttattatgtctgcttcctctggaaaatggcagggtaatatgaataccttatttatagggctgctgtgagaatcaatatttgtaaaacacctggaagagagcttgacacatacaaagcactccaaaaatgttctctggcattaaaaacatttgataatatgggctgggagggatcacactgcttctcagatgcaatccttcaatggcaccccatttcttgtaaaaataaatactaatctcctcaacctggcttacaaggccttgttcagtttacccttatgggcttgttctatccatccacttttcctccccagcgacacggtacaggcacacctcagagatattgcaggtttggttctagaccacagcaataaagtgaatattacaataaagagaggcatacaattttttttttgtttcccagtgcatataaataataaactacagttacgctgtagtctattaagtttgaaatagtattatgtctaaaacgtgtgcataccttaatttaaaaatactttattgctacaaaatatgaatgatcatttgagccttcagggagtcataatctttttgctgattgagggtcttgccttgatgtgacattgatggtttctggctgatcagggtgggggttgctgaaggctaaggtgaattggcagtttctaaaaagaagaccacaatgaagttgtctgcatcaactgactgtttcttttacaaaaactttctgtaaaaattttgtatagcatgtgatgctgtttgatagcattttacccacagtagaacttctttcaaaattggagtctaccctctcaagccctgctactgctttgtcaactggtttaggtactgttttaaatcttttgttgtcatttcaacaatgttcacagtatcttcccaaggaatagaatccatctcaagaaaccactttcttggctcatctataagaagcaactcctcatctgttcaagttttatcatgagatttcagcaattcagtcacatcttcaggctctatttctaattatagttgtctttcagtttccaccacatctgccgttacttcctctactgaagtcataaagccctgaaagtcatctatgaaggctagaatcaacttcttccaaactccttttaatgttgacactttgacctccttccatgaatcatgaatatttttaatggcttctagaatggtgaatccttttcagaaggttttcagttcactttgccccgatccatcagaggaattactatctctagcagcaacagccttacaaaatgttatttctttaataataagacttgaaagttgaagtcacttctagatccatgggctgcgcaatagatgttacattaacaggcatgaaaaaactagtctcgtacatctctattagagctcttgggtgaccagctgcattgtcaataggcagtgatattttggaaggaatttttttttttttctgagcagtaggtctcaacaatgggattaaaatattcagtaaagcatgctgtaaacagatgtgctgttagacaggctttttaaaagtagcactgcaagagtaatttaggatgattatttagggccctaggattttcagaatggtcaatgagcattggcttcaactaaaagtcactggctgtttagcccctaacaagagagtcagcctgtcctttgaagctttgaagccaggcagtgacttctctctatctaggcaattcctagatggcatcttcttccagtataaagatgttttatctacacgaaaaatctgtttagtgtagccacctttgtcgatgatcttagctagatcttctggaaaacttgttgcaactctctacatcagctcttgctgcttcatcttacactcttatgttatgaagaaagctttctttaaacctcatgaaccaaactctgctagctttcaacctttcttctgtagttccttacctctctcagccttcagaaaattgaagagtgttagggctgtggattaggtgttggcttaagggaatgctgtggctggattgatcttctattcagaccacttagactttctccccatcagcaataggactgtcttacttttatatcatttgagttttcactggaatggcactttttatttcattcaagagctttcttttgcattcacaacttggttgattggcctaagaggcctagcttttggccggtcttggctttcaacatactttcctcactaagaagcttaatcattctagcttttgatttaaagtgagaggtatgcaactcttccttttccttgagcatttagagaccattgtagggttattcattggccaaatttcattattatgtgtctcaggtaatagaaaggcctgaggaaagggagagagagggagaggaaaggctggttggtggagcagtaaggccatacacatacaacatttacctattacgttagccttcttgtatgggcatggtttgtggcatcccaaaacagttacaatagtaacatcaaagatcactgatcacagatcaccatgacagatatcataataatttgaaagtttgaaatattgcaggaaagaccaaaatgtgacacagacaagaagtgagcacattctgttggaaaaatgacaccaatacacttgctcaatgcagggttgccagaaaccttcaatttgtaaaatatgcagtatctgcaaaatgaaataaagtgaagcacaatcaaacaaggtacacctgatgtctttcagttggcttaaggtaataattgctgcagccagctcagtccagcccagatttgttacattttcatgaatttttcaaatgttttgttaaatacagctatcattaaaaattaaattgcatcaacttataattaagttatattaaaagaagggtaatatgggcacaaaactgaccatttcctgattattttactacattttactattttctatgcttatttagtcctattatttatgtatggtgaaatctatataatggggaacagctgctcatagctgccagcacttcattcagtgaagtcacattggcagcttgaagctggccatgccgggagtatttatatgacaggaactggcaaacacctcagggctagatgtcttgtttttgaactagaatggcagtcagcaaacttttttctgtaaaaagctagaggagtatcctaggctttgtgggcaccgaaccctctgttgcaattactcaaccctgcagctgaagagtggaaaacagtcatagaatatacatatataaataaatgagtatggctgtgtttcaataaaactttatttaccaaaacaacaggctcacagtttgctgaactctagtctagacttacaaaagtgatagagaaaacataaagaatgcaaattaaattttaaaaatgtgttgattctggtagctgttacattgtatattgccccccagaacacaggacatattctttaaacatctgaaaagtattttgggattcagcaaagaagctgctcaagacattgacaaataagtgaaattctgacttaggtcattggtttattttcaatcttgcttgttcatttaaatggaaatggcaatcaacattgatatgggaaccacacttgctcatcagttctaactgtaagttggctacaagtgtaagagtttggaaaaaaatcaacaaaagcattctgtgagaatcaattggctgtgtgtacaatttacaatatagaaaattgtgtgttttattatttgtaaattatgtgttacttatctttgatatcagtgaaatacataatcaacatatatgtgcctggacatgcctatattggtttttgtgtagagccaattattaacattaccagaatatcactgcttgaatggggcatgttctctttagcttccaggcctttgagtggttcctccacctgaaacaatctcttcttccctttgcctacctaactcctccttctttgatctgcagcttaaatgtgacttcttcaaaaaagacttctttgatcccttcagtaccaaatgagttcttccctttatgcacatttttccttgtgacacttgacttaattatagttaaatgatgaattatgtgctggcttattacttcctttttaccaaaagactgcacgcttccccaggtagataggtccatcttctttatcatcgtgtctttggagtcttacgcagtttgttgaaatattatgtttgtagctgaactgaattgtgatttaaaaaaaaataggtctgtatttaaaagttttagtgtcagctccatccagcccaagttaagtactaattcagcaagttagttaagtaataaatggctgtcactcaactacaacatatttgaattcagttttgaggccccagtagttgctaaaaatcaatgcccactttctccaggtatagtaattatttctcatattgttattgactgtctctttaaagaccagccaggacaaatctatttctgaagctgttgtaaatgatttgaaacaggaagatgaatggaatggaatgagggttgtttaaaagagatttatccctcttattcttgctcaagaaatgagtggccagttgctaccagcctatcccaaaagccaagagataaaagccagcagcagttaattttctagtccgtgtgctagtgaccacagatatctaaccactgatttccaaaggcttactattattcatacatatttactatggtaaatagctcatgttttcaggaacactgaggatctgtttagtcactttggatttctggtttcatcaagagtttgtgtccgacatctggggatgagtgagggttccggatacccattacagaggaagagtctgatggggaaactagagggaattcctatctggaatttaaatttaagtttaggatctcagaaagacaaatggagttgaagctgtgtcaggcagaagagatatctccatttgtttttctgctttctcaacataaggcaaatgtcagtagtaaccaggtttattccacaggcatactctgcaatgtgtgggtaattgtgcctatcgattgtgacaaagtcttcaagcatgaggcagagaagtttgctatccaactggatgccctcaacaatgtttgcatctcaacaatgtgtcctcacattggctggctttacatatgcagacaagtgaggacatgcagaaaatcatttcactggtcctccccattgcattgtcgattgtgtggaggctaacatgtaaagttatcagcccagcagcagacacggagtgagttgtccataaatagtcattctaattgttctgtttttcttattataatttatttttgctatgtaaaaaaaaatcaaatgatctattgcgtgtatatgtgagtttttgtttaaaggcatatgacccaatttgtaaacatgatcattatcttctctgggaagaatactaaccaagggaaagagttcatgatttggctgtgtagagctctcattaagtgataggtgactggttctgtgctgagtgtttttcatcatcttgatcctatgagacattcaacattccatcttcatcttacaaatgagaaaactgaggcttagtgaggttctatagatgctcaaggtcacagacccaacaggtgactgagctggggtttaaatctccagggggtcttttagtaaggcttatgcttttaagcaccaaactctaccaggatataaatggcaaaaggaactgcttaagatatgaagagaaaagaaacacactacttaacacaaaacaaaaactggataaaatacccagttgcctgaatatgtatgcacttattcttgcattcagcaaataagtacatagcacctatcatgaaccagtgactttgcttaggaacacaaagcaagcaaaatccctgccttgatggcacttacttcttagggaaaagagaggatgacagaactgtagagaaaacagagtataccagatagcaatgagggctgtggagaaaataaggtgggaagagaactaatattggagctgggatttcagaaggaagaaagtgtttgagttgagacctgaaggaggtgcaggaaccacaggaccatctggggtcatggtcagcaacatggccaatgggccaactttggcccactacttgttttcatgaataaagttccattggatctcagccaggcccattagtttatgcactatctgtgtctgtttttgtgttcaaatggcagagttaagcagttgcaatcctgtggcccagaaaaacttaaatgtttactatttggccttttatagaaaaaaaaaatgtgtccacctacatctagaagaagagttttccagggagaggggacaggcagcacataggagtctcaggatgggaatatgcctagtgtgtttgaggaggcaggtgcgcctgcaacagaatgggcaaaggggtgagtggagggcagggcctgggcacgtgggggccactgtaggggagagagggaggattctgcagagtgttaacaggaggactctcgctctttgtgatacatccactgtcttaggttgaagaagcaactctgagatggagtttagcattcagggccaacacctatggaaagcaggggcaggaagcaggagtgagcagagggagaagtccagctatgatacagaccaatggcaaccttggccactctctaggagcttcagaattgaccctgtttggcccaagacagacaggcctttatactccagtgttgatcggtcattgaatataggtctttcaatggcaacaacagttacaaggaaggagcatcacctgggtgattgttgagaagctgagagccgagggctgcctgctgaccgcactcccagcagctggtgccatgggtcctgcattgaagtaggatcttgggggcacatcacaatgtccagcacatagaggatgtagggagtaacagctaaagcaagactaattaggaggctactccggaaatctaactgagagatgaaggtggcttgaaccaggaggtggccaagagttggcagactctctcttttgaaggtaaagctttcatatattctccatggcctaagatcaccttaaaggagcaaagtaaaaggaaacaagccaaggggaaaggcttcaaagattcagtctatgttattaaatctccccacccattgattatcatccatgacagtctttgcttagcttaggtttacctgtgctcatcattttccagggtgtacagaaggaacactatttaatcacaaacgttccaatcacaaatgcttcagtgacaggaatagaagctgtcacaccagacagggcagataagtccttgtcacatggctgggtctgtccctgcagtgactgtgctattcatagcaagaatgttgtgttgctaaacttggcatgaaacaatacagttatttatgcgacttcatgaactagagtatcgccttggatttgagattctgctaaagctacatgagtgggcaaatcaagaaattgtattccataatttgtttccaatctgacagagtactatgtgtaatagatgaataagcttatagattttagcacatttattgcagtgtgatgtggtttgacacagtgtctatgagctgtgtggggtgaaatggaaggtttaaatggattccagcttcattatcccactgtgatctgaggaaagcgagaccacaatgttgccatccagtaaagcactttatcacattccttcccaagttgaacagcagcgttctgccaaagaaaagctatttgctgggtagactctttagcaagtttcatttttaacttgggtgccaagccagccaatagaatctaatgggctttgcttacaatgtgcatggcttggctatttacatgagattgacagcacgagaaaaaccagacgctatactcactaggctgatttagaggtttctctgctcatttgaattcagccaagctagtcagtctagccctgggaaaacctgcaagagtaaaaagagaaccaataaaagcgattcatgaaaaacctgaagtgcataagaaattaattcccctgagtttccaaactagtcagtaagctgcgctgaggttttgctttctatgtttctcctttgcttagggactggtcaaaatctcgaagccacttgttgatttttctctctttaaactgctttgatggaagaacacccagggtgtaatgggcacctgggtgggtggatgcctaactaaatatatttatataatccttgaaacatgtttaactctggaggttaaggaaggcccaaagacaaagcggagttgttaagggaagaaaaaaacagaacttcttaaaggttgacacggtgccactcattaattctagaaaagtttgcaggggctgttacatgtcagacacaatgctagccttcccagatgcattgatgaacaagttgcaattcttgctgtggtgagctaatggtaaaaataaacagagcactgccacacacagacataagagccatggggcagcatcccattccaatgcctggtacatattaggaacccactaaatacttgttaaggttcattttgtgatggtatttttttcctctctccgctagcttaaatctgttcaagtctcccatggttaatacgataatttttctgatgtttatcaccaataaatttttagaaaaatcaggctacacagtcactctctccaccttcttaggatacactcactctcttaccctttcactccttcgggcaatttgatctgctatcttttcccaccactttaagagaaggactcttgatggggttcccacacctggtcagatggcctctcttggttgtcttcctcaatcctttcattgtgttgtagttgggcagttcctccacctttcacttctcagatgcagcataatcgtgtttcttcctcccctctgaatattccttttctgcctctctgcattccttttcctcttcccaacacctaagtgattcttaaaaatattctctgactttctatgccttctccatcagtgttagtttcaagttatcttgtcatagtttcatttaggagataatgcctgaatctttatcttaagccttgaaccctctagaacaatttcatttgtgtgctgggcacctggatgtcccaaaggcatgtgaactcatcatatcaggagtcaaactcattctgactaattttatttaatgctatttccattcacttggtcatccaggtggagacctgagggtcaagatggagccctctcccatgtctctctctttgctgctctcagatggacccaggggtcatgtgctgtcaactcatccatcactatatttttctcctttgcccttccatgttatttccatttcacccaccgttgtgtgataccacagcgtctgttttacctcccactgaacaaaagaaatataatccttgaaacgtgctccttagtgtggaagagaggggtggtctgatgacttgtttcaaaatgatctcaatatcaaccactgccccaacggtcttgcatttcatacttaagcaacatatttcaatgcagagaaggtttatagtgtggtggggatttgagggtagcttttcaattctgctctgtttgatttttgactgatgaccccagacacagagatttggcctggcagaacctgcccttagttctatagaggacaccttccccatacttttttctccttttcctcttcctctataaactctaggttctttcactgcatttcttttttgtaaacagctttactgaggtataattgacctacaaaaaattgctccggtttaatgtatacagtgtgatgagtttggatatatacaagcactggtgaaaccatcagcttcataatcaaggcttccaatatcattcacctccaaacgtttccttatgcccctccagtgtttgttgatttgtttgtggtaagaacacccaccatgcaatctaccctcttaataaaatgtttaagtgcacaatgcagtactgtcaattacaggcgctgtgttgtacagcagacctctagagcttactgatcttgctaaactagccacttgtcacacattcgttaggtttcatgacagtctgtcctctgagatgggctaagagttagtctgctctcaaagagtttcttgcaagaatatgatgggtgctttgtggtgaaaagtgaaatagcaataaaaaaaatcagtcacttccattgtaaaaataaacgtaactgcatggccaatatgttattctaaaacagaagttggcttcttacctggctttaccgtgcacggaggactttaatttgtgttcctgtcaaactctaggaatgtgaaaatgtggaaagcccatcccaaacaaaaataagcctcttgccggagtcctcacctgaaatctctctcattctcacccattcacctttcaaatctgtgcttttagcacatcacctttctgccctaaaacgtttagtggctcacaagctagtttccaaattccttagcttagtagttagccctccgctaccttttcttaatgcacttttacacttttctccatgctgtaactaaacagcactacctactaaaatagaaagatacctttcaggttcctgacctcatgccagtatctaccatttccttttcctagaattctctctttctccttatttaaatcctgtgcattctctagtgcatttgggggaaaatgtcatctctttctgtaggcattaactctctatgccctaaaatttcatataaccttggtggttccttttatctcacacatttcgcttatttctttgactaatgttattcatgaacatgtcttaccatttattctgctgcacctacaacccctggtggccagtggctgtcttactaacttttgtgttccctgtgcctcacacatcacagactttccagaaccttttagtggataaagttaatgcagaaatgagttaaatattcaaagaagcagtgagcaagatacgttttttattcttcctttcggaaatgaatccttgctcttccccacccctgggaactgtgccctggttatgattgagatctcatagtcactcatcattcattctttagttagaattgcataacattttattctttacaataaagataacttgttaattgcttaaccagatgtgattttactattatattttttagtaattacataaatcagaggaaaaatccttttcagatgatatgcccttatgtgtgatttagacaagctgaccacctacttttagataaagaaatcatcttctgccaagatggggctagatgtgagggaagagaagtttcctaccaagaatttccatttaaattcaaatttagaagctttcttagtccctgagtcttattccacttcagacttgttgaaattttcctcatgaaatatgctttagttgtcttggtaaattttaagagtgagagaagaccaagtaacagtttacaaaggtaagaatcatttaaacctacttactctccctgtttaagcaatgaggaggattctgtttatttatttttaaaaagtgttaagggaagaagtgctatttcaaattaaatgaagacacgggaatttgcctttaattatttaaaatagtttaaatcttgttgttcaaacaacaccttgtctctacaaaagaaaaaggaaaatacgatgacactcagactttgtcaactttttccaaatattagcaagttaaaaaaaactattggttctgaatggtgagataaatatatgccacctgtaatatttacctgaatagtatatattcagaatgcaatattgtgtaatctcttttaacttcaaaataacccttctttgccctgcaaagatacttgaactcttggtgttggctacctatgaaattatgtcaaacacatagattctacatctccagatattcaaaactaattatcccttaatttgcaagtgaaagcaaaataccacctaatagaccatttctctggtaaacctttctttatcttaatgagcagaatgtggacgcctattacaacctgattttaaaacctccgtgccactcaacagcttactcataagactgaccagaaggaggcaacaaagatgtaaatattcttatttacaatatggactgagctcatatctgtctatttagcattttattataatgcatgccatcccaacagaatcaatagttgattgatttcttatgtaagagacttgagtactttaattctggatggaaactcatcagcaacttccagttgatgagatgacgttctccatttggtgaaactgggctacatttaatcatcacaaacttcaaattgtattatcccactttccagataatgtacagcgtattagcccaacccgctttcttcagaagtgtctttaaacagagatgggctgtatctagataggggtggaatatgccagtgtatcggttagccgttcctataataatgctgcataacaagccatgctaaaattccatggcttacacattgctccataggctgaggggttggctgatctaggctgggctcagctgggcttgactccagactgtgggtttcattcaggtctgctccatggacgtctcattcttctgaggacagcgtgctccttcggaaacattcttttcctgatggagactgaaagtttccaggttagcatatagaaacacatgatgcttcttgaagtctaggtaggaactggtgctcagtcacttccacccactgggcaaagcaagtccaatatcaatgggggaacattctgtttggaagaacttcaaagcctcatagcaaaagcctccatatggggagtagtgaaaaattgggaaaaataatacattcgatcacagctgctttgttttagggtttatataaaagaaataactttaaaaggggttacctccttctcatgcctatatttttaaaagtaagtgtattactctacattgaataacccaagctaaaagtattttatagttaaccttgacctagtatacatactctctcactctcactctccccacacccccaaacccaacaatgaccacagatcttcctttccttccactttcacaacccaaaacttgtcctgttcattctctgctcaaaagcccatcagtgaatccctgttgccattgatatagctcaaaccctcggctagctttacaataaccttcacagtgtgtggtttgtctcttccatcattctgtgtgaatttacttgtctgtctttccacatgttatttcctttgctgggacactctcttttctctctcccacctgcctggtgaattgatgtttattcgtcagagcccagctcaaactttacaacgtctgcacatccttcactaatcccctgcaggcttttctgtttccttatctgtggtttacaagcattttatacatatggctataaagcacttataataatagactggaattagtcattcatgcgccttttgctgctagcctgtgaaatccttgaagatgggggtccatgcctcattcattttctatcgttagcattcatctccatgcctgtaacatggtaggcttcaaataaggtggttggattgaaaagaaggagattttaaaaataagcatttaagaaataaaaaggagaaacagccatggcacaaacagttatgttcaacctcgccattaattaaagacactataaacaaataaaaattatagatcaatttttatttttcaaatagggaattatgtttttagaaagacaagacatagtattgaaaaaaacatggatatctggcattgccaactggagtctaactgacaactttcagggatttttatcatttctctttctcaagtacttaaatatattcatatgtgttgacccagaaatttgattttaaataatttatcaagtggaaataaagatgtgaaaaaattacataggattgctgattatagcatcatttatagtaggaaaaaattgaaacactctaaatttcttacaatatcagcccggttatataaaatcatggtgtagatataacattgggccaaaacgtctgccattattagaggcacagttaataaaatgggaaaaggtttaccatgtatgttccaacataagaaattaagagcacaagaaatgagaatcttgtaaaatataagggctattgttagttacatcccatgtacgccaaaaactgaatttgaaagaaatacaggaaaatattaatagtgattacatttggatgtaataatcacaggatgatcttatttttatttttttctttttgcctttctctagtttccaaattttctacaatgaacatacatagcatttatagtaaatgaaaagatctaaaaatattttaaagatataattatgatacagtaacttgtactgttaactgggcttgtgtgagctctaagttattgattatgtatagctctttatgtgagtttctgctacttttgagccttgacttgtttatctttagattgggttccatttctcttttgtaattaactaagaactgaaatgaattttctaaatagaattgttcttaatttaaatatgaaattctgttttctctaatgtaattgtacctgagtgaaagtaactgcaatgaggactataaaggaagataaagtaggaatatgatgtataatttccctttgcataattgtaactctgaagaacgcatgctcccagcagaaaagtaatttaaattatatcacaacaaatgccatattttaaaatagaaactatccatcatgtactgagtaaagctggtggcaacctatacatctcaaaaatatactgaaaatccctccatgagtccattaaaaacaaattgattggtttaattccagcacatgctgaaggaaagtataagtgacattaatgtaattttaagtgcataaaattactaattacatatttagaaaaaaattatgtaagagaataaccatgagaaataatttttattataaaatattgaaatgtgtacaatgtgaacagaatagtataataaatcccatgtatgtagcgcccacaacaccttttatttctcagtacaatttttattttggaaatgatttttaaaaatgtagaacaatacttttgtctttatcttctgggcaaaaccagttttgaacaacagtgaacattttaataattgtagaccagtgctaatatgttttttgtttttgagacagggtctcgctctgctgcccaggctggagcgcggtggcactctctcagctcactgcagcctcagacttcccgggcttaggcgatcctcccacctcagccttttaggtagtggggcctacaggcgcagaccacggcacctggctaatttttgcatttttttgtagtgacagggtctcaccgtattgcccaggatagtctcaaacgatccactcacccacttcagcctcccaaaatggtgagattacaggcattagccactgcacccatctactaatacatattttgaaggcataatttgaaatctgttggaacaaatgctccagcaaagacattaaaatatatttttcacctagacagagaatagacatacctttcatgtacacaatttaaaatacagacccaacactcagcattcttttccttggtcagcataaagcgtgtgaatatggaaaacatgtcaagtgttgcttgtcccccactgttaatgttttctcacattcctgtccagagatagttctctgcatcttttacattaaaaatcttgccataagtgtatttttaatacaaatattttctattttataaatatgacatagaaaaatttcaagctattcaggtgtatgtaattaaatttgattttttacaggaaattttgaaattgttatagtgattaattgatttgttcatctggcatgtattaggcacctactatataccaggtgctcttttagactttggagaaaacagtgaacaagatggataagggatcccatttttaaagcacaaagttttctccagctatttcttaatggagagattaaagaaatcttcgcctccaagaagtctggatctaagtcatctccctttacttgatcaggcccatttccaccccctagttcagttgacagagataggatggcagcctctgccagcatgtttcaggatatacccaggaagcaaatacctggttggaataacaaagtccaaagcgaagcaagagggtgattgttaaatgagtaattagaataaacactgaaaaatggtatctgcctgggcctctatttttctcgcttttgtagtcgtttttcataggttggacttcttgcccttcagagataatgaaccacaatatgcatctatctgtgggtagcagtagcttgagtttgggattgttcctcgggttcctagggatttttttgaaaaccaggagaggattttctgaacccaattggtccagttaatgtatctatacgtcttacttctctcttttccaggcataaatctctgggctggcttctagaataccaggtccctttcccctcagttcctgtgtatcctgtgttatagctccaagaaggagctataacagggttagaacaaagatctcccctccctactactcctggataaaaatcacagctaagctgtgacttttgagtgcttagcacatgctaggcactgcagtgaatacttctatacacatgatcgcatttaagctccaccacctatttcgagggctggatgaatttatgtttcttgtgctacatatgaggaaactgaggcacaaatagcctcggccatttgtacaaggtgcagagcctgtaaaatggcagcttggcagtgatacccagttgtatcactctaatccccagagcctgtggccaccatacagggctgcctctcacaacacacataaatagccatatgtctcataggtagcattgacagagtcaattcttttccagtacggagagcggtgaattttgagaagtgactttttggcagaaatgcaatctagtgacaaatcagcaaaaggttagagttcagattaaaactcagaatctctgacttcagagtctacaagttaatctgtgacactttaaaggctctgggaaacaaaagaatactgttgaatctggttaccccctcagactcaggctgacttggagttgtgtgcgtggggcgatgccattccaatggtagccgctttgctttatggggttttaggaagaaatccaagcttcagtagcctttcccaaccgaatgcattattaaagatacaacgtgtaactcaggactgattttgacattttaaacatgatttttctccattaatagagtaccataaagtcagcagtaacaacattacagaaagctgagaaagaaaatacggtgaaaccccgtctctactaaaaatacaaaaaattagccgggcatggtggcgggcgcctgtaaccccagctactcaggaggctgaggcaggagaatcacttgaacacgggaggtggaggttgcagtgagccaagatcacgccactgaactccagcctgggtgacagagcgagactctgtctcaaaaaaaagtcttactgtaccatatgtatgtggttccatcatacatcatcgtaggtcatcgtcacctttttctcccttaggtataagccttttcttatgttattgtctcttttcataaataggatttttcatagtgacatacacatcattgaattaataaaccacaatttaagtaactatttccacattactgaatatttagcttgttcttttagtcccctccagtttgacactgcaaacaccaaatttggtcctctgttattttacttccagaaaataattttttagaactaagattaccaagtcactaatatttttgtggttcttaatggatatatattgccaactgcttttcaaaactattgttatatttaataccatcaaaatatatccattcacaagtttaattacactgtcttcatcattagtcataacgttttaaaaacataattgccagcataagagggaatctatctatgtctttctatttctctctctctatatatacatacattttatatacatataagcacacatcaaacatactatatactatatacatactatatattatatgcatggtgtgtgtgtgtttatatataaacacactgtttatatatatgtgtttatatataaacacactgtttatatatatgtgtttatatataaacacactgtatgtatgatgcatgtatatatacatattttaaacaatttctaagtcatactcaaatagagatgatagtactttgacatttctttaaaatctaggcaaacctgagatgcttttatcattgaaagtagaaggtgtccccattactggcagggaaatagattccagaatttcatattctctccaggtcagccactacaaatgagaactgaagaattaatctaagacttttttcatttttaaaaatcgggttattactttagcagaaatatgactttatgccttcataactaattgtactaatttatgaataaagtacatttttatttaaaaaaccaagaggcatactagaagaaattaatccacttattttcttctcaagtaagtggtttacttaagcatacatatatatacaatttcattttcctaagacctagaaaaaattcccaaactgatttcttaaaatttttacttgaaaaaaatttcagcttataaagaagttgcaagagtcgtaccatagttggaaatactctgaatcatttgctttgttttggtgtgatagagattttttgtaacgatcacttataatgtaactccctggaatattaaaacaattgttaaggacctgatgttgtgattagagcagccctgtttctttcgtttttatattcctgacagtgaaaattgctgtgcaaatagtagaaactcagaatgtgttgttgaattgaattgttagattgtcttagtcctcttctattcaggcattttctaagacaatgtgattgatacaaacaagtagaaaatatgctttctcaatacaatgagttttatttccagtgggactgtttaatcagaatgaaatgttgttgtaccatgatgactgccctgcccttagaagtcaattattttatgatggagaaaaaactgtggtccgtagatcagtagaatcagcatacctgggacctggttagaaattcataatctgtagccaaaacctatggaattggaatctacaattagaagaccctcaggagtatgcacgttaaagtttgaggtgtttaaagttaaagtatgcactttaaagtttgaggtgtgtttattcaggtagctttcctttcttctcatatagtttttaggtataaatgaaaggtctggattatttcacgtattggcagatgtgtatttattttttagtgcagtgcttctcaaagtatggtccctggaccagcagcatctgcattacctgagaacttatttgaaatgcaaattcttgggtccttcctcaggtccgaatcagaaactttggagaatggcactactgtttaacgagaccttcaagtaattctgatggctagagtttgaggaccactgctttaatgcttacgagagttgaattagttgtttaaacagaaatcttagaggctttgaatccacttacaaattagtcttttcaaaggtgtactttttaagtgtctgcataatgcgaatgttgtgaagtatgtcaactcttgggatttaggaatagcagagtattagtattccagaggcaaaattgtaattggccttttcacttgcattttccccacaagtgacaaaaggctaaaattaacaatagaaaggcatttgtttacatccaggcaaccttcttttttaaaaaccaaggcacaattttagatagttgataatacctggaaaagcttgggctcaacttgaggaagtagattccattttacttttcctttatttcccagatacagagaaatccatgttaaatgccttccgtgggtccagaacttcttgcttgttctctttgcccccagtctcctatttgacagagcagctgcactataataaatgactccctggcatttcagcatcatagctggggactctgccaaagccctggccacgtctctgtagtgggacgtacaacaacgaagaaaagaggctggatccacaaaccccacaggaaattagtctcattattgcaactcaattcatgttcccatccagaagagggcttcattgcacatggcaattaatttactatgcagagtgtgttttgcttggtatcagcttttattctgacttccaggacaaaatggttgcctgagttcttaatcgtgtgtgtgatttgacagtcaagatgggctatgggaatcatctcttggtagtgtcatcagcagaaagaaaattcttttctgaattgagctttggttgtatgggatagatatctgttctgttggtggtggtggttgtggtggttttgtgttttaatttttggattgtgacctcagtttgagtgagcaatgtgatgaagctgctaacaaaaaaatcaaagagaaaactctaaactctgttaataattgtacattgtaaggtagtaaggcatgttagcctcactgtgcttgtcacagatcagaatctacctagagagctggggtacacgtagaagcccaagagtactagatgatctcctataaagagccaggatggtagaagacctgtggattggccttctgctatgtttctgtttcccagcatcttttccctcctgccactgcctattttaagcaattttacttgaactttcaaatatgtgccttggtcatcccaacagatacctgcacctagttggccaatcagatcactaattgtccggtctcagcgattgatctagacacatttatgaccaatatatggcaaatgagagttctttgggggaaattaatttgaatgttgcagagtgttggccttctcactcccctgaaatatgagttccaaagacaaggtgaatctggaattgtggggtccaatttttttttcaaatggacacagtgagttggataaaaagcccgacagagccaagaaatgcagagagaaagagagagagagagacagagagagagaaggaggaaggtgggaagagagtgacagaccttacggtgttattcaaatccctggatccagctgtacctaaagcccataccttgagcttccccattacatgcaccaatatattatctgtttaatgagtttgtttgcattacattcaatgaggcttcacttacatagcccaggagtctcacttacgagtaatagtttgaagagagaggtaaccctgatggagaaaaaatgaagatttatcgtgacaggagtggggcaggaaaacccacttcccttcacatatctccaggttcggaactcatctattcctcctaacagtgctctgaagtattacctagcctgtgctacagatacaaaaactcaatgtaaggctctaacttgtttaaagtcacatacagagtgagagagctgggactggaacccatgttcatgcgattgttttaaataggtgtccctacttctgagtttccattgcattatgtatatattttccttgaacctccttaaacttaacgtattataaatgtttgtagagtctactaggctatgccttgacagtcattttttgcttccctcctttccttccttcctcacttgtttctttgcctccctcattttctcccttcttcctcctttcctttatgttcaccagcacctaacatacatttatgcctattggaggtgtcagtgatgttatttttgccaatgactgaatgaaagaaaaaaatgtataagttgaaggctcctgtctctagaaacatggaactaaaggcaagtcgatttttgtttaggcattatggggagggtattcctgggtggggccaaagatcagattaagaatcccccataaccctttaaagtcaacagtccatggaggagttgcaccaaaaagagactctccttctaaacatctgtgtgtgattcctggaggacataagttgagcggggtgcttttggaggttaactccaaaagcagcgatgcttcagagggcagcggttgtaaacagaaatcaggaagcagatggtgggggtatctgtggccagaaataagaatatctttattgctgagtaaataaacaagccacatcctgactaaatgggtggaaatttcctgaacatccaggaaggatgtctggtctttaatctgtttttggaaagtcaacctcagagcactaagcccaagtgtgtgcctctaccagcctcaatctttatcttgtgatttatcacccactctctccttctttagggagcttgttggttattctgcttatggactcacagaagagaacaattcttcctccctttgcccattcaattccaatctgaatgttagtaccagactaatgatctgacatagactgaagaaggttccaaggacttttctgaaagctgagcccatttttgttcaccattctcttaaagtctcaggtggagaaggaagaccttaaataatagcttttcttttataatgaaaggggaaaaatatctgaaagaatgcttccagctgatagaggttggacagaacagtaaggagaaattctctaagtccacctggagcttattaagattgaaaattgcaagagattggcttaagctgattttttttttcccaacagcctaggcaaagactctgatttccaattttctgttatggttgagtgcattcttccggcaaatatttagtaggcactcttaatgctaggactggtcacttaaaacaagtgtctttaaatattcttaatttagacacataatcttcaaaccacaacagtgatggaatgaaagctagtcatcagcagtttgcaaaaattatggcgctggtcctctccccagccaacttaactgggcttctaccatcctcctccttcctgatctttcttttctcttcctgagcatctatccagttccctatttaatcatatgtaatcttcagtatgtgcttttatgtggaaagccagatgtgtaccagttgatgtcaccatgatggacaagaaaaagggaagcttacagagaagggcagattcatgggcttgcaacatgtacaattgcatagggccctgtgcttaacaggagggcccatgcgtgcgagttaatgctctgtcatcactaccctgaaattcttaatagatttttttttgtgttttgtaaatgaagcccaaaggaacaatggagcatgagctggggcttggagcctcacttcacagacagccccacctcctcctgcctcctcacttccctgggagaggtctttagccacctgatccctgaccttgccctacacaaggcacacactgacctcctactacagcacctcattgcaactagcatggaccagagctctggggcagggaggtttttgtcaggtgcatgtaacccacatgcagaattataggacagagccccaggttcctggaaaggtcagacttatccttcatatattccatgcctgagagagcacaatattaaatagcaaataaaaaacaccatgacagattgagagaaagaccatggaaaacaggtaaaaaaaaaaaaaaaaagttttgtctgctttttagacaagagatcgcacgttttcgttttgtacctagctctgcaaattatgttgcaggctctggttacatacagcctttagtttatcagcacacagtgttggtgagcggatgagaaatgtggatcctcccgcaggtgagtataaggatgtctgaatgtacagaaagcagcctgatgtaggccagccccatacttaactgacgaatttatcggttgtatctgtcttccagaaacatacaggctaaacgccaacaaacaatgaccatgtctaagcatctgaatattcctctaagaaatcaactgacaaatttgggggaaacaagatgatagctgaaattaacagaatatcccccaaagcagcagcatgggaaacaagtgttatttataccataagctaacaaggcaggcctgggacaatcaatacatgagcctcctttccaccaaattctcttctcattatgtaaataggatggcctgaggtgcaagaacaatgaatagaataataatcggaaatgtaatggaactaatagtggatttctccggactgttaacttctgttcaaagagcccgccaatgatggatagagagcggcgtgcagaaaggaatctttccctggttcagcttgggtgcactgccttgtgctgactctgtcccctcccctacccaccacaccccatgtgtctagaacaatctcctctgcagtacttcatttcctaaatgaattagtccagagccctgttttgaacagatgcctgtacagttcttgattggttgaggcaagtctaaactgacataagccctaactctgaaacatgtgactttttactttgaaaatgtccaattctcagttgtgagctattcatgtgcaagtaacaaacacctactcaaacaagcttaagaaaagcagggaattcctgggaggatgcaggagcaggaaattgagccagtcgttccaaagggccagaaccagaaggcagaccactgggtcccagacagatgggtcatctctttccactgtgattcaagccctgatttgtggcctttgcctattttcatgatatcaatacctccaccgtggctgattgcaagctaccaatgacgtatcatagaatgtggcactggggagggatgtgcagccgcaccccattattgtaccccattatgtagtacttctgccatgcagatataatagataaataatcttaaaagcatagataacagtcaaatacatttgtaaaagagttaagaagtgatgcattttgagtattcattgcctttgcttttaagattattgaatcatgagtgcatgtaatgtctaataacatcaatgtttaactggcttagaaaaatcctgaaatttcaaaagtgacctcttacaaacagtacgtgtcagctcctacttattattcctcctcatgagtccatggaaacagcctctctgggaagaaggcagagagcaggagacaggtcgtggtacagaaggaagtgactggcagaagtacatggatggcatctcagttcaatctctctttattattttggcataattcaaagttcatatctcacttcatctcaaaaacaatatgcatatctgtccttggcttcattttcctcctacctcttcagacatctcttctctggctcttccccttaacccctaactgggggctttctaccctgtctttgcacaccatttatcctctctataatgacaactcctaaatctaagaaatgggcacatttcccctgctaagctacagacctgtgtatttacgtacttcctagatattgccccatgcatggcccaccatcaccttaaattcaagatatccaaaacaattctccatcaaaaaaaaattctttatagccaaatggaagtgtgctgtaatgagaggcatggactttgattctagtgccaaattgtaggtcttaatgagcttgctgactgtgagcacgtcactgattctccctcatctcagagttttgccatctcataaacaggcttgacctcgattaatgggttttactccacaatccatggggccctttattctgtgggtccacctcagaagctgtccaaacatcaagagagaagtggccttggtccagtcctgggcaccccatctcccatcaccaagggccatctgtctttcatcttttcatatgttaaagttccatgaactatttcttctctgaagtagtcatccactaattcattgattcactgtgaatcatgaataagatcatgatcactcaggaaccctctaggtctagcattccgtgattcttcggttagtgctcacgcttctggaatgaaaagtacaaaggtacaggggcagcagctggagatgacagcacagtctgttgccatgtgtagttcatggcgcagggtcagggcagaaactccttaatattaaacttagtgtacagtaactctaatgcctgatatttgatttgcattaagcactgacaagaacctttcatgtctatttctgccctggggtcctaaaacataaattttaacattccttgcttctccttgatgatcattcccacatagaaatggaactgcattaataatgattgttgaaaaaatgaataaatgattgttgaatgaataaccgaatgaatgccaccagggaaaattattgtctccatttcattttagggcctgaactttaggagaataaagttatcctaaagagagctgttggaacctgcctttctaaccagcttcctattttctagaaaaggggtcactgtttgtaggaattgtctaggattcctgagaactgccatcaaacattcattttgcttttcctattgctaagcattatcagacagagacacagcttctacacaaaggaagatggtagggcattgtctgttcagggctgctagatcaatattatagttttatttatctattaatttatttggatttctaagcagctctaccttttgttacgatgattatatggcaaaatgcaaaacaacttgacaggactttgctatctagacttttgataatgatctctaaaagccaactcatttcatttgcgtccttttatgaataatacaaaaaaatccaaaccttaactagtgtttgtcacagtcagtgggtacttcatgagccaagagtgcatagaaaggtatttttggttcattactaggtttctataattgacctgacattttgtgagagcaatcatgtttgttaaggagaaactcaagccaatgctgtagttgcaaagttctccttactattaccctgggaaacaaattcatcagaagtgtgcagatgtgttttatgtgtgcgtacacacatacatccctatgcatacacaagcatgtacacacattggcatgggtcgacctgataaaatatatgcagtgttctctttgtccaaatccagctggtcatctagggactgtatagaaaatttgccagtgcctgcagccctactccatgtttccctttttctctgcagcttgagcctcaccttaaggcctaagtgagatatgcattctgtcccaaatgatggctcatggggacagaacatttctgagtcttcctttctgaccctctagttatatggcagtgattgcactgagggaaaaccaggaaataacaaaggaaactgcttaagcaagttgtgtttgggaagattagaaaagggagtgcacaggaggatgaagctgaagtctctgaggaggtaatcttgttcaaataatagcttttcttgtaaccatattttgtcaaattggttatttctgatgatgtatccccaattttctgaaatgttttaaaacttacattgtagctttctctcatttccttattcctatgttctcattctggtccatcatctgttcatttattcagtccattctttgtgtattcattcaattattctttcaagtgacatttactgataattaaaactgttaaaatcactgacgtcaaggtctatgagcaaaactgaaccaaaccaaaacaagaactaaactagaatccgttgtggcgggattgaccactaggtggtatgtccattctttggccttactggggatttaggcatttgttttggttatgtgccttgttaaatattcatcatgtcaaaatggtggtagtaacatgaacacaatcaagaaaatatgaagagagtgatataaattatatttggagctcagagaggggccaggaagactttacatgttggattgcttctgccttaggcagaaaagaagttgcagagcgttctaggaggagtgaaatacttgagtaggggctgggaagcaataaagcaagtggtattttcaagtttatgcatccacaagatcagtgttcaatatttaaaatgttcaatgtgtaaactctatcatggaaagatttttgaggaagtagcttgtaaaaagttgcatatttctatttgttgctagggttacctaaccaacaggttcttggctaagcaaaaaactacagtctgtaaattagatattctggaataaaaaatttggggaaagaggaaaaggactcatgctcccaagaaggccaagtgaaaagtgatatccttctgatagggaaagaagtcatgagtcattagtctggactgctatagtaatgataataatagtaagaataataatagccaccatttgtggatcacttactgcaaaccaggaactgtgttaaatccttctcatgtgcaagctgctcctttaacctgcgtggcaacccggggtgactagctgttagtatagcagttccttgcccaagtttctcagtatctttcagcctcagtttcctgttgggcaaaatagagattacgggacagtgggaacattaaatgaggctatgcttgttatgtggttagcatggtgtcaagcagggagtaacaggtcagtgagaattatagtattagctactattagcatttctccttcctcgttagtatttttccttccctgaggaggaaacagagaattaggaggaccaagctgaatataagcagtacctgagagcattcttggaagattatgctttcgtgagctcctcttagaactgaaaattgatgatgagagagacagactgtcaccaatgcatgactatcaccttgtcattattaaagcactttccactagtttatattattttattctcataagctctgtgagggccaggatttgggtcttctcttgtcccttgctacatcctcatctatatcagtggctggcacattatctttgttgacgactgacctttccttttcctctttctttgcctggcaaactgttacttgcccatcaggatccatggggacattgacgctcctccatcactctcacctccagtcctctcttcccacacaactcttagttcatacagtggtcacagtacctccatgctgtattgtatcctatctactctcctgtttgtctcttgctgcagactcctctaaggcagggaccacttttcaccacctttccatgcccctggatccttgttcagatttggcttgatgtacgcactttgaagatacttgaatgagtgaccacaaatatcttcatttgcatctgaacaattttcttgatatttgaacttcttacccaaacccccaagtccaaaggcccttgtcttgagcttacaggttttcaaagaatgctttacctgggtatagggcagctctcacatgcctgggaggaagccttggagcaaaaacaaatcgatggctctgaaagaattatgtcaacatttaattgcaagagatagctgctctgcccagagggcttccggaacaccttagcttttggtttaaagctcaattttaggtaactgatcaggtagaagctagtttgactaccgcagcttgcaaatgcaagctttggtaataacgccatagctttttttttgttttttttttttttggggacagagtctctctctgtctccaggctggagcgcagtggtgcgatcttggttcactgcaacctctgcagcggattcaagcgattatcctggctcagctttcggagtagctgggactataggcgtgtgccaccacgcccagctaggccagctaatttttgtatttttagtagagacagagtttcaccacgttacacaagatggtctcgatttcttgacctcgtgatccgcccgcctcggcctcccaaagtgctgagattacaggcgtgagtcaccgcacctggccgccacagcttcttaaaatgtcactatcaatccattctgaggctagaaatctctctggcaagtgtgtgaatgcaaaggtaatggctttacctttcaggttagttgtagataatctcatctttgttcatgaccggtgagtgccaagcccccagcattgagtatgtagtctccaagggacattttccttggaccaattgggaaaagacctggtcaaaattgaggaatgggcaatactcacctggtattttgagctataatttggttctttgagctatgagaaaaaaaagggacacgggctatgttgaagtaacaggaatttgagaagtaagggtgatgagaatctcagaaaacttgcaacagctggacatccaggtctcctggaaatgggaagttgattgaggaactggagggaaagttaaggtcctaactttagtgattgggtttctgtgtcaccaccttggcccaggagactgttgatacccccccccctttgctttgtctccccatttcttttagtgtctctttccagctgagcagtcttctgactcccactagttcaagtttctgagggagaagctgattgagcggagctgtgcattagacagcttatagatgggtgctcttaggtcacatgttcccagtgagccaatcagcagcctctagaggagaggtcacgcggcacagaatatggccgcctatgcttaaggcattacagagggcatcttcctctggaggggtagtaaatgtaggcactttcttctaaatgggctatgggtgtaacaggcattaggctgcttctattttatcagaggatggggccatgattagcccaatgaacatttactaatcattgaaatttaagcatggcagcctggtgtgtaaccattgtttgagttagcatacttcagttttcccctgttgatttagtctcatgtaaatctctgaagcctcggccagtcttttcttaaatacacgtaacagctaccataattctctttctgctagtcctttggtccacctaagttcacctagtcaaggtagacagtctgcagccactatccttcttcactttctaagggctttctcagcattgggggcttattaagcagcaagcaagtcagtcctgtaaatgtggggaagctggctccctggggtctctcttaactgttgagagtcagtggataaatggcccggcttcctgtgagacaattgtgagtcaggttccacacagctccttagagtgtccccactgggagtgagcagaaacctgatttttaatataaactttatttgtgtatctcccttctctgcctcatttttcacacctcctcacttgtacttcccaaatatattctctgctccaaaatccttgcctcaggctttgcttttgggattattcaaactgagacaataaaatactacacccattttagggaagatcaggagctaacagtgtagggaccaatgcattatggtcttcatctaaatgaagtctgtttctaatatactgaatgtttctgtaaggcaaaaactcataggtaattggttaaataggggattgtatattaatatgtagtaatatatacatatatgtatatgtataatataacatgaatataatatacatatgtatacacatatataatatatatgtataatataacataaaaatgactttggtccatatgcagtattccatagaaaattgatattttgccttaacaagaagcggcaattaaaggaatgtatactaatatagctgaatgcagcacacctcaaaagaatagagaatggtctatagaattcaaataggttctgcctcttgactcacttgccaaatcctctgtcttagaagtgcttattgagtaattctcccctatcctgacgcactgcgcctctgttgccataattcagcagattcaccctttccttataacccgtctaccaagccccaatccacattttttaaagggaaagccttatatttactgtaagttttcatttatcaacaatttatgtcttctcaaacacaccaggtttaaaaattatgattataattattatttgcaataattatgtgattacaaagttgcaaagatctggagcattctactctaatcttgtcttttccaaaatccttatgattttattgcacaattttcctaagcatagagtttttctggaacacaaatattttccagaacacctatttcagggctgctccacacataggcatatctgtgccagttagacataagcacccggctcattgcgggtacttactgagggggtagaaggaacatagtaccgcccccgcaaaaatgcaattagcctgttatcaaaataacagggagagatgaattcttatctttttgctggaaggtcggaagaggcattgggcttaggaagtggccacatcatagtcatttgatacactgtcatttgcatctagtgtaaaattcaccattgtttatcttatgattttatgagtagagaccaactgaaaaattttgtacttttattaatattatggcattacaacaccttactttaggagattcatagtttggaccctgtttacaaaaatgtaccagttatatggtatttattgagtgtctttactgcatactaggaatcatacaagagggaaacagaagttatttctatatgactctgatagcacctgtatttgtcccttttgtgttgctataaaggaatacctgaggccgcgtaatatttacagaaacgaggtttatttggcttacggttctgcaggctgtacaagaagcatggtgccagcatctgtttctggtgagggcctcaggcagtttacaatcatggtgtaaggtgaagggggagcaggcatgtcacatggtgagagagagagcaagagagaggaggaagtgccaggcccttttcaacaatcagatcttgcagtaactaatagagggagaactcactcatgatcgcagggttggcaggaagccattcaggagggatctacccccataagccaaatatctcccaccagcctccacctccaactctggggttcacatttctttctttctttttttttttttttttttttttttttttggagtctcactctgtcacccagactggagtgcagtggcatgatcttagctcactgcaacctctgccttccaggttcaagtgaatctcctgcctcatcctcccaagtaactgggagtacaggcatgtgctaccacacctggccaatttttgtatttttgacggggtttcaccatattggccaggctggtcttgaactcctgacctcaggtgatctgccctcctcggcctcccaaagtgctgggattacagacgtgagccgccatgcccggcacatttcaacacatgagatttggaggtgacaaatatccaaatcatgtcacaaccagtaggataaatactacttatttttcattcctcagatgagaacatttagtcacagagtgtggggcagccagccaacttctgatgttcagagtcagtgctgtctaaacttagctttcatgttctttctacctcagaaggctacttctcaatcaattatttgggatcagttggtttcatcacatggcattgcatcatgaatatgctgaacaaggccaagggaaggcaacaattaactggcagtttgtaggcttgtgattagatataattaaaagtcacataaagttccaaaaaatatttttcacttgtttcatatctcaacaacttccacttgtttaagttagtgtttttccaagttgcattgtgatgaggagaatttgacatatttttgagggctaagagtgagaatgattcaaagctgtgagatttgaagtgatgtctaaaagatttttttatcatgacttatgattttttatacacacacacagacacatacacacacatcctagtaggaaaaatatcaaaatataataactttagataataagaaaaatggtttctgtttacactgagttttcacaggtgagatatgcattaaaggcacaaaagctaaaagacaaagagaaatggcaatttaagcacttgaaagccttgctgaattttttacagactgtgtcaagtggagctggaaagtgaaaccacaaatcggaagctagaaaggaagcagctaggcaagagagagtaccttggactgctggctgcagtccccttcttttcccccaagtgacctgcacatcggacttcaccctgctactctctcttcccaaagatgaaatgaagaggttgaatgtaatgattactaagattctctttctgctcccacgatgatctgatgctgaggatttttaagacttctgtgccgttagaattgattacttctaaattgttatctactattcataaaaagaaaattattcaagcttgtacttcttggcacaaaatatacctgtgattttctaaaatattatctcttaatgcacaaagttctcaagtgctgtagctaaagggagctaccacagagtattaatagaaaatgtatgtgagaggatgttatttaataaacccctaagtcagtaattctaatgattcaaaatgactttaactttctactaattagaagccagactctcagctttgcttcttgatctgcacttctccccatcttggtgttcttggtgatggtcatgttcctggctgggtcactgcttccatgactgtttattaaaatcccctggccaaacagtgggcgtactggacttcctggaggggttccctggaatgccttgagcaaaacttgggtgccaaaagcaaagacctgctgtgttggagaaagaggaagagaagagttctgctgtctttgcatgtgtttggaaatgtctttctcatcaacagattctcatgcttggggatgccaggggtggtttgggtgggcactctcttcattaatagccattattgtggagtccttaaagtggattaatgatgttttttaggaaagataattatctcctatgctttccgggaggtacatgaactgctctaagattgcaagtacaaaacaggacattcgtggtgctactgtgtgaaaaaataaccagcagtaccttgacatttatagattttatataagcatgtgagtatggaccttgggcctcaccagccccagaacaccccaggcgtccttgtaccgcagggcctttgtatgtgctgctcttgctgcttgacctgccccacccagtatctgtaagccttgctctttctttcaattagaatctttacttaaacatcctctttttgcacaggttaccctacataaatcaacgtgcctcctgtctcctatcactctctgtccctttatcctgctttgctttttcttcacagcacttatttcctgacacagtaaatcatttataagttgcttattttccacctcctcctctggaatacatgctctgtgaatacaggctctctgcttgtcttggtctctgtttaattcctaatcctggcagagcacctgtgacatagtgaacactcaacaactgtttgctgaatgaaagaaaaaatgaaaaggttcacatggagatgagagccactggccaacaatttcagtcaaaacatattatttacttaaaaatgcaatgtctgcatatatttgacaatgataatttattgaaaacaacaacagtgaatacatgagttgatatctgtcttttcaatagatatataatgagcctctggattttatttttatttttattactcacgtattttttgaaacagagtctcactattatcacccaggctggagcacagtgtgcgatcacagctcactgcagcctcctctgcccaggctcaggtgatcctcccacctcagcctccccagtagctgggactataggtgcacaccaccacgcccaggtaattttttgtagatagggttttgccatgttgtccaagctggtcttgaactcctgggctcaagcaatccatcttccttggcctccaaaagtgctgggattacgggtgtgagccactgtgcctggccatccctggatttgaaaaggaaaggggtagagtgacaaggactggttgcatctcacattccaaactgcttgttttagtatgcgctaatgcatcaaccttttattactgcccagaccgtagacctggcttgttccttttcacatgttattctcaccagaagctacaaagtaggtgttatttgtattattattgctgttgttgttgttagaatacatattcctcatttacagacaagtacacaggctaagcatgactgcaacttttgaattgtcatgcagctcagaactgggggatctagaaactgaattcagcagctgattatttggttcccaataccatggtcttgctacttacctactagaaaggattctcatttgtctatttaagttcttctcctctactctctgaggaggattctttcagctcttagtgaaataaaactagaaatggaaagggaagtctcaaatctatgttcagaagagggaagaggtttaacctgggggtgggagggaagcagatagatgtgctagcagagcaagcagtttgagatctaatatacagccttagtgggattaaaaatatgaggtataatttgtgttcatttattctacagatgtattttgagaacatagtgaaggcatgatgcctggcccacagtaggtgctcaataaacgtgtgttgaataatacatgaaggacacgaataaatgtgtgttgaataatgaatgaaagacacaaattcaggaggtaattttgtttgctggtttgtgtccctttatctctttatcttgtgatgtggaaccacactcacagagtcccttcatcttcattcatttcattcattcttttttttttttttttgagatggagtttcactcttgtcatccagtctggagtgcaatgttgtaatcttggctcactgaaacctctgcctcccaggttcaagcgattctcctgcctcagcctcccgagtagctgaaactacagacgtgtgccactatgcctggctaatttcttgtatttttagtagaaacagggtttcaccatgttggccaggcaggtctcaaactcctgacctcagatgatctgcctaccttggcctcccaaagtgcactgccttcattcattcttaaatcattcatttctttgtggaagccccttagctccatgtagtttatggatgtgtcagaacaaactgaatattgtttattcttttactttttaaagagatgagtatttgagtcctctgattcacagtgaatttcagaattctatcagctaaatacctcttgaagctccgattaccaagactataagcccttctacagcattaagggattgctcgtaaagatactgctattatgcatctggtgtaaagcctcctcatctttagctcaattcaacaagtttccattcagtgcccagctctaaaagtcttaaatggaaattgattccctactccttctattttaactgtcaaaatcatagactgcattgtttccaactgaaaatccgctgacagctccccaccaaccaccccgtgagccttcctagggctggcgttgatgatgctgctatcaatggggaatctacattgtgcacgggtatttatgatgagaaaatcatgtggcataaaagagaataattgccttcataagtgtataattttttatactataagcttctcaatgaaaaagcattctaagggaggcataattgctaattttcggtgttaaacatacctctgaagagtatttcacagtctaactctctgagtgtcatgtcttcctgtggcccggggaagagagtgggaaggaaataaaatttcattgagcatctacataggaccaggccctgtaagttcttggatattggtttcttcttataatgacttgagaattacatggaattatccccattatatgagaagacagagtctcacaggagttaaatcacttctcataaaatcatctctcatagttatgtgagttcagaatgcacgtctatgctaccccaaagtccaagcttaatagagaaatctacagcaactctttatattctggagaggttttattactaagcttaagaattgaggtgccctaagaacgggctgcccccaaaatattttcctcaccacctcacttctgtttccagaagcccaacatgaaaatcactcttctgaaataagtcctggagtcttctttaggcttctgctaaaaagtcttattcgtgagatgtctagcgtaacttctttttttaagtcaaggaaaatgtgtagaatttaggtcaagatgcactgagaataatttgcaaaacccgtaaatccgtagctgatatatttaacaccaggtccaaactgtttctgaaggattgaatctcttgcctgaatactgaagaaaatggaggcatgatctgaggttggggaatattctaccttgccaaggataactgtagagtattgtgacaaagtgcaaagatgccacatggattctggatcagtcagacctgggttggaatcctgattctgccagtacacctttctgcctggttagcttggaacaaagcagttaatctattgagcttcattatctctctcctgaggctcttgtgaggactaaatgagacaatacctaatgcttcatacagagacagtggtcactctatcataataataggagccctcattgtttatgtctttaccatatatcattatccaatatattcctttatatcattatccaaataaatacatctgatcaaatcccccaaattgctttcttctcagcattcctcggtgcaaaatatgagatgtcctttgactatataatataaaatatactataacatataatattgaccttatattgaagatgtatttgtacccgacatacaatatttttagaaataatgtttcattataaaattttttacacgtacagaaaagtttaattttgcagtgagcactcatgtacccaccacctagattctaccgttaccatttaatccacgcattttaccacctatctttccttctgtgtgtctcccgtccatccactaatctacctcatgttttcgattggacacatttcaaaataaattgtagatatgctctccctctaaatacttcagcatgcatatttttcagtagagttcaatatttgcttacatattgtttctcttttgatgtaaaatttacacacagtgaaatgcataaatcttaagtgtgtattctgagttctaacaaatacacacatctgtgtaacccaaagcattgccaaaatgcagaattactgcagaaagttccctcaagcctcttccgagtcaattctgactcctaccacagcaaaagtaaccattgctctgattgttttctatcttggattagttttatctgttctagaacttgatataaatagaatcatgcagcacatactcttttatgtaaggcttccttgactcaacatgttgtttttaggatccttgcatgttgttgcaccgatgtgctttctgaatcgggaaaaacaaatatttttgtgtttgtagaagtctagcttaccctgatgccagatttaaattccctgtgccaaacacattgtgtgctcctggtccctgccccctttaacttccccagcatagtgcctttgttcatgttctttctttccatcactccctggactctggctgttcatattctgcccttcctctggagatcagctccaatcccaaacttttccaaagtctgcattgactcccttgggtttctgcctgagctctctctcctttggacactggactgccatcccattaactgttgatgttgtcatcagtgatcagctcctggtcataaactaaggaagagttaggtgggagcactggcactgagggtccatgtgctcacttagctttccagggaggggctagaccacaggtactcttcaccccacgagccaaaaggagtggatctagagtgaccattgcaaggcctcaaagagaaacgaagagtgaggagtgatggggaaagagccaaggggaccatccctgagtcatgggcgtgccttgggttgaggctaaaggttcaagagggaggagtaaagaagggaaggaaactgtcaggagtgattgctgtcatgtggaagaagcctaaacatgaagtcatgagagacgcaccttgtggctggtgggaatgctacacaatcatgcaacatgtgcctaattttctcaactaaattgcaagctgatgtcttactattgacaggaataaagtttcataaggtgttccctgcagtggcctgactgtgcaaggtgctgatagatacctgctagttgataatgatgcctctcacatggccagtcattttagcaattagtttcattgatattgtgggactgggcttattggagatttgactgaattgaccatttcagccactacagcctttgcagaatttgtgtctgtcaacctggccttcccaaggaaatggaggttaggcaataaggaatgtgttcattttattgccattttactaccacagcatggtagattccagctattaatcctcatggtataaggtgctttttatatcttcaaaaatagggtatagccttgatctctcttcttgctgctctggaattaaaatagaaatctttatccctatctcaaaatctttggggcaggttaggagagctgggcttcaggatcatccagcctagtgcttaggtctgtttacagctcagcaacatttccattggttgagggatattgttcagcagccactgaacatcaggctctgacctcttgtttctttgctgtctaacccagcagaccatcctcggttaatacttactctgattcagcctagcaaagaagatcagaagcaattctgtgtccgcaggctccctttcacacctttaatattttgtattttgcaaacattttgagttagttagcaggtctcttgctttctcttgagggctgggcacaaatgttcaagaataatcattgtaatggcatctctctgattaaaaagacagctggcaagattgagatagaacatcaaattctgaaacatcattagcaggattctattttggttaggtataatcttctgtgaggtcatcatgttgtcttcgatgagtctaaccattttatatcatttagatctaaacagacccatcatgtcacaggcaaatggctttatcatatttaattaacccaacaccatgtaataatctccctggtaattatccctcactagtgcttgaaagcgtgctgcaacaaataaatcatcaaagttgcaggtatacttaaactgttatttggtgccgtggcagaagaatattgacaagtcacagtgcaatcctaattatactaagaaaatgtaaatggcttcatcaaaaaaagaaagagccagatggcaggttttatatactgtatcctcctgtgttagaaaatggggtattaaaaaggcttcatgccctcagcatcagggaagaagaagaaataaaggctgatacctctgtctttatggaggccacgttgaacctctaattctggagaatggtaacattgaagaggacattagtggccattgacgtttatgtctcctgatgccaccctacatataagtgaatgaatattaccaggatgaatgctacttttcttatgataggaattgattgaggaggataggagcaattccatgatgccctagattttactttatgtttgcaaatgacaaattattcacagaaagacatgtgcccaccaggtggtgaatcaatgtgtttccattgacctggcttttctaatgcatcagcaagaacacatttaccggaatgcattgcaattaaaaagcaaaattcagttggaaacaatggacttaaacctacgaaatgtgacaggataagtcagagaggaaatttgatttcaatggtgagattaacgagcccatgaatgcatggtgcatacggcacagacaaagataactgaattggattttcaataagcatagagttctagatttccctgttcttgaattgtgtaccgtaccacccagctgctgtccccagctaattttgccagagctggatgtcagccaaagcacaactgtctatggcttgggaagttctcctttgagtcagattatttagttagctcaggctggtaactgccacagaacctggctgtgatttggtcttattagaaaacaaatttggaaagtattagagaatagtgttcgaatagtaatgttttcccttgctttccttaatatttcctttgtgtgagtgtgtgtttttgtgcacattgcactgttgttacccaaccaatcagaaattctgtttattataaaagtaattctccttaattagagaaaatttggaacgtaaaaaaggaaaaggaagaaaattgctcaaagtttgcagtccaattataatggttcttgaccgtttagttatttagtctttttcctttatgcatacattttgaaattgttggtttagtttttttatagtttgactcatcaaaaatcatatattcactatcctgcttaaaaaatcatcataagtttaatctatatagttacatattcaatcattatgctttgagttatattgacattccatagacagatgtcatttcatgatttttaagcagtcaattttcaattactgcataatattcttccatttggagatacatattttagttcagtattattgtggcacacttattttctatatttcctttttttctggagacagagtctcagtctgttgcccaagctggagtgcagtggcgtgatctcggctcactgcaacctccgcctcccaagttcaagcaattcgcctgcctcagcctcccgagtagctgggactaaaagcgcacactgccatgcccggctaatgttttgtattttagtagagatggggtttcaccacattgcccaggctggtcttgaactactaagctctgagctcaggcaatccccccgcttcggcctcccaaagtgctaggattacagccgtgagccaacacacctggcccaatagttccaattttttatgtgtatatttttaaaaaattaagttgtgactttagcgtgaattgaaatttgtttgactatacttcataaacccttttatattgttttataattttttgcaaacataatttttaacaatgcataacttgtttatcacaagtcagacccagaatatttagctcttcctttgtgttcattcactgaaatcaaggtgctttccagttttttacaatgataaataatactttgacttatcaattaattaaaatgtgttatatgtcaattatatacagagcactgggctaaactggttatctgtgtacataaactttccaagtttgggattgtctgcttagaaaggatatattaaattggtaccattggacccaatatgactggtgtttgtaagggtctaggtagaggctgcttgatagcatttgtaaagggcaattaatctattctgccgtcagcattacagctcgcttcaccacacctgtgcactcaacgactcttcctccccgaaagtggagacagtgaggcaaaggacatggagaaacggaggctcggagagtttcagtaactttccccagtccaccagcttgtatcggaattgggatttgagctcaggtctgtccagctttagaatgcaaactcttaagtgctgccttaagtttgcttccccagaagaaggtcctgggatgagaatttgtgttaaagtgatgtatcggaaaggttgctaggaaaaacgtatagggaagtgggaactgagtttggcaagagggagactgagcaagggtgtcatctcaagcgaagttccattgagataactttggcctcatcttccagggagactgggaatgatgtgatttgcacttcagtgctggcccctttggggcaaggcaacttgagtatttataactcttgacccacaagtccttggttaaaggctgctgggatagtgggcaggcaggggcacaagttgtcagatgcttctgtacttcatgtgttacagacaaagcagatccactagatgcagccttttggaaaaagacacagatgcccttgatgtgctggtgtcggttagcaatggcttggaagagctggatgttaaattgttaggaattttgcaatctggttgaccccactgacagcttgaaatcagccatggtgagagtatctacaccatggaaattggccaacattacaaattagggctcccttccctccacccagaagtgttcagtaaatatttactggcatactaccggagctgctggcctttgggaatggaagcatactgggggtccgtgtgcactaaaatggcaaagaaaatctaggggatgtggatggtgcagggacagcatctactgcagcactcatgtataccagctgcaatatggtaggaaacctgcccctgcccacacaggctaggcagaggtgtgtgagaaaaagggaactggtgagagggaggggaacatgctggatttcagagcaaggtctctcaacctgaggtggcctgggtatgagacatgctacgcagaaaaaaacctagaaataactgagattaaaatagctaactaagctactgaatacttgcactgccaggcactgagctagatgctttactttggctaatcttcataggagccctaggaggtagatttcatcatcatcatcctcactctaactattattatcatctttgtcatccttcttctacagatgataaaattgagatttagagaagtaaagtaatatgtctaacatcatagtgggatggctgagctctgaacccattcaatctgactccaaatgcaaagattgaataactttgacagaataggtcccacttcctatggactgagtacacatggttgtgggggcataggttgcttcagtggccatcaggatgacctgggagtaacctaattttacgtgattataggcttaaccatctggttatcaggaaaaaaaaccatgtagagagcgcacgagagcccagaatcagtagctgggcctcctggtgtggaaaggatagaactcaaatctcatcgagggatggaagtctggatacactcctttcatctctcagaatcagctccaggctggcccaaaacaaatgatacagaggctgagaaaggcagagcaaacctgggacatggggctgagccagcagaatcattagcagtcaggctgtgtgaatttttttgtggtaagagagataaatgtccctcttgttctttgtggtttcctttgccataagagccactgctttgtgaaagttcttctttcctttctctggcttgcccatccctggattgatgtagtagccagcagcaaggacatatgaagggtctggaagtggaaggctgccacccctgccctgctcccacttctgggcccccagggatcccctgacataaacagtcctgcaggaggaaataataggtggacttgtccctgtgacacagtggaggtaggtctggaagtttcctttgaacattaggtaggtctcagctttgtatttcaggtgcttttatcatgtgttttatcctgtaacagtacattctagagctacctttcaagtgtcatcaatctccaattcattttatattttcctctatgtatgtacatttgtatgtatgtgtgttcagttaccattatgaagtaactgacctgaagcaaactgaaaataaatcttgccttatgttgccaacattgcatttttttttctttttcttaatttatctgtgaatattgtttttcttcttcttcttctttttttttttaaatggagtttcacactgtcacccaggctggagtgcaattgcgcgatctcagctcactgcaacctccgcctcccgggttcaagcaattctcctgcttcagcctcccaagtagctgggattacagccacccaccaccacccctggctgattttttgtgtttttgggagagacagggtttcactatgttggccaggctggtctcaatctcctgacctcgtgatccacctgccttggcctcccaaagtgctgggactacaggagtaagacaccgtgcccggccagtattgttcttctttatacctaattactcatcattggaattctctttaaaaaaaaaatgtgcttccctaattggttgccaacagagaggctacatcatagtggttaagaatataggctcttttcccttgactgaagcagtgattaaaacaaaaaaataagaaagaatataggctctggtgtcatactgcctgggttggagacccagctcttcaatttacatctgtatgacttcagttcatttttttttttttttcatttctacatggcttggtttccccatctgtaaattgtggatacttacactagctatctcataggttattgtgagaaataagtgagtctgtatgtatgaagcccatagaaatatacataacatagaggaagcactacctagtgtcagggtctaccactgtgtattctttaggaggtttcaatcttgaccttcagaaaaagaattatttcattcaacaagcatttattgaaaatttccttggtgctcatctctgtgccatgtcctttcatatagattttatctgacataacttaattcttaccatcaccctgtgttaaagttatggtgttcattttctagggtttaagttctggaaatgctgtgtgctcactgtatccaccaggataggtgaggctctgctgcattcatgaacagtcacagatctcagagcctgtgagcgggtttaattctccttcatgagaagccccctggtcagggtgtgttcctgcacctggtggggcagcatggtgggctatcccctcctatggctcctctgttaccaaacaagctcttcctatagctgcagctgaggaataaaaatgctggagaatcttggcggttaaatgctttgacttggaaataaaatggatcagttctacctgcagcccaggagcaagattgggttgcagactctacctaatggccctagagactgtaatcctcccacgtgctggaaggagagtagaatagggtatggtgaacaggagatgtctctaccactcacttgggactgtgagcacctgtctatacctcggctgtcttatctgtgaaatgaggatgacagctgtacctactgcatatagttgtgatagagtgaatagataaatgcatgtaaagctcttagcacactatatggcactcagaacatagtcaaaatggggtcactgtaatcatgatatacaagaaagtcagcggagcctcctaatacagtaaagtaaccattgttttgaatagtcacgtgtggatatcaagtccagttatattacttaccagctgtatgtatgagcatggggaagttatttaccttctctgacttttacttttctcttacgtaaaatggtgtgggatcacactcaccccataggctgcatcaagggttaaatcgctaacatttactgacaccttggaaagatgagctaagcgtttaaaacctgttggctcatttatgtctatgtcaatgctatgggaaaggtactctgttatcccccattttatagcagaggaaactaagcctcagagaggttaagtaatgtacccaggcctctctaactgctaagtggtagagcaaaaagtgaaacccaggcattttgtcttctcaattaatgatcttaatacgcattacagcctccctgagatcagttgggtaaagctctgagcacagggccaggcacagtgtacacccttgcaaaaatattaatttgcctgggtgcaaggtgagggacatatccttttcctattctgaaactctactctgcttaggatgcatactgatggctctttttttgtgaatggatggaagtatgaaaggagcagtaagaaagggcactatcaggctgcatgcagtggctcacatctggaatcccagcactttggaaagctgaggccagcagatcacttgaggccaggagttcaagaccagtctggccaatgtggcaaaacactctctctcctaaaaatacaaaaattagctgaggacagtggtgcatgcctataatcccagctacttgggtgggtgaggcatgagaatcgcttgaacccaggaggcagaggttgcagtgagccgtgattgtgccactgcattccagcttgggtaacagagcaagactgttgaagaaaggaaggaagggatgaaggaaggaaggaagggattaagggagggagggagggaggagagggaagaaaaagaaggaaggaaggaaagaaggagagaaaagagaaaagaaaagaaaaggcactatctatgccatatgcttttgtgagactatcaaggcctgcatgcaaaaaaacccagtgcagagttggtggtcaattagctggagtgctttattatttttaataatcagccatgcttagtgggagtctctgaatctgtagttatgactgtagtaaatgggacacaaagggagcagctggacataccggcaagtattataatgtgcagacaacctgcaaatatgaaccttcttttcaaataagaatctcagtgctgtcactatttgttttaggaagtgctggttttaactgaatgaggaagttaaacgcatgttctgttttttgttttcattgcgcccacatgggttgactgtgggttcggttttctctccagattgaacacttagtacttaatgggggaaccaccttggaaaagcagaactgatttgaggtggcttcatccctctcttctcccaccagaaagagatgggagcttccacttcaacctggggtgaagacagagaacaaggtgtcccagcattttgcacagaaccaaagccctggaaattctggtggaagctagacattcagagtcatcaagctaacagtcacttcctgctatgtgccagatactatgcttttcacagacatctcatttacatttcccagaacatcaggttggagtgcagtgacgtgatgcaatcatagtttcctgcagccttgaacttctgagttcaaatgatccttctgcctcagcctcccaggtagctaggactacagacatacactaccacacctggctgagtttgtttgtttgtttgtgtgtttgtttgtttattttgtagcaatagcatttcactgtgttacccagagtggtctccaactcctggcctcaagcaatcctctcgcctccactttccaaagtgctaggattacaggcacgagccactgtgcccaaaagttaagattcttgtagctgctttatagaagatgaactgaggatcaagaaggtgagacttgatgtgagtcagatagtgaatatgctatagaaaactaaacccagttcctttggggacttggaatttggcatcaatattgtcaccgggctttaattttgcttaactccacactgtggtctttgtgaatggtgcctccaagagttgtgcccctgggtgggcctgagctgaaacatcaggtagatgcaataggccttgtcttttgtgacagttctgtaccatcgtctataatatatctgtattagtaatctatggttatacaacaaatcaccccaaaacttagcagcttaaaaccatatttattattccacaatttctgtgcagcaagaatatgggtgcagcttagctgggtctttgggccataatcaaggctaaaatcaaggtgtcaactgaggcagcagtcatcctaagacttgactgggcatgggttggctcctgagctcattcatgggattgctggcaggattctgctttttcaggctgctggactgagggctttgcttccttgctggctattggatggaagaaccctttaattccttgccttttggacagctccagagggaagctcacaacaggacaacttgattcgtcagagaaaataggtgagaagagccagaaagccagagggccaagaaaacagaagccacagtttttgataacagtcatagaagagatgccctgacacttttgttgccttctatgctttagaagcgagtcagtaagtccaccccaccctcagtggaggggattacacaaggacatgcatatgaggaggcagggttcactgggagccagccactgcctactacaagaaccgtgattattttaacgcaaaatgatgggtcaaattccttttattgggtagaattgtccctccagaaaaatctcttttgtcttgaatattcatgcatgctctggtacctctctttctgtgataaggacgttccagtttgaaaaacctgagtttattagtcaaattgtgctggtgtagaaatattccctctctttcaaataactttgcatccacctgctttgactcatgatgttgaatctaattttattacagagttttggatggtgggggcatttccacgttgctgctatgtactttctatacaaataagtgttgacctttgaagtagtctccctggaatagaaggttttaaactcattgatgatgcaaactttgcttaagaccttgttgtagcttctctttgggaatggcctttggaatcacgaccagaaaaaaaaaaaaaaaaaaaaaaaggtctgctttatctattctcactacacagcatttattagatatggctgccagggagatatctccttcctcactgattgttattctatgcattttcttcctaaaactagtagatttgaactcatacctatctagagccctcattatgaacaacagctttaaagcacgcaaggcactaggaacccctatttaatcatttacagaaaaaacatggcaaagaccaccacctccttccttaattccatggtggatttaaaatgcttagattagctgagtcttaggaactgaagtatccttggtgtttcatttgtgataattttaaatacaagtgttggtctgaagaaaggaaatgatcaggaattagccctggagcctgctgtgtatattaaatcaatctcagatggaagaattgagatcccggaaagcaaagaaatggctggacttagagaggaaagataatctagaagtgtaaagttagggtgggagggagaagggtaaagcttgagtaatgagtccactgaaaactattttttaaatgtaataaatacgtaagtagcagttactgtatgctagatatccttctaagtgcttgacaaatttactccttagaagctaagtactattttccccattttctagatgagaaaaccgaggtgtagggaagttgagggacatgtccaagatcacacagatagtaggcagtccagcttcagaatctgtggtctctaccagtgcactttgccacttcacagaactatccagccagaaagagcagaggccgctttgagaatttctgtgcaggtccaagcgtccacttaaatcagggctcctaacacagcagttctccaatgtcctgtagaaaacattcttgttcccttgggacaagagaaatctgaactcagttgtgcaaaaaagagggtctgggaatgaaccaagagggatggtcagtggctccaaggggcggagcgggagaaggcaaaggagaggggccaggagagaatgccaggaaaaaccagaagaaagatttaaacaaacctcataatttacctgtaaccgacagctctccttggatagtttatctgggcactctattccaccagaaccagattgttggagttgtttcaacagaggaatgcagagcttaagtgtgtctgtgctgtgtgaatatacctttgtgtatctgtgtagcaggtagtggtagaaagattttggaagtcgagggagatgactgaagtagagggaaaggtgggaggtcatggctctcatagtattttgtcacgaggtaactttgacaacccctgagaatcgatcagtcccccaagaagtcaaatacatctgcacatgtgtatcatgttactgcatcttaccttgacaggcgcactttaggggatgcagtctctgcccttttgtgccaggagcaaatccattttgcccatgatttcaggtacacaggtgatttcgccaaacaaaacaagcacagctgaaatctgtgacttaaatcaagcaacggtgtctgcaatagtctcattgcagagacttctgctcccttgttgcttgtaggaatgggggtggggaaaggtcaggactatatatttaagaaaaaaaccccacatatgtcgacccacaagtggttacaacaacattggtttacttgaaagctctgtctccactctccctacaaaaattcaagtaagaacctggaatgcaaggaggtggaagagttttctctccttgccaatctctcccttgctctctgataaaaggtgcggcaaacagggtagaaatgactgcacgggaccagaggatgtaaatattcagtcatgacagtccccataggataaatgacagcagcccatgcaatgtgccttctgcacattttcaactgactcttcccctctgcagccaagttgacatattagtaaattgattccaggtgatgctgacattttgtaattatcactatctataattttcatcttatcccatttaatattttgatcatttaaaatagagtagcatacctaatagtggtcattagtttagctcaagggaagattcatggtttaataaacttacattagaaataacttactaaaattacaattggcatgattagctacttttttaaataaaacataacagagtgactttacccatgctgacagcttttttctttcacgctggttcattgttctattgttgtcttggaggaagaaaagacatgtataacacagaagttgtaataaaaactgtaataacccgatacacaaaaacaagggttatatttcattctacatttgacagtagctgagtagtgtactttttcttgttttctgactggactggagggaggaaatcactgtgactttgaatcagggtcacatttggggtagctgtcctcttctcctgctgtctggagagactgtgaggttgcctgaaaggcagtgggatttaggcttgacttccttatttccctaggcattgattttttttaagtgtatcttctgaagtttgcctctaggttcacttgaggtatcatttctgaagaataaaagtggcagttttaatatgcaggcaattttttaaaacaatgaaatagagatgtgattattgccagggcaaggctgtttagttgccacagggaaacattataccaattggcctatagcttgaaattacagcattctctatattcgtccagctttagggaaatgcagaccacaagggtcctgcctaccgttctgcttgctggtggttcaggttttgtgaacttatacaagggcttggtatttgaatgctatcttaatgagaataagcttttttgttgtgtacattggcaacttgatggctaaggtcattctccatccatttgtctagctacccacacacctatacatccatctacccatctgtccacccactcacccatctattcacctatccatccacccagctatttatctatcatccatccatccacccacctacccacttattcaccaatccacctattaatctatccatctacccatccattcagctattcatctacctatcagtccatctatctattcaacctttcacatatccacccacttacctcccctctcatccatcaatatagccttgtatccatccacgtaaccactcatccttaaacaaaaatcagttggcaaaactgtaagcattggtaataaagagacatataagtcgcagttctgtccttaaagagcttaggatctagtacgggagtatatgtaaaccaaaaattacacaacagtgtgctcagtgcacctacagagaactgtgccgtgttgctgtgggaactctaaagaaagaatggtttactgtgtctgaaggattcaaagaaggaggcacacatgtgaacctaaatgtcatatgtggtaaaagaggaagtaaccagccaggggtgaggaacacaacagcaggaaattaagtagctgatgaatattcagacttgaagttcctcctaaagtgcccatttgttgtttggtagaaatatggatatgtaggagggggcctctaccagggtgcagaacatatggtggtattattagggcaccaggcaggagctgaagtaggggctcagaaagccaatcacaagaaccaggattcagggtgggcctgtggttttgaatggaagaaaggagaaaagagtaaacaaatgggctgggcacaatggctcacgcctgtaatcccagcactttgggaggctgaggtgggtggatcacgaggtcaggagttggagaccagcctggccaacatggtgaaactctgtctttactaaaaatacaaacattagccaggcaagtgcctgtaatcctagctactggggaggctgaggcaggagagtcacttgaactcgggaggcggaggttgcagtgagccaagatcgtaccactgcactccagcctgggcgacagtgccagactccatctcaaaaaaaaaaaaaaataataataaacaaatggatgcatgaacaagtgcataataggtagataaatacaccttaggagacagatcaaaatgcagacttgaatttaattggcacagacacttaattatgcatcttgacatctttgaccaaaaacaaaatgccaagaacaaaagcagcttcacgaccaagcacatgctggaatccggccttctgtctgccttactcccgctgctggtgaagctgcaggaatcctgacaggagcaggctgcctttcagctccaagttcctggcactaagttctgcgcaggggcctgggcgaggtctttatgactttccagaggcttccaggtctctattgaaatgcaacagctgttactaggggcaactctacttcccaaacaagaacatagactttgtggagctttcccaggtgctgtgaacccagcattgccaaacaatgcctgggacccacagcgtctccttcccccatggagtttaaatagattggaagcaaatgcttgttgacaacaggtgtggctcaatgtgagcaaacgttccattccgttattgcagggttggcaccgagggacatttcctgtgaaagaaacaggcttccaggagcatgggcaatccatactcatagccagacctgctcagctcctccccttcagggccaaagaccgcaaagctccgtgaacaggtgctcctaataaatgcagagttttccatagcccaagcaaggctagcagggaggggaggggtccctggccacaaagctccaaccagccaactgatcaggctttctgcgatgatggaagtggctgcatcatcattaactcagctagattaacctgttcagcagaagcttgcagagctgcgtgagcctgccttccactcagcttgaattaaagagattgggctgcaaggacacagagaggtgagccccaggaggtggggtcccagtcctgagattagtgacagcagccctgaggatgtagagaaaaacttcttactcctttgaaaaatgtgtgcagtgattcttttcctccctgagctgtcttggagccaaagtaagttcttcacggaactaaatggagttgcttgttcaatgagattctaatttcagtgagaggacttctcggctacatatgtattgctttgggaagtcctcccttccgaggcaagggcttctccacacctaggatttgatgtagaattactagggcagtatgtaaggacagagaaagaacagaggcagcggcaggcttctgacaagggaatactggtaatcaggctctctgcataatttttggagatttggagatggagttagtggagggaaagaaagaaacggatataattagaaaaagaaaaaaatactaatgtcttcacaatacttaatgttagaaattcaatttgtttttttcttctacctccgcaggctctacatgttcctggaggtgtgtgtggctgggcaattatcctttttcactcttgcccagtgcttgttttgaatgcaaatgtattagttcagatgggccaagttgcagtaaaagaaatccacccccaaatttcggtggtttaacagaacagatgttcttatcctgcttacccaacagctctagtgggtgtttcttctatgaagctgctcagaaactcaggctgatgggtgaccctgccattttcaacatctggtcttcaaagtgaccttagacgttgacatccctgtcggccagaatgcagaagtatcacggcgcagcatgtgggagaggttcttatggactgtgcctggaagtggcagacattgtccccatcacttggtcaaatgaccacacctaccagcaagggcaatgaggaaatgtggtccagctgtgtgtgtacaggaagaagggacagcgaatgctctcccccacaccctgctttcagggtttatccttgtcatttattgagggcctgctatgtgccctacattgtcctaggagctgaggatacagctgtccacagaatacccacggtccttgcccacacatggttagaacctagtgagggaagaagaagaattaatacctctttataaaattaattaattacactttggataagggtcataggggaaaacttcagggcaccatgagagctggtaactctctctatggtgaggtgaaggggaagtagaggaggtttctgggaaacagtgacattcaaactggcaaaaagaaagcaaaacagacttaaccaggcagatgcacagcagggtggcattttaggaagtgggaccagcagctgaaaagtccttaggcagaaaataatttcaaacattttagacccttcctccaaagggcagcgaggctgatgcacattgaagaggccagagagcgccttgaaatgagacagaagagctgctccgggctgagatggaagtcatcttcctggactcagacagttagggctactccttagcagtagtgggggcccgctcatgggtgtaagaaagaatgtagcatgatcagctgtgcttgtcaaaaatctgctctgcctgatgaagtctgaaggagggagggtactgcagtctttcaggggagagacgggggcttgcgttcggggctggcagttgaaacggagagacataagatagattgttgaaataggaaggggaagacatgagactctcttatgtctaaatgtctaacatgggttggaaaggctgcccaccagtcccaggtatgcaggcttggcacttggctcatttgaaagagagacaactaagccataactggtttatccttttcctctgcagttttatggccttcttgacttcaggcctatttaataaaatgcagctctttaaaatggatgttcagtggagctcaaattcaccctcaatgtgcacttctgcggactttgattagtatgcataatagagcagcacacctgatgtccgcagcaggcagttctaatgccggtggagagaggtacaagataaatcactccaagtaaatgactaattaatcatgcacttgattttaataacatataccatctggctcaagatttgtctgtctacaatcttgtattccattctagagatttgataatcagtaaaaccacccatggattcctaattgaggacaatttctttcctttcttttagaaaacttaggaatcaaagtgtattccagtaactgcatggaaggggctggagggagaaggttattgttatatataaagtcgcggtaccgcaaaagaaatagcagtcgaatataaaattttatttttaattctcagcaaggcaagttacttctatatagaagggtgcacccttacagatggaactatggtgagcccacatttggacaagagaggggaaggggttcttatccctgatgcacgtggcccctgctactgtgtggttcccctgttggctagggttagaccacacaggctaaactaattccgactggcaaatttaaagagaatgatggagtgagtgctttggcaggagtcaaggcagagcaggtagcaagtaatctgaatgagttagggtgagcaagtgatcagaatgagttagggtggagcaggtgatcagaatgagtcagggtggagtaggtaatggaaaacggttgctttacgaggaagttaagtttagaagtagaaggcaaagaattgcacatactgacatattctttgaaaagaaatttagaagtcatatcttacagttaaggtttgattttttttttaaatcttaaaaccatcatagatatttcaggataatttatgggacaaaatggacactatcccaatgaaaacgtgtaaaatcacttccaaaagtgtctatgccagagggcttacttgcaatgatcctttgatcctccaaatcagaaaacagttttttttttttttttttttccatagtctcatctatgcctttttggtttttcttcttcttttgtgtgtgtgtgtgtgtgttttattatactttaagttctagggtacatgtgcacaatgtgcaggttttttatgtatgtatacatgtgccatgttggtgtgctgcacccgttacctcatcatttacattaggtatatctcctaatgctatccctccccctccccccaccccacaacagggcccagtgtgtgatgttccccaccctgtgtccaagcgttctcattgttcaattcccacctatgagtgagaacatgcggtgtttggttttctgtccttgcaatcgtttgctcagaatgatggtttccagcttcattcatgtccctacaaaggtcatgaactcatccttttctatggctgcatagtattccatggtgtgtatgtgccacatagaaaacagttgtttttaagggtattggacaagggtcatgactgcttagcaaggaagcatcctctacttgtgcatggcttcaaacgcttctaaattaacaggagtatgaaccatctgaggattcacaatttccagtgagtcttggctctacttatttgaaatggatagcttcctaaagtaacatataattcacctataaaatactattttatctcataagacaaaatgagtccatggtcttattatgtaagactgttttccattggggctggtctcaggctaggcaaggtgagtatctgtaggtggaattctcctgagaacagatgctctaaactttttaaataattgatttgacttcttcaccatgtccatgtatacagctgagcatggccaatctactggtttgtattatactgtcaaaaaacaaacaactttccctaacaaaataaacagtatctcaaacagcagcacatatgtcctggggggtaaacagaaaacttgtcccatttgactcatttcattatttggaagaaatttccgtcacagaaggcagatgtcggtggactgataccagatagtagagaaattctgagtgtttactgtgtgcaaaaaaatgctgcattggggggctttaatcagaaatccatgaaaaatagtgtaagtacaatttatcgagcatttattgtatgctagacatatgcatcacctcacttcagaattagcctatgaagtagaattattattgtcctaaatggacaggtgggacctaggttgcccagagaggtgaatgggctttcacagggtttcacaaccagtgggaaaaggctggactcaatcccaaattaggctcattaatcatgctcttgattttaataacaattttgtttgttttttctctagaaaagttacgaattaagttgtattccacggactgtatggaggggggtgaagggaggaagtgtgtgtgtgatctcaaaagccatcatacatctttccggagagtttgaaaataataatctgaaaatccaaaggctgactcacaactcctgggctgtacctacgatacagtaagtaagaggatggtgtcactgtgtcctcccttctgtcctgaagcattccatgctacacaccattcataagatttaaaatcatcttcaagaagtgccctgttggaataataagtcagtgctctctggaggctataaccaaatataatttgccacataaacatgaaatgtgtgtccaagaaactagtaggaatgcatctaggaaccaaagtgtctccttcctagagagagaggaaaaaaacaaagtgaggatggtcctctgcacaggcgttgtatattttgttctcaaatccagcagccttgacttgacatgggatggttgggatggttctccacgtagccacataagctcgttactacccattacatctgcctgtacctccagcaggtgcccaggagatggctgagtcccaagagccatgcaggcctcctggacgaccgccctgatgtggtccacgtgactcttaacaggtatcatggccttggcacatgttgggcattttccagcgtcactctcagaagaccctccctccatgagttcaccactgctggtctttaactctcagcttagggaatcagactgaattagttctttgtgttattaaccggaggaacacttacattttctgacaactctaatcttggagctcagggaatagcacagagcatttgtatgaaattacccctcgttctatctataggcctaacagccagcatttgtgaatttggcagaagccagcagatctcacagttaatgtcttcctctcctgccaggatctttggaacaaggtgcttagagtgccacatgacaaagagccggacagatcctgggatgtggagcccaggtgatgttatttgcatccaattaaagaagcaggaatgggtagcataattgacatgcatgactcttaatgccttttggttcattaagcctttggatcaacttttgtaggaagacatttaaaagaaactgagcaggacttgggcacaggtagaggtgagcttccgggctgaatcccctactaggccgttagtcaattgtatgtttcctttttggactcacctctgggttgcaaaggaggttgctctgattgtttcttgttataccataaagataaggagcttgagttactttccagctgataaggcaattttcacctttttccatttgtcttggaatttcacaccccaccccatcctacccttaaggtgccctggaggggttgaagggccattcttggtcatccagtctctgtgtggttgggttgatcacagaaactagagaagtcacgaagagtaggtgttcctcaggttaattacacaaagaactaattcagtctgattccttaagctcggagttaaaaacagtgattgtgaactcatgaagggagggtcttctgagagatataaagaggctgatatatgctctttatatctcacctttgatgatacacagctcacctttgatggtcactctgaatcacatcaaggcgatgacaagaacaactgtctagacttagtggtgtggctttgaaacgacacttcgccattcagggattcaattgttttccagttttataatgagggagctgagcaagagaaatattttcaaaggccattctgggctgcacaaggatagaaacaaatgggaggtccattgggcaggacacacctgtttctacaagagcaacctacttttttgttttgttttaatcaagggagtgtcaagcaattgcttatttcataaacagggctgtgctgctatttttacacagtgtgaagtccacaggtctgaataatttcttcttgctccaagagttcctaggtcctgtgttcagattttgagagccttcatgtctcaggtcccaatagcagtttctatgactgaccagcctgtccacagagcatctcctcactggacaggcattgtgggcacgctcctgcggaggaagaatcagggtggtgaggcaattagtaggtgttctacaatcctgacatctttctcagaccagcccccatctctgtctattggcgagatttcttctttagcttctgctcactatgacatgaaggacttcttcttacctagatattctggtgctataggggggtgctgatcagtggagcttagaattactttacacacacatgcctacaccccccctcgcaacacacacacgtaccttacaaaatttctaattataggccaggcgcggtatctcatacctataatcccagccctttgggaggccgaggcaggcagatcatgaggttaggagttcaagaccagcctgatcagcagggtgaaaccccatctctactaaaaacacaaaaattagctgggcatggtggtgtgcacctgtaatcctaactactcaggaggttgaggcaggagaattgcgtgaacccgggaggcagaggttgcagtgagccaagatcgcaccactgcactccagcctgggtgacagagtgagactctgtctcaaaaaagaaaaacagaaaaattgctaattatgctgattactttagataaacatttctcaatttgggcttcaaggcatattaatagacatacaaaaaaattatttggtcaagtgaaaataaagcatatcctgcgtcccatagtagggtagtgtattagtcccttctcacgttgctttaaggaaataccggagactaggtaatttataaaggaaagaggtttaattgactcacagttcaccatggctgggaaggcctcaggaaacttacaatcatagcagtggcagaaggcagccatgattgtttaccaggcagcaggaaggagagtgccaagggaagagggaggagtcccttataaaaccatcagatcttgtgagaactcactcactaccatgagaacagcatggggaaaactgcccccatgattcaattaactccacctggtctctcccttgacatatgtggattgtgggtgagagacaggactagctggatttcctaggccaactaagaattcctaagccagctgtgcctggtggctcacgcctgtaatcccagcactttgggaggccgaggcgggcagatcacgaggtcaggagatcgagaccatcctggctaacacagtgaaattccgtctttactaaaaatactaaatattagctgggcgtggtggcaggtgcctgcagttccagctactcgggaggctgaggcaggagaatggcatgaacccgggaggcggagcttgccgtgagcagagatcacgccactgcactccagcctgggcgacaaagcgagactccgtctccaaaaaaaaaaaaaaaaaaaaaattcctaagcctagctggggaaggtgaccacacccacttttaaacacggggcttgtaactcagctcacacccaacaaatcaggttgtaaagagggttcactaaaatacaaattaggctaaagcaggaggtaaagaagtagtcaaatcatatatcgcctgagaacacagggggagcgacaatgatcgggatataaacccaggcattcgagcagggtgtggtaaccccctttgggtcccctcccattgtatgggagctctgttttcactctgttaaatcttgcaagtgaacactcttctggtctgtgcttgttagggcttgagctgagctttcgctcaccatccaccactgttgtttgctgccgtcgcagacccgtggctgacttccacccctctggatccagcagggtgtccactgtgctcctgatccagcgaggctcccattgccactcccgactgggctaaaggcttgccattgttcccgcaaggctaagtgcctgggttcgtcctaactgggctgaacactagttgctgggctccgtggttttcttctgtgacccacggcttctaatagagctataacactcactgcatgtgccaaggttccattccctggaattcatgaggccaagatccccaggtcagagaacaaaaggcttgctgccatcttgggagcggcccgccccatcttgggagctctaagaacaaagacccgcccgtatcatggggattacaattcaagatgagatttgggtggggacacaaaggctttcatggtttttggcacccgctgctgtcccctccttttgagtgtgggacggatctgtgactggcttctagcccatagaatatggcaccttccttcacataaaccatccatctctgagccatccccggttccttgacttcatagactcacaattccagataagagatgattctaccaccttgctgtcctggcatcccgggattcctgccgcgtgggctgaactgtctgcctttcccagtatggaagtcatcacttactcattcaatcatttagcaccctttctcgcttgcttggaaaatacaaggtaaaaaacacactagcctactatttgatatttgtgcgtgggtgtgtgtgtggggcgtcatatatccctcttagcatctgataaaaaaaagatcaattcattacccagaaatatgtatctgcatgtgtgcaagtcccaatacacaattcagtacaattctgggggttctggactccctgaggaccatttataagttctctccaagtcattgaccccaggtttagttgcccctctagactataaggccccctagatagaaggcaagtgtcatatgccactgcatccccaactctgaggacaaagcctggtggcaggtggaccttcattcagggtgaattgagctgaattcggtacatggctctgtactcagaaggcctttatttatttcttgtgttcctcttatcttgtcacactccaaaatagaaatgtatacctctgctagttgaatgactgtttatttggaaatcatcacccaatgcccaactgcatccaggctgcgtgacatcattccagactacaaagtgccaagcgctaattgatttgtaagaaagtccacatgaaatgcctggcactctcccaaaggcacccatgggcttggagggacgacagcattggactgttatgcgaggaaataattcttgcttgcccgcctgggatggggtgacgttctggccaggaagcagaagcagacttgactttgggcagcagtctgcccctgatggagttattcacagatggctaagttaaatgcagccctcatagcactaaggcatttcaggggcgactaaacaagtggcccatgaaatggaggcaccagaagcctctggaagcggcatcagtgcatcacccagtgaagccattgtgtcgcctgttagtaatgagcatttgcaagggcagcatggggaatttcaatcaacctgtgagaagacaaggtgtgcagacattgtggatctgagcgagatggggagaaaaggcaataaaaagcagtagcaaaggggaaaagaaaagttcgggccaggagccaagaagatactttctgtggaaaagggagggaaaaaaaaaatcactccacccctcctgtccaaatgaaaaagcatttaattgaatgttctttatagaggtgaaaaaataccctgtggagttcccagtgtttcattatccgattgagttcggtacctcaagtttcaaagaccgttctcctgaatggttattctcatttccatgtcagtctgccgtgtgcttggtgaacccctgctgggccgcatcatttaaaactcaaaaccctgaaagtatttttatgcccgatatagtaacagagcaaaccctggtatcactcattttattctccgcagcctccttcctcttgtctgtgatgtagatgactgtgctgctcgagatgcttgcaatcaacagggcgctccccaagctctgaatgaggtgaatggcctcagaggaaaacagattagaaggcttagagatgactgcatctcaggtgcaacacttgaagcaggaagatgggagtctcagaattttccccttgcagttagaaaaatatgggacaggctggggcagtaggagtggatttaagtaagtgagacagtggatcaggaaaggccaggcttttactgggtggaaatagcctggatgcaattatctgctacaagccccaccaagaagagcctccctgctggaggaaagcagaaagggaactggggtataaccaagcttgtccaatccgaggcccgtgggtcacatgctgctgagggaggatgactttgaatgaggcccaacacaagttcgtaaagtttcttaaaaggttatgaaatttttttgcaattttttttcttttcttttctttttttttttagttcatcagctgtcgttagtgttattttatgtgttgccaaagatcattcttcttcttccactgtggcccagggaagccaaaaatttgaaaacccctggtttaaatcctctctacaaactcgccagctctgcaaaataatcatctttgttggtcttaagaacactttaaatcaggtttaaatcatctgaacatcagaaaggaatttttttttcttttcttttcttttgttttttttctcccttgagagggaaatctaggggtggagtagagaatcatttaaaatatttcccttcagagaccaacggctaggaatagctgataaataacataaaagagcggtttaatagtttcatgtttgacccatgtaataccccgcacatttggttaatttagaaaatatttgacgacaacggaatccaatctcattttctcaaacagaagcttaatttctctttgactgaaatgaatagttatgttgccatgccttagccaaacaccctataaatataataccccttcagccttaatatttcaaaaactatggttttcagtttgagctgttataatgttttatctcagaagttgtagaataatttaaaccagtttttcctactttggttccttggaggctgattcttctgcctgaattcctctcacagaacatataaaccccttttacctccctcactggcacaaaagcaacttgtttccaagattcaggacttaaagaaatggctgtgggttggtctacgaaaaccattatgctgcatcctcccagtcctgagagattctgaagagaagcaggccctggcttcagagttgaagaaatgataccttccctcctttgcctcatagtctcattcatgatgtttgcttcccatactcatctccaactggctcacacattccttcaccagatagtgtgggaaggagtccatctttctgcagttggctaatccaggtgttggcatggaagttttagctctggtctgagagttctagtcatggacaattgtccatgtctattggaatgaataattttccaatggacatggacagttgtcccaggggactggaaatcaagggtgctgagtaaactcagcctcagtggaccacctgtgtgagttaatacagagaccacattctgcatcttagcaacctaaacaaaggagaggcacagcaaggtgagaagcttcaaaaggcagtcagccaatgcatcaacctgggcccggaggggtcggggaacctcaaattgtcatccttatgtaacagtgacaactaacatttttcaaggctcgttaccatgccctggccacctgtcccacattattttatggaatgctcagtcaaccctatgaattacatactatattatccccattttacagactacaaaatgaaggtttaaggagaagcttacacacctcacccaaggtcctacagttgttaagtagggggacagagacctgcatttatctgtagaccctccactcttaaccaccctattgacccagttcctaatccagctcacttctgagctctggacgtccaccaggaagaaaacaatggctgtagtggtgcagtgacccttctttgccagtttgtcttgggtcctgatgagctgccaggctcagtctggaaaagtgccctcaatccctgcatctccatctctcataggcattgtgggaccccacaaagactctgtctctattcgcttaacacagtggaaaaaaaggccacccttcattctttttttttttttttttcattcaacaaacatttattgatcttctaatgttttttcaagaatgcttttgggcctgggatacaaactaatggacccaacagatgagtcccttgccctattggcacttactggttcatgtcaggttcctgtgcctctcctggagaagcaggtgataaggtctctgtgttaaaggaggaaaccaaggttctaggcagcctcgtgggtaatacagccagtaaattgcaaagctgggtgaactcaattgacaggactctagccagaaactggttctttgccattagtctctactgacccctatggatgtatggagggagtatggggtacctgggaaacatcaagccttacctagaatcatctttccaatctcgctcttctcttccatttagaaccaccttcaacatctccccagggtacattccctaaatagccccgattattcattattttatggaactaccagatactgaattcctgttctgggccatgcactctaggagctgtgatttcaacagtgaaggaggacagggtggaccccaccatcgtggaatttacattctaaagggcacagtttttctgttgagtcttcccaggaggtgtctttttatttcatacctttgaccttcagatccattcatgatactttggcttatgggtgttccacacttgattccaagggtgatattccatatgtgtaatgcctcgctcaatcagaatggacactggccctagtggccacccaagatggattcttggagcttctttgctgtgacaaataatgaccttttagttgacgaattataaggaagttatgggagatcccagaggaaggctttaagacaggggaattcagagagcttggagcagcagctctttacgtagggccacagtgtatttcagtgtttctccaacggctgcacctgtggacctatgtgtactgggagactattgactctgctcagattacatgggtaagtttgctccttacaactagactgaatgcccattggaggcaggatcctatcaactttttcttctgccaaaccagcctgacacagtatacattgcatacgattcttccatgactatgtacttgtcatgagttattcctcatcattctaaaatttgacctcaaagctgagcaaagtctagatgaaatgaggttctagtttttataataatgttcaatagtttttcctatacgtcactctttcagtgtggggaggaatggtgacttttcagttgcttctgaatacggtttgctgtacactgtgtgttaccagtgtgatttgctataacccagctcttggagcctcatatggtatgtggttcaacagtacagtggtcagtcaagaataaatacagagcaagtactacggtagctgcagaaagagcatcgccaccatgcatcattagtgcagagccctggaccaaaggactcgagctgccgccagacctttacccattccaagtgcagactttgctaattcatcactgccttcctcaagaccccagcaagcttctcatcacatcacttttggcacttatctgatctttcaatgatctgagttagctcaagaaattacatctagttaccataccatgtcaagactgctatttaactagaaaacaaagagacttcctccactccatgcaaacacatgttgattctcatttacctgtttaggaaaaaaaaatttagattcaggctcatatactaattttattcagtgcttaaggtatgtctgttatttgggatagaattcagtgaacaatgctaaggtttacaagggcccatgtatgactttagggccgtgtgtgtgtgtgtgtgtgtgtgtgtgtgtgtgtatacatgtgtatgtgtacatacttttccccctgtaataggatttctttagatctgatgcttaataagacagaaagacaccacagccttctcagaagacctttgcaatatgtccttactactggtttgtgctttcaaagttcatgtgtgtagtggtctctcctgtcaccacgatggatccagatttaagatgtcattgagccatcacaaagtaaagagacactttctaccccaggttgctctggggtgagaaaactttgatgactaaactaaaggtaaaatcaattgcagatgcagtgtctgaattggatatgaaagaaaagaggctggcatttattagctgtctaccggaaaccaggttgctcttgaaacaccgtctcatttaatcagaaaaatgaccgcttgcagtggatatcatcctctccagtttacaaatctagaaaacaagtacatcaaagcagttaagcattttcgtaggagccgcacactcagtaagctaatattagaactcaggtctgtctgatttcagagctctttccacactacctaaaatattcatgcaccagatgaaagctttcttttttcccctagactgtttcttaaatttgtagttctgctttcaatacagggtttcttgaaatgtgatggtgtgattagacttctggttattactctccaaccatcatttctaagagaattggtgtgtgaggctgaagggatgatagtagggtgagccgtaaatacaggttaactgtcttaatgtggcctgggcaatgtctaattactcagggctgtttttggaagacacttccccattctaggataggggttacaagcacaaatgtccataggagctgggtagttactgtgaataagtgccataggctagcctgtttgggtttggggagctgagtgaggctgtactgggaaacacatgccccaggtagagctgggggttggtgtctttgctccgttaagacgattgcaagatcccagcaagggatcttgaatatttgcaggttctgggttctgtgttgagtgcttaaatggatatcttatttaataataacaggaacccttggaagtgagcacaggtttgattctcactttgcagataaagaaactgaggcccagaaaggtgcccaaggaagcagagttatttaggacctgacagaggtaggattccaacctgggcagtctatcaccagagtccttgtttaatcactaaattttgtacctcttaggactattcaaacccagcaatttgtctctgagaatgatagataaacatgaagatactggagaagtcaattatatatccccctaaaatgccttcagcgtgttcaaaagcaccgagctctccgccatgatgtttgtaagggggtgacgttagatagtgatcaaagaaaagtctaatacatgttattttttgttgtacagttcagttccttgtacataattcatgtgtcaattgatactcatgaaagttggtcttgaaatattgtatacagcccaaattaagagcttggcacccaatccccacttggactacaaatcacttcctcttgccaaattagagtctagagtaatttaccgtaagatgggcttttaaccctaatttctagacatactcagcagtctgctttgaaagctcatcagcttctagaagcagctcatcgttaaggagataccatcagggtaaacacatcagtttagtcttttttgcaacattgctaattccacgttgtaatcaaggagaaataaatggaaaactcttacttagtattagtttatttagacccatttatttccatcagtgaccttgggagatagttggttcagcacattttctcatattcggcctctaattcagtgtgggattttgtgtttttataattaacagagacatttacaaatagaaaaaaatatatttgtgcttttgggaaaagtgccaacaatgtggctatggaatttgattttctaaatggagactacacaaagtgtagattttttatttctaatgtatgtctctgcctatctactgatgatggattttggctttatggcaacccactaccaggcttttagctgtcagaattggacaacgtattgactcctaggtaggaaccgtggaaccactgcgttatcatgataagctggtacaagcagagaggatctattttctaagcagatgtttactaagggactactacactcgaatgacatcacatctttgttagcagttgtggttggtgccatgtttattaaaagacaggaagaccctttggttggctgttaactattgcatatttgtctgtcttgtcaataagcatttttttaaaggttacttttcctttatgtgtttacttggggttaaaattttgggattatgacaaaggccatattttgagattatgacaaaaaataattcaaaaatgaattattgaatgaggaagttgggtctcattcagtaggttaggtctcctttaaaattgtatttttctcgtatgaagacccagttcaatgggtttcatagccagtctgaggcaaaagctggctatttacttccaaaaggacttctcctcaaggaagagaccccctagtgatacccaaatcataaatcagagttcttaacttgggatctatggaacagagatcagggagtgagtcttagaaggcccgttaacctcccagtatgtggaaaaatgcttcagatgttgacacatttcacagaagtgtcatcacattaacaaagggctcataacccataaaagttaagaaccattaattttcaggtaattcttctaaataatgggtcctggccagctctacatgatttggagcatatttacatacatttgcatactgcttgtccttggtcatgccattcaactgccacacacctcattatagaaaagagaaagaacaggatttacctaaagctcaaaggaatagtgatcctgtgctaattaaaatttgttctggtatttgggagtctcagatgagaaatctggagtcatgttgagtttggttattttactcatttgtagtcagtattcaattattttaatttagcttgtgcattttcatgcaccttatttcctttttcctcctttcgactccatttggtacatttcatctcactaaacaaggagaaaaaaagggaataggagttcttgaaactcaaaagcagcattaagttcttgtctgtgacccttattgagcaaagattaggaccagtgtttacaaatttttcaagtactctcaggagctcttgatgcttagactctagaaaatgttgggtttgttcttaagaaacagaaagtgtccaaatcccacttggcttcctaacctctcagactcactctctgccctacagagccttagaaggatggccaccaacacctatgagatttactcctgaatcatttgtctcaagccatttcccactctgctatcagcctgtttctgttaacctggctggtgattccacgaatcattgtcccctttgaagatctatctaacctcctggcttgatgctcctcgagggacctctagcttctgtggattcaaatgctttaaggaaaaatactcagtctaatccacactgtctctagaaccagctagctttgtgcaatcattcaggaacatctctggccctccccacccacacactttccatcaatccagaaatgatcagattcagcccttgctcacagatgtgaagccacaaacggcagctagggtcaagaacagcaaggttactactggatgctgactcaaggcaagaagaggagtcaggcacaaaattctgaaattagtcattgagggaagtacaaagcttaaccgtagacaggaacctggaaatgctgggtcagcctcttcgtctacccgtacatgacatacaaaattattccatgttacttcaatacttttacccagagccttgtaacaatcttcttgaactgttgaatctatacaggtgtagattgggtcaggagatagctttaaaagtttgttgttcacgttcgtgccaactcctggtgtcttagattttgttcccaaacactcattatgacaaaaggatttaagtgcattctatttatttgtgaagtgatgcaggaaactacagtaaggagtgcggatgtgaataagtggaaggcaatacagtgtgtgtgaatggtaatgtcacctccatgggcgggtggggctcagttccgttgaggatctctggaagactacatataggctggctcagagctgtgccccactggggcagctcactgggttatttatctatcatctccctctcattggttggagcctgcttctaaggggcataatattcaggtgctttccacctgccaagagaggaggccaagcatgctccagtggccgcagaaagtcctcagcagaatcccagggtcttctaagaagaagacgtggagatcgtgagaatagtgagtgctcacagtatgtagcggggacaacaacagtgtctcccacaaccagcattacagataaccaggagtcgaccctgatgaagctggtggctttctcagctttacagaatgctcttttctgcttcgcctggcaaaacaggaggatatctgtctcaaagttttcaaagaaaggacattcagtgatctgttgagagattcagaggttctccttttctctggtggtgctctatcagggacagataggtccctaagacttagcagcaaaagggactctccctgcagaagcatgtgcatgatgtgagtaggtgtgcccacagcccagggttcatactctggggcttcatgcccttttcctattctttgtctccaaccgcatcttataagaagtgcatgttaggaaagagtacactaaagacaggaacagttactggattaatataactttaaaggtgagcatactggggaaaagtgaacagcaacccttaccagaatgtttaggtacatttctgcctccctcttcaagctgccaggaaagtgcactgtaagttaccaaggagcaaacttcagcgcttttccaacagtcacaaaggactctctgccaccatctgtgttgcatgtgtgctttacctttgctgtcctccttactttgaaataaatcccacccactacggtgtcccatttcagaaactctaaaatacttacttgaatccctggaatggattcatccaaccctgttcggttttcttccttccagtgtgctattctatagtagaaacagtgccaggccatgggatttagacatcagaggcatttccaggtttataaaaaggcgaagactgtattaaagtatttgcttttaagtttgttggccagttcttctcactgaccctggataggtctaggctactctcagcttacctaccatgtctttgtaagatgtgtagtccatggtgcttgaatagcaccacaaagacgtggagaggtaaaagacataagatgatctcaattttgaataattctccttgaggggcaattatatatttttggaaagttcattcttatttattgggccttctttatctcagaattcaggaaggggcagagtgttttcttcccaagttactgactttcttagcatgcgaggctcaaatgacaatgattatttagaatctctgagcagctcagactcagttttttttgtaatgccagcatataggtcaaatgtgaattccttacaattttttctgaatgggaagtttagggaacgactccaatgttcctgtagtcgctctaagtcgtttaggtgtgctataggatgaaaagaagaataatgaaactgtggtatatgcatgccgtgggatatcattcagtcatacaaaagaagaaagtcctaccatttgtgacaatatggatgaacctgcaggatattatgctaagtgaaataagacagtcacagaaggacagaaactgcaggattccacttatatgaggtatctaaaatagtcagactaatagaagcagagtagaatggtgatttgggggagcagaaaggggaaatttattgctcagtgggtataaagcatcaattatatgggaagaaaaagttctagagatgttttgtacaacttagtgcttttaggtaacaaaactgtaatgtgcacttaaaaatgtgttcagaggctgggcgccatggctgatgcctgtaatcccagcactttgggaggctgaggtgggcagatcacgaggtcaagagatcgagaccagcctgaccaacatggtaaaaccttgtctctactaaaaatataaaaattagctgggcgtggtggtgcgcgcctgtagtcccagctactcaggaggctgaggcaagagaatcgcttgaacccaggaggtggaggttgcagtgagctgagatcacgctactgcactccagcctggtgacagagtgagacttcatctcaaaaaaaaaaatgtgtttagagtttagatctcaggttaggggatcttgctacacacacacacacacacacacacacacacacacacgcacacacatacaaatacaaagaaatacaatgaagcttttagaggtgatggatatatttactaccttgattgtggtgatggtatcacaggtatatgcatatataaaacatatcaaattgtatacatttaacatgtgcagttttattgcacgttaaagatactttaataaagctattaagaaaaagaaataaaaacgtttgctttcatatcctcaggtcatcatggattcggatcctagttctcttgtgtgaacatcttcctcattttccccatatgaaaaatagtggatttaatatatgccttatcacatcagtttgtggattaggagacactgtatgtatgaaacaccacagtcaataattggtaggaatctccttacccttcttcccttggtatgtagcaacttcatgaatgaaaacactttccccaaataggtatctcacagagaagaaaacactatgaattcatgacccatttgcatagttttaggggttaaaagagctgtatataaattgtaaaacatattaagaaatttagagaaataatctaagggttatcaaagaatgttcaaattccctcagattttgtttttcaccttatctaaattcatattttcatccctattttaagcagaattattcatagttatctacttagcagatgttcaaggatgatattctctttgtatccatctttccttatccagaggcgtaaaggaaaagcatgaagataagggacacggcatcgttaagtatcccgggtttgttaacagtagaagagagtgtggacttgcttttcactttcattgtgtgtgtttctaggagatcctctatcttcatgctcagcccccaggtccatgtgtccttctctctaataggactgtgctatgatagctgttggtgggagagaggtcttgcaacctaaaaggaaggagagccatatgcagaagagagaagtgattagatgataaagctgaatggtgactctgaaaaacaaagtaactgtaaatttgtggaacttttggtctttcttctcatttgatgattagaaattttttagctgtccaaatccagtccttgtcttatctcagctatgcagagtggcatggctggttcaagctttcagtgaagaaacagatgtatgaggccaaatcttgcaaaatgccagaagagtgtatttgggcagaataccaaaatgagttcgggggcctatatggaactgcgggcagggccaatgacagatagttgaggactgcaatgagagatgcccaaatataagtatgacaagcaggaatgtcattctgtgagtcagagtcaaagtcaaaaagactttgtaaaaatctactttggagactaggtgtgggtgtctgatttagaacccttctcatagtctggtgatttctaatggtgcttttgccgaaggaattcttaggagcatccaagttccatcttaaagacatggctttgccagtctgttgtgggtgtgctataccatatcagacagagaaataaggatgtgtgtgaaggtatgaatctccggttgacgaactctagtgtgcaaataagacaactgtctgtcttttaacatggtacgcacatttctgttttgatcaccctttctaccagttggtgaaaactttagcaaagtccattcattgtctccataatcccctaggtttctatctaattttcattgagcttacaaggcacatggcaggtgggaggcactctggcatccactgagatgttagtgaacccatctggtcttcatttgtttccttccaagctcaagggtgattgagtttgccagccttctctccactgttttagtcttttcccaaagcatataaggactcttctcttgcttccttgctgaactgggcttggagatgcagctcagagagaagacatgcccttgtcccttcataataaaccatcaacatgtccctttttacatgtctgctatttgtctcctcttctttccagcccagggagtctttatctagataataggtcgagtaacctggaccacagtccattcttccctgtctaccattgaaggtacaaaacgtataccagacacctttaagatttagaatttgaaatacaagaatgtgggttcttacaaaacaaaacttggaattttaaagttaatttttgttattcttgagctctctgttttttgttttgttttgttttgtttttgtaacattatctctctcctgaggcaattaaacagaaaaggagtaatgagcagagtgaaagttaaggaaaggtcttatttaattcctgcccaaactttcagactgcctgatgggaaccccagttgaataatggtgggatttttgttgttgttgttgttgttaagcaaagatgatttccaagctctgcagggcagggagagctggagagttcacatgtttgtatttgaactcacatgaaacaatgaagagtgaaatacagtcctgtttctctagcagtgaaatttcagatccacagagaaacaaggctttcattctaccataaagaaggacaaaacataactgagaaatacagtgtaaaaggaggaatttgcaaagaataatatgctctagcatattccagcaaggagtgatcagatgtgggcatagcagtcatcattggggtgaaatccaagacaactatgggtagcaaaggaagcagctatctttgagaaagtaagactgataaggttttcagtccaaatgacaagtaacttctagtttctaagtataagcttttgcagttgggatcatgcctttttttttttttttcttaagaaaaaacttaaattgcttttactgacaacagacattgccagatttatccacacaaccagtgttccaaatgtcatataaaaatgcaatgcagcaattggccagattgttaagtaacgtgctataattgtttttatttgttttaatccctgtgaacaaacattttattttttgtccaaaagacaaaaaggagttgaaattttatcgttgtttttccaggcaaaagaaaatagggtatttgttgactgaagaaatgagatatttctctttggcagtttgggcggcctaattgataggaagaggtctggtagctgagaatagcagggttagaacaatagaggattccaagatcaaggggaagggtcagaggttcacaattcccaactggagtgggtgagtgggagagaactttacaaaagaaataagagcaaaaccatctgggtaaaaatgacaccatgtcttgatctctgggctaaggacccctggaagtgcaaccatttacactcgctcttgaaaatgcctcattgtgggttcagggataataacccttaagctaaagcctttatgagttggaagaagagaaaatgtgcttcctgtttcttacagaggatgaaagaagcagttaattcccaaatccagcctccaaacaccacaatggagcattttatatgtggaggaaaattgctaaaggttatttacaattagatccataaaaataattactggggacttttaacaaactttatttaggctcttccatacttaagacacaattctcaagaatatcttgggtaattttcaaactgttcttttccttaaaacgatcaaagggaattggttattatccaaggtcaacttattaacgagagacagaatattccccaattacagtatttctccagcgcagttcttactgagctctaggcaaggggcaaaatggggaggagagagtgtagtcagaagtcccagggtcttacttgggtctccagctaactagctcagtgagcctgggcaacacccctgacctgtctgcatatgtttccttgtttgcaaaatgaaatgagaggggataattctaaaaatcctttctttgtgctcttcctaattttttttagaactgctaaatcattgcacgcatgaaatgatttgcttttgttctctttgaaataatggagctcattgtctaggatctccagcttctatttctgtgaagcaagatctaacagcctttgatacctctctgtctactttctagggaattacagatataatttgtggagacacttagtcaaaaattgtcactgaatgccttatgcttttccacaatgctttcagagctgaatccttataggaggcaagtcagagatgaaataagaaggactgacaggaaggagaggtgtaaacagagctcgtgaacacacatgaaaaggcaagtgataggtacacaaggacatcaccaagaagaaggctctttttctgcccttgcagtataaaaatagttatttattttttcataagatgatgttggaaaagtttcaaaggaaaggcttctagtgtttgatgagcacctgctgtgtaacgggcacaggttaggcaattttatacaagataaagatgtttgtacccacttaatggataagaaaattgaggcacaaaggggttaagcagtcttcccaaacttacccagttattcattttaactgctgtgtcatgttcctggtgtgagtctgccaaaaattaattcatttaacctttttactattgtttttcatgattacaagcgtttctgtagtgagcatccttatacctgccctcatgtttacacataagagtatattttttaggtaggtgcaataaactaagcatgtatctgtagatatgtgtatatgtatgggtatatatacacgttatatatatgattgtgaacatgcatatacatatgtatgaatacatatgtgtttgtatatcagtgtatgtatctacatatatgtatttttctaagatcctgccaaattatcattgcaaagtggctctgtaaaatttcactcctccccaacattgaatgaaaatatctgtttcctcatactgtcaccagtgtttcgtgtcaccatattttaaacatttgccaagctattattacattattttttcatgttcatttcttcaatcacaagtgagtttgaccacctctcaagttatttacgtccaaaaaaaaaaaatcactgtaaatgaaaaatgagtagtttagccttgccctgtgctgtgcagaaagccggtgagtttcttcctgaagaggatgctgcagggtcatttgacttggagaggagggagtggtaagatcacattatcattaagaattcgctcagggcatgtaaagatggctgagcagcttctttaagcgtgtaagtgatgacgctcaaatctatcagaatactaaccctgaaatcaggtctgagtttacagccattatatctttctttggatttggttttatgtttttacccttgatttatgtacgtacttcccttagcatcccatatctcaagcaacataaaggtattaaagtgatgggatttagcaaatatgttatggttaccatctttgttcccaagagggaatttggaaatctgacaagtattatacctttcattttcaagacccgttttctgagccgtttcgctaacaagtcccctgatttaccatgccattaacaaaaataattctttctggacagcagtaaaagaagtggattagaacaatttacagccttctcaagatacatataaggtgcctgttaagaaaaaaaaagggacagatttttgattaactgatacgtagacttgcttttaaaacatgtcagttcattctctgtatgcccatctattaagggcaatgtccctcatggaggaagcctgccatcgcccggtgccttagcacgctctcatgtttgccaacagtgattaggaattacttagttgctgacaaccctccatcattgatcgaagtaagaaaccttttctgcttcaaggtaaggacatggtgcctactttctaaatgagatgttatccagagacaacattttgaatctgtaggcaaaaacgtatccagttcaacaaaagaataacctgcaataagcagagatagaatgggtgaggacctaggacagcggctcattaggcagaacccgtcctttctctttgctaaagttagggaggaaacaaatgcctgccgaacagaaggaggagatgagaggatctgtcagccagggagaggtacagctaccagaaaagcactggacagtttcctctaatccttgggaactttaatcgtctcctcaataattctcattttgagaggatctcaaagtggagggatccattagtaagttccactttggcctggaatgagagatgccgaaaatgacaagggtgcttttctgtggtggtgtaagtagcgtggccgtggatgtgggcaattggcttactccagtctgtggcattagttagcatctctgaaaccctgagacatgattctcagcccccatggctggtcaagggattaccagagaagattttcaagtacatgggattggggggtgctcccaacccttcagtcagctgtgggttttgcgtgtgaagagcataagaggggagagagaggaaatgagagaagctggaccatgcagagccttgtaggtgatgggaaggattttgctttcatcctaagaagagtgagaagccattaataggattcggggtgattgtgagtcagggggaaatggggggaggtatcaggacatggaggtctttgcaattattagttggagaacagcaatggttcttagctgcttcgtgtgccctggacccttctctcagtctgctgaagcctgggcagtccatctcagatcctgttcaggtgcatagattaaaatattttaaattacgatataagctacttatgctataccatatttatactatatcattgtggtaataaagaatttgtcatagattaatagacaggcataggtgtcctggaactggttctgtcttaccagcttgtcaaagctgattacgcgaatttctttccaaattcttactcagtgatgccaaattggtagcttgaaatcaagccacggtgagagaatttatatcatagaatatggaaaacattacagatcaggacttttcttctcaaaagtcagctgttaaacattgaccatcatagcactgtgtatatacttatgtatttaataataggctttggtggcaggtttagtaactattgcaattttgaagtagtgatgagtatgaatcccatttcaggatatttcccacaattgaaatgtgatataataacttttttcctataactggtgacaaacacaggttctgctaatactattgtgatttgttatctacattcatagttgaagaacctgcttaattttcgttagagggtaatgaaaataagggtgcatttttccattgaaagagcctctgaactacagtgtccagaaaatgagaaaaaagagggaccatagagaccaactagaaggtgatagcagtattccaaatgagttgccatggtgtcttgtattccagtgaggagatggaaaggtgtatatggaattggaaatggttagtagataaactctatgacaattgggtatgtatagacattggggtgaaggaagtgtcaggagtgacttatagggttatggcttacaccactcaacttaataaggatgagaatgccagaagggcccaggtttagggaagatgaccatgagtttggttagggcctgttgagtttgaagtgccttttgagtatcatggaaatattaaaaagatattgggacacatgcatttggaatagagacatgagtaggttctaccttcagccttggggtgggaccaggttacgaagggatgttattctttgatggatgagcagactacaaaaagctgtgccaccctttgtctctatgtattcacactgcttcccctagcacctcttctttatctcctaacaatcattgtgccaacagactgcctttagaaactggcagatggcccctcttcgaaggatcctgtgcatacagagtaactactttcccagtagctgcatggctatcttgctggatctgcaggtccagaggaggggctgggacagtagaggagcactaggaagtcattaggatatttgcaataattgaagcttgcatcctatttgaaacttccccaaagaaaaaaatgagcgagaagagtggtcagcaggaagccttgaggagttccaaaatcagtggccagcagaggtggaggagcctaaaaatgagactttggagggagcagccacaaagataggagaaaagccaggtgaggtggtggaggtgcagggaagacaagcagagagggtgcttcagtgagaagagaggagaggagtgaaactcaaagtcgcaagagaacactggaagttcttccctgcatctagtgacacggagggtgttaattttacacaggctgtgttggtggaggaaaccagatgggaggggaagaaatggagataacagttatagacacatcttttaagaagtttggcggctaaaaaggagacagatagtgaagtagttggaggtggatgtagagaaaacaaagttttttttttctttcttttttatttcctttccttctcttccttcctttttccttccttccttcctcccttccttcctcccttctttcctcccttctttcctgtaggagatactttctcataaggattcatttgagacagagagggtaggagagaagggatttatgatggcataaagcttctgagaaggtgggaaaggctagacttcaaaacataagagggacctgttaactttttaaacctgggagttgaatcaatgaaaaactgagtcaatgatgtaacacttttaaaggtagttgtttattgccccccatcttagagaagagccttttctggttacagaagacaaagtgatttaatgtgtgctgaagtaagctggaaattcaggtgttcagttgatgtttttggagtagactgtgaaattgaaattggagagacattatccaggcaggaaaactatgagttaagggctctggacaataaaaaaaataagggtgtcatccttggggaaggagatgggagatgctgatgcgtttagggcttcagagctgcacctgtgctcctcttgggatcagaactgcagtatctctgcagctgctgcaccttgtttttaacccctgcatccaagagctgagtgttgcatgactctcaagatgcagatattaaaaccttattgactgatgtagactcttctgtgcatcaaagggctcagaagtggtattagctggctgtctccttttaagtgcagagagtgcttttctgtagatagtgctatgagctacctggggttaagataaaaggcttcaaaaaggtagtgtcttcccggaggctgcttgtggccactcgctgtgtgtctgtggctatacagaccccagattgctggggctggactttgcatgtctctctctattaccttctagagcctgtgaggcccaggcttttaaagattcggcactgaaagaaactaaaaccaaacttttgagtttacaactgcctgaggctgcctccatctacaggacctttactaactgtgccattttggcgaaaagatagattttgaagttcaatcagtcttggtttcaagtattagctattcctcagatgattgtgggaccttgaacaagtctcttgccctctctgagtcagttttatcatccatgcaatagggataatattacctacctcataaaaccattgtcgagacccatctattcagcacatacttgagttcctattcaaataccggctgctgtgcttggctgtggagtctaactgcacaaaatggtcttgaccctgagggttttatagtttgagagtggatataccaaagtgcctggctgtgattattatattgtgatataataataaatacatatttggtctctgcccccagttctaatatttagtctgtgaacccagttcctggcagacagcatctaagagctttgtaatttcctgagtgacgggaacatctgacacagagctccgaaatcccttggtatttcctggctgataggagcatcttttgctctaatgagttgacttgtgctgggctcctggatacccccaggatgggtgctggtttccaggggaatcaaccatgtatttttagaaggttggggctttcatcatccaccccacctccagggaggaaagggaggctgaagactgagttgatcaccaacggtcagtgagatactcaatcgtgcctatgtaacaaagcctccatgataaccccaaaggacaggggttaaagggcttccaggttgctgaacccatggaggtttctggagggtggtgtgcccacagagggcatggaagctctgcatacctttccacatacctttccctatgcatctcttggtgtgactgttcatctatactctttgtaatattctttataataaatgcgtaaatataagtaaagtgttttcctgagcacttctgtgagtcactgtagcaaattaatagaagtcaaagagggggttgtgggaactccaatttatagtgggtcagtcagaagcacaggccacaacctgggccttgtgactggcatctgaagtaggggacagtcttggaggacctgtgggatgtggctttatctccaggtagatattactgaattgaattgaatcagaggattacccgctggtgtccactgaagaatggcttgatgtattggggaaaaacccactcatacttggtgtcaaaactgttgagtggtgtgtgacagtaggtaaaacattttgtttttttttctatccttcatattggcccagagagcttatttaataaatatctcattcatttcttttttcttatccattataccgtaggctcagctgaaaacatcgttcatgacccacctgaatgcacagtagggtacttagaaagtactgcatggttagcagacagctctgtagggagtcggaacagccacgcagtagagtcttggaagcagaagagagtaaggcacagagaccccgaatgagggccgagtgtggacatccacatcacagctccacccatgactagtcacaggaacagagacagtcgacttgcctctcactctctgcctcagtttcctcacctgcatgatggagacgataatggtacacaattctaaggtggttgtgaggattacacgagctggtggtgttgcgattctgaggtggttgtgaggattacacgagctggtagtgtgtgtcaggtgctcagaacaatgcgtggaacatggaaaacactccctacatgggagatattatttccatgttcagaaacaagctggtttcattaaagcccactgctctcaaaaggcaattcccatgggaatagtgatgacttgaaattctgtatcaaaatgctggtggatgctgcttcgtttgtagtttcttttcttttccagtctccacagggctctgttatttggatcctctaccatgaagaacagtgcccctaatcgtagactatcactttgttggccactgtgtgttgtccacccattatactgtgaggtctcaacagctttaatttcaataatttgaggtttgttcaatgcattatattccagatagttcacggatgcttttaatttaattataggcactttaacaccacagatgactgttggggaaacggaaaatgtcattctttctgaatgcaagacacgtgtttaggactgataaaatacataactgtgttttatttcagaataaaaagaaatgtattaccaagtatgtgacagtaggtagactgctgggaagcctgggtctgatacattgttgtcagaaacaggctcaattttggtgaagcgaagggtgtacggaggatgagccttgcaaacaagctaaggtgcccaaaggacagctcccccagtgacctcagggtcagcctctctcttacgtacatacaaggagcccctcctggaagcaaaccccactgcagccttccaacaggcacatccttgttcttcccactatcttattatttgtagcagcaattattcattgccatctgaattcactcagtaaatatttattgagtaccctgtatgtgtaggtagtggtgatacagcagtggacacacagacaaaaatccctactctgaaggagcttatattccggggggaaaaagagaggaaaataagtaaaatgtgtgctggttttgtgcatgaagatggcaaaggctatggagaaatcaaggaggatagagttggggaggaacagttgtaacttccatagtgtgggtggagaaggcctcactgaggcatcaacatttgagctaagtcttgaaagaggcaaaggaatgaaagaggtgccaggccaaggtaatagttcctataaaaatcctgagaatggagagtgcctggtgtgtctgaggaagcccaaggaggtcatcatggagtgagggggagataatagaagatgaacttcaaaaacgaagatgtgaaaaattgcattgatccttgtagtccatttggaagggtttagatgttttatcatcaccgtcgtcaccatcatcactaccacctgctagaaacttcggggggcggggggtgggggggaatgactcatcatctcatctctgcactcctgaagctccaactcagcacaggatacaacgaaaggataatgtgatgcttggtaccaagactttaaggacattcaggagcggacagaaaacatgacctaaaagagagggaaaaacagagactttttacagggtctcccttaggaaagggagctatcccttaggaggagatatctaagccactatgcagttgtgaggtctttagaaatcaaccaagtgcattggtcagattgaggctaagttttccaacacagagaaccctgaagtcccattctgtactttgtcttgactctcctttcatttctctttatcactcttcgccccccactgcaggtacctgttcctttttctgaccatgtctctggacttggagaaggttttctctcataagcttctatccagccctacacccagtggccatacaggtccacccctctgtatggctctgtgcattaatgagcagctcttcttagctcagcgtgctcactgtctttaggaatggtttctgctgaatccattgactgcacaataagcccagtggaatgtgtactctaggccccagttacctccaaggagaagggatgataaatataacagtgacaaaatactctcatacacacagaaatatatagttacacttaaatgcacacacatatatacatacaaatatagagtgggtgcagtggctcacacctgtaactccagcactttgggaggccgaggtgggtggatcacctgaggtcaggagttcaagaccagcctggccaaaatgatgaaaccctgtctttgctaaaaatacaaaaaaacagccaggtgtggtggtgcacacctgtagtcccagctactcaggaggctgaggtgggagaatcacttgaactcaggaggcagaggttgctgtaagccacagtcacaccactgcacttcagcctgggccacagagtgagactccatctcaaaaaatcaaatgaaaaaccacatatagttatatataaaagcatgcacgcatgcatgaatatacctatacatatacatctatgtttacatacaaatgcatgcatacatgcacatatgcacacacctataattataaatgcatgtatatatatatatgtatgtatacacacatacatttttatagaaatgcataggtatacacatgtatagagttgtagatgtatgcacatatttgcatgcatacatacatgactatacgcacaatgcacacatgtttatatatgaatgtattcactcatacatgtatggttgtgtgtgtgtgtgtgtgtgtgtgttttgggaagactaattactccaggagatttacatgtagtttcccttcttaagtagatcacaaccctgctctgcatttgctgccattgtttctgttacgtagatgaggaatttgagtctctaaaacttgaagttgcccggccaaggtcacgtagctagtaagttgtgaagctgatattcaaactaaggactaaaagataaaaaagaccactttcttccaatgcttaaaagatgttaacagaaagagagcaaagcaacaacaagaaagaaggaaccctaagtatgttcatcgagctactcacagaaaacagaaaatatgattacaacataaagtgataatttccataaaagaaaaagttacatgagcacatacaagagggaataacatttgaggaatctcttgaaggatgggtaggagttttttagaaaggggtggggaagcaaaaagattttgcttttcatttaaagttatgatagccaacatttaccttttagaggtgctcaaaaggcccactgtacctttggcttcatagctgtagaaatcgggcattttccaaaaaaaaggcagtgacggtgcctcacatctggccacaggcatctctcggcagcatgcaggtcatctagggcaagtctctgtaaaggcctttctctctggtgttgcatttgcgtattcatatgtctgcatacaaacaccaagtctgctgttagtggtgtcataactttgcaaaaggaagaaaacatggctaacggtaaaatgagttatgcctttataaaacattttcaatgacagaacttgctcccctctgagtgctttttgaggatcagtaatcataaactgtggctttgccaggaggtgctgtcgaagattgtgtggacattctttcagcaaaatcatctggcatgtgtgattgcttctatttattcaatactaaagaacagaagattgagttttatgagagagagaaaaatgcacattccacatagagattggataaatttcattgtttagagtgtttttattgccacaaagtaatcttctgattgctaggtgagtaatcctgtagttacaaaaacaatcaattaattgatctaaattaatcggataacatattttagcctgctaagcatgaaggcatatttcaagtaactttccagataaaggaggtattgaaccttttcagccaccagccagggacagtgacacagattctagtatcaaatgctgattctcaaattaacaaatgctggaattactatgagaaaggcatggactagggagtcatgaagtcctcccccttttgttatacaggaagcttctaagctgcctgtcccactgttcctccagctcttttgtcccaggcttggccctactgggaaggagacttccctaacttctgggctacccctccctttccctacctctagccacactgtgtttcagggagggcaacatgggagacagaggaaattaagacacctgcatgaaagttgacagagttacccaagaggagatgccactgggcagggactggagagcactcaagggaagggaggcaagtccgtcctttctcctcctttcttcttcaaaatgtattgaatgcctatgcttttccaggcagtttttaggcacttggaatacatcaatgaataaatacggcaaagatccctatgcttgtagaactgacattctagcagaagagacaactaatatataaataagtcacatagtattttagaaggtgatatatgcaatgggaatagaaaaagcagagccgaatgagggctagatggatgctgggatcctaggtggagcaactggctactgttaaaatttatctgagaagtggttccgagagacagcggcagcagtagaggagaacacagcagtcagacgagccaggagggttcctggctgttccctgcacatgtcattaatgtgaacactcaccagcatctcttagctccttcatctttaaaacagggataaggatatctgcaatgtggggaagtgggaatgattaaatatcattgatttgtttttactgctcctctttaaaatgacagcatcaccacaaaggagatgaaatagtcaatagtgaatggaaagcaccaagcacagagactggcacacaatgggtactgagtacacgtttacgttggtactcataaaagaccaggaagagcttatatgtggtgccctggtaatgcctcagatactgttctaaatgcttcatggatattagcacatttaatccttacaaccctttggggtaggaactaatttatgtccattttacaggtaatgaaactgaggcacagagaatttaagtaacctccccacagttttataattggttagtggtggaggcaggatttgaacacaggcatcctgcttctggaactgcactgcagttatttttagagcccaggctatggaaagaaaccattcatttattcacggaacacatttttattgattatctgctacatgacaggtctgtgatcagcactaaggctatagaaatgaaagacatagacagggttcctcccccaaaacattcttgatgtaaatgtgagactcacactataaccaccctaaggattttggtctgaaaagacattctttattaaggattatacatttatgtcctggatttcctagatctggccctgaaggtaaatattccattttcttattggagtataacaaccaacgtttgactgcaaaaaatgtggtagattattttcattcatatgaatatgcctgcccttttctctggtggagtctggcccggtaagtctgtgggacctgcctctaccaatgaggggtagagcttggtgacttttaacaatgatctcctcattagatgaggccatcagttacagcggaaatgatcattattggaaagctggagaccagctgctgtcagagagggatgggctcctgtggaagcttgcaaactgatgactacttaatccttgaacttcagcagcaacaacattagctgaaggtctgtaatgcattcacagttctcatctgacattttccccacatcattatttttctggttttacttttaaattccctataggaccattgacatgaaattctgagggggaatttggaacattaatgactgtttaaggcaaatgagtaagtgttctttccaagaggaaattgtctttataatattggcataaggctatttttaaaatttatactaatgagacgattcgaggcagataactgaatttcccaggcttgaagttggcctatgccccttggtgaattcagccttagggtgagctctgtggggccttgcaagtctggctctagatgcaagagatctgccctatccacattccttctttccataattggttagagccttgaccattcaaacctgggcttggatgttgggcttacaagtggcacagacagtcatggagcttgctgactacaagggaagaaagactttatcaaataacactacttatggatgtctcaactacaaacatgaatcaatgacttgaaagaaggagagtaatattccctgaccttaaacaataaaggactatgaccctgtttggggactggggatggtcattgagggctcccctaaaaataaatacttgctctgaacctcaaatgaagtgtaggatttagaaaggcaaggggccaggtgaaagaaaatggtttcaggaggagggaagaacaagggcttgaaggaatgtatggtccccttggaccatctatgcttcctaatcctggggattgcacctccagtgatataagaatgtgtggcaaagggaaccaggttcctcactgactttgttcccatccatagaaccaaaagggtcttccttagtaatgcctatggctattgggtattgagttcttactacaggatagaccctgctccaaggactttgtgtgaattaacttatttgacctcgacagacatttgcctcaccccactgaaacaagtgacattaacagcaatcaaaagattacccggggacacaaggctatgtaatacagcaatatatgcaatataaaaaaataaataaaacttgaatgcttccaaatgtctatcaaaagaacacaggttgaataaacaatggaatgtctacacaaatgagtactgtggagctctaaaagggaatgaggaatagggctataggctatttgggataatgttcggatatatttttaaggtagaaaaagtaagatggagaaaattgtgtgttatattactgcctgtctttgaggggatgcacattcacatacaaatttacttttttaaaaaataaaagttaggttaaatcatttttttaaaaaaatagttactgttccagttatcttttttctttgtataaacagggtctcattctgtcactcaggctggagtgcagtggtgcgatcaaagctcactgtagccttcaccttctgctcaagagatcctcctgccttagccttctgaatagctgagactacaggtgtgcaccgccacacctggctaatttttaatttttctgtagaaattgggtctccctgtgttacccaggttagtcttgaacttctgggctcaagccatcctcccaccttggcctcccaaagtgctgagattataggcataagccaccatgcccagtctatctacttattttgaagcaaattagtgccttaaaatgtcaacaccattttattatcgtctctcacagtgtagggattgtctgggctccgctaggtggatctcagggtttctgatgggcttgcagtcagtggccgaggctggagtcatctggaagtgcgctcgctcatagacctgggtgtggaacagagagacaaacctctgagggttgaggctggaactgctaaggctgccttgacatctctctatggtctctgcagcaccaaggcttacaggtagctgtatgttttacaagttggcctgaggctccaaagatgcctattccaagagagaggctggacaagctgtactaccttttatgacttagtgtcagaaggcacacagtgtcacctttgccacatttctttttttcttggcagataataaggcccacccaggttcaagaaaagtggggcagcaggggaaggggatggactttacctcctagtgagaagatgataaggtctggaagaggaggtatggcaaaaaatattgctgtggccgttactagaatatataatctgacgcagttacctaaagtgaaaagcgtgaaataaaggctgaagagatagggaaaaaaagtacatttaaaaaaaaagttgtttcatgaatttgaaaacaaaatgaaataaaaagcctattctaaaattcaaaagtcagagaaacaattgaacctaagtgtgtactcaagatgctggcataaccacttgataggaactacccctagttattttaaaacgcagttatttgactctgtccattaaagacaattgaaaaccaaaaaccaaaacaactgcaaagggaaatcttaaagtattttcaataatactgcttttggaggtagtgttggtatatttattgttatataaaatatagtataatattgtgtgtattgaaagataaatgtatatgttaatttggagaactagaatattgaagtatgggaggaagaagatgcagatataagaccagcgagattaatttaaaatgctagagaattggaagtgggattatacatatgaatttattaggtgttttatcttagaaattcatgtattctctttctactaaaaagccctagaaacagtgaccaacccaatagcaataaacttccttagcaaatagattatggtcactagtgatcattttctagcaaaagaaaccaagctgtcttgagaaaatgattgagtttatatttgaggcaggaaataaacaagaagaatctgtaaaatcttgtcataccaagaagcagagaggctatgagatgtcattagggtcatgtcatttaaagaagccagtatgagtagctcaaagatgagataatttgagcctcaaaacaaaataagtgatttcaatggatttaaatacactaaatctgtttaaatacataagttcataatgataggggaaaacaaaattatttataggttaccttacaaagatgatagaaaccatctcattattttagaaacggaaaggaaaaaaaaacataaacaactatcctgcctttgttttcagaattccttgtagaaataattaactagtggatgaagagagtttctctttctaggtaataagcaacgaaaaaatggcagaattagaatataatgaatttgcagttcttactaaattaatatatctaggcagtaaccatcaataaaaagaaagaccatatgacatttgtatgtcctgaagtaagttcacaacgccatctagtcttgagccaaaaatactgcacctgaatctgatccagcctccaggatgtatctatttataggaaacacagtggacaggcgaacatgttaaatgacaccacagagatgcaatctgcgaacttccactgtggaaacaatccaaatgattcaacacgatgttgcaaagacaaaagaattatacatgaacaggaggctggatgaattaaaaaacataagagatgtatcaatcataatctttggttctaatttggattctgatttaaaaatagactgcaaaaaaatttgttagaataatatgaacaaagactagatgtttgctgccatttagaaattctcattagtatttgttcagttatgataatgcatgctgcttctgttaaaaaaatacttttaatcttttacagataccttctaaatatttatagatgaaatcatatgatatctagaattttctttaagacaatctgtggaaggggtgagtggatgtgtgctcaggtgagctaatggtagccatgagtttaatattgaggttgagcgatggatacagagaagttcatcatacgaatctctccactttgatgttttcttgaactctccaatactaaaaatttagccaaaaaaattaacaggggcaacgaactttcttctttttccaagggctttttatcgatgattttaagaaaatggtcagacagcgcaggcgtgttttaccttagtccttccaaagcagtaaggtgcacccacttctcagccaccctccctgactttgttttcacaacccgaattcaccaggaaaataccaggagtctgctttgtattgtgccatcttttaaataatgcctcactttctagtagcaaagtacctcattctttttcttgatacttcaaaaaaacaaaatgaaacaagaacttctcattagctgaaagtgtttttatctagtgagaactgaaatcttcttggcttatttcctcttagatctaaacaatattaacttttttttttttttttttcccaaacagagtctccctctgttgccccggctggagtgactgcagtggcacgatcttggctcactgcaacctccacctcctgggttcagggaattctcctgcctcagcctcccaaatagctgggattacaagcatgcaccaccatgcccggctaattttttgtgttattagtagagatggggtttcaccatgttggccaggatggtctcaatttcctgagctcaggtgatccacctgcctcagcctcccacagtgcgaggattacaggcgcaagccactgtgcccagccttaacaatttttttttgtttgtttttgaggcaaactctgactctgacaccaggctggagtgcagtggtgcgatcttggctcactgcaacctctgcctcctgggttcaagtgattcccctgcctcaccctcccaagtagctgggactacacacgcaccccaccacaccgagctaattttttgtatttttttagtagagtcggggtttcaccatgttggccaggatggtcttgatctcctgacctcatgatctgcccacctcagcctcccaaagtgctggaattacaggcttgagccaccgcgtctggcccaacaaatatttttaagatgcattgtctactaacaggagatgcctctgattctgaagtactttgcgataaacagccacacaatagccaaatgaaatcttgaaatcagagggttgctttctcatgaagttagactgcttgagaattgcagtggcttctatatggcaggtgcttaaattgtccaagttgaaattctaatttttataatgagtagggatgagtgcatgaaatggttgtgtgtttttttatttcctacatacaatatcgaattcaatcccaaacttgaagcattgatgtaattgaaacatgttggtaattttaaatcgtgcagttctgtacatgatcagaatcctaatcattattaaaataggtgtttctattatatgcatatgtataaaaagtcctccaaaatgttaaattacctttctcatctcaggaatagagtcccaatcacttccagattgaagcacttacggggggaaaaggcgaagggctccagtaattttaaattgcttcgtacaatgaagagtgcctgtaaattactgaatgtggtaatttgttccataagcttttttgatttgtaagtaacttagtggatttgctggtgaaacagtttggcaggttcctcagataatttagagatattgagcatagacatctaaatgtgattaaaatgtggtattagcagacattgaccacaggaagggtgaggcaggttttcaagttacagcagctagagaagctgagaaagactacagtcgactctcaggggacttgggaaaggtactaagaatgcacaattgagctaattacaggaaaatgccacacggctggctttggaagaattcatccagcccctggcatgttttgcttatcctctgcctgatgataaaataggggttatttctatcagtggacacatttggcccatatcttaattcaggcaacacagccttagccttgttctgctagtgctaattatttttttgaaaaataatactgttaatatagtaaaatgtagttgttggactcttagaaatggataaagtttaggtttgtaatttcccagacagagagagagtggcataagcatcgtgtgaattcccttctaataggatgtcttcatctttactattttgcataataatgtattgtttggccataagagggatttaggtactggatctagaggcattgggtgtctttaaggtatgaaggggtcaagcaaatgtctgccactcacagagtgagggaggtggagccagaggttctgaacaaagaacctcaccaaatgatggggagaggctgtgatgcatttcatgaggcagtgatgatgtgagtcttgggctctgtaagtgagggtgcatagaagagtaggtcccgccctttttaggagtatactgtggactagagtcaatctgtagacaaagctaggctaacttcctactgggcaacgtctgacccctttcatctttgacctcaagaaagtcactattgttggtaaagtgaggaaggacatggaacctctggggagaatctgacctaaaatggcttcataaagattctcagcatgaatgcccttttttacttgatgaaaatagacctgatagtggttgggttatttgagcagaacaataatggtaaagggaaaatagtagtgagatttatggtgtaggatggtcagatgtggtatgagtatgacacggagccagaagtgcctggtcattcactgatttgtcacactaatggagttagaatactctaccttgcaaggcagagtaggagtagagtatccagtcatcctggtttgcccaattctgtcccacttttgacacagagagtctcacactccgggaaacctctcagttctagacaaacagagacagttggtcatcctattatgagaggttagagaggaagcactttctggatgggttgagtctgataggctctgttgtatttgattagacagctttctatgagatcaaggttttcaataccatcacagaaccatttctggagctgtgttgaggaagagagggcaagggttagagaaaagcttgggccgcagcattgcctctgccatgaagactctttacgtctgtttcacacacagtcagcccttcgtatccacaggctccacatctgcggattcaatgaactatggatcaaaagtatcctctggccgagtgtggtggctcacgcctgtaatcccaagactttgggaggccaaggcaaacagatgacttgaggccaggagttcaatactagcctggccaacatagtgaaaccccaattcactaaaaatagaaacctcagctaggagtgttggcgggcacctgtaatcccacctaatcccagctactcaggtggctgaggcatgagaattgcttgatcccgggaggcagaggttgcagtgagatcacaccactgcactccagcctgggcaacagaatgagggcctgtctaaaataaaaataaaaatagatgtgtttgtgtgtgtgtgtgtgtgtatatatatatatgtatacacaaacatatatatatacatatatacacacacacattcaaagaaaaaataatacaaataaaaatacagtacaactattttcatagcatttacattctattaggtattatataagtaatctagaaataatttaaagtatacaggaggatatgtatagattatatgcgaatactatgccattttacatagggtattttggtatttgagaaaaatcctggaatcagtccctcacagataccaagggacaattgtgctaaccttttagataaagtttcatagaccagagacttccacagtgaacacaagattagataccttaggctagagcgatgggttttagaaaaaaggtggacacatggaattcatggatatgaaacaatacattgtccagaagtaagggtggtccatggagactggttggagtggggtgggagaaccttttcttcatcagagtcaagtcattctgggttggcaatatatatacatgagtggactggagagactgaggaggcacaagtcgaggaggaacacatcttttattttgacttaattttctttttatcccctctccttctaccccagggttcttctccgtgtggatcacattaagggagcgtataacctttcataccgcctgactaggatgatggatgtggaaatacacagtttgggagccctgtctgcttgcctgttaagccattgactgttatatactcttgggcttgaaacaccttccaggctggaggggccagtattgcatttacttttatcccatttctgttttcacggctacccaagaggaaataatttgatttggggctgcagggggtagggtggaaaagtgcagtcggaagacagagaaaatcagcaagaagattactgaaagggaaagagggggaaaccaaccagctatatatttcctgcaacatgagttaatgaaattccgttccttcttacacagctgtattcggtttgttttacattgtttggtatgtgaaaggatttggctttgcgttacagaactaattgcttactagatattacatggatatcaaaatactttataaatattaattaatcttcacctaattccctggcaagcacaaataaccagtggcatatttattgaatgtgtaagcaataatctgattcttaaagatttgttttctctgctgaagctttctcatcatttccatttgtcaaaatgcctcatctcctttgaggaccatatcagatggtacttccataacaattgttaggaaaatagtaataaagacgatgtttagagtaaccaacattattatttgctgaactttcttcctttgccaagctcttgagtaaacatttcatagatatatctcatttaatcctacagcagtcctacaataaaaatgttattgttactacttttttttcccccagatgagggagcaaagtttttgaaagctgaatggtggcagggctgggatccatagcccattctgtccacgtgtgaaacttataataaaagccactatcttgccccttttctgattcacactacagggaggacacttggtacttatcaataactccattcatttatctattcaaaaatatgtgtttgaatgcaagtactattagaggtactgtgctaggctctgttatgacatacctggtgttgactcttgagtagggattacagagttgagcatcttttctctcctgagattcatcatggtccccatgggcagtgaacagtgttgttgtcacactatgaaatgggtatagtgcctggcacaatgaccatttcttgaacaaatggggagtgatacagtgaaagtaaaaagaggatctacagtgtcgtttgcttgtgaatggtgaggggtgggagcgcttagaagatgtaaggatgtgctctcttctttcctcacactcatcttatttgtaatgacattaatttgtgttcttacctgctcagtgtcttctcagtttgacatgccatgatggcatggactatgtctgtttcttctagcgcttcatagctgtattgacacatgtttgttgaatagaccaataccttgttttatgcataaaagaaggccagtaaaaatagtcttacatgcatattaccatgaccgtgaaaataatcccaccctgggcatagcctggctcttgtttgaaatgtgtggtacttctatgtgacaagatatagaataagtcattggaagaaaaactgtcctattactatattttatataaaagtgtatcttgtgttataatgggcctggtatacagagggtgcttagcaaatcttccgcagagctgaaactgagctgaagctacggcccccttctctgcttgctctcctttattctctagagtgctgcttcccaatgcgtggtccatggaccaagcagcttcagcatcacctgagcacttgtcagaaatgcagcacctaggcgccgcaccagacctgttgaataggaatctacattttcacaagattccagatgatttgcatacacagtggcatttgagaagcattaatccaggggcttctttgcagtcagtgatggtgatttgccaatcattagcatttcagaaaccccaggccgaaaccatacatttatccttagctaggtcggtatcaagtttctctgctttcatccagaatcctaacaattcagcttggttgattatctaagaagcttctatttgataattatatatctttcattttttttaaagtgctgggggttgggagatcctgggaaatggcataactattgcttaataaatgcagtttgcttggaagaccaaaatctttcaagtaatgagaagcagcaaaggaaacaactccaacaatgacacaaagatttcctgacaataaaggggctgaggtgaggaccccagctgtggaccacactacccgaagagaaccaacaaccaaatcaatatccaaaaaataacaataacgtccaggtcatttcacttatgagacagaagaggtaaaacaaattctcagatacaaatatttctgctgctccacattgttccatggggccaggattgtgaagtcaatcttcctaatgattaatggaatttctcaccttttgttcaaatgacttggcccctttggtttttaaatgacatctaagggcaaaacagacccaagactttgtggaatgactttccaggaaacaaccatatctaggtaaacccatgctcacaggttccctctgttaatggtgaaattacatcaaggatgaccttttgaaagaataaaactcattatcacatggaatatgatagctgtaaaagagcaacgcttggaagccaaagcaaagtcccgcatatgataaattaattagaatagaagttacataaaacctcgaccttctgtgtgacccttatcttataattacctcttctttaaaagcagaatgaaatattttatgtatgaagatgttactgttgaccctaaatgcattaagagtcaaggagacatttttcacgtattgaaaataagatttgattgagtgcttgcaagtggcctagtgaaatctcattaaaccactgtttaatactttataaatggcagaatattaaccattaattatgaacatgaaaccagtttgaaaataagttttgcaatatctaagcttgattttcaacccttattaatgcattgtctttttcatagttttcagtgttttacagcaagtaggtacttacgacttaggtgtgacttttcatctcttcttcctcctcctccttctctccttcctccttctcatcctccttattgtgttgctctaccaacatggttgtaaaaatctggatgaaaataagaaaatacagtctattaaacatagttataggctgtcactatccacagttataattagatttataaatcatgtgcaagattcccagcaaaaaaaaaaaaatgaatcttaaacattcttttcaactattatcaccccaaaatgaaacaaaacaaaatatagcaacgatatgaaattgtttcagtaacattgccatgttacagtaagcttttgcatctggatcagtcagcctggtacaaataactgtatattctgaaatgtaaatagataaaaagataatgaccttcttgagcatctactgggtgacaatcgttgaaatagtatctgaatttaactgcaccaaggaacataggcagattttgattcagatgacagcttccattatttggcagcagatgcttaagaggctgctttgggaggattctgatgttggatccagcctacatcatagaactgcagccatggattagcaatatgtgttatgtgagtgagctgcaaaaatatgccacaaaattcccatcttacagttatacctttttaccctgaaatgagtcagtgtgttatggtaacattcccagatggcagacagaaggagagccaatgtgagagaccagtgaactcagacccgtctcccaagagccttgtgtaagtcatctaaaaaacaaatgtttcggatattcagggttttctgatttcaaatgtgttcataccatgaataattgtgtagcactatcttactgtgtgctgaggacattaatgtgcttcttctttcatccttcgaatgatcctgcaaaataattctcactgacattttcgtggaggtatccaacttcagctcttatggaaaagaaagtgcctctgtggaagttgcatagatagtaaattgtggcgtggggactcaaagccaggtttgcttgacttcacagtctaaattcaacccaggaacccaacagcctgttgctgtgtgattctgatccccatgaattcactatgttgtcaaatgctgagtttgcaaagcatggtctgagtgcttcccttctggacctcccttaaccattccagggctttccattgcttgtgcagttaatgaagatggaaaatgattcccttccctcccgctctgttcttccatctgtccaggtaatagcctaatgtcaacctagtgacttcatggcatctgttttcaatctactgcctccttgtctggaattctcaggggacacttaagccagaactggggttgaaggaagccctggctctgtgcaagtccacagtacagcagctactggggagggaaaacggtgtgtggctacgctgagggtttcttcctggttgatgcgattataatgtgaaaagatcgacatgtgagcccagagcagatgcataataatgctactgcattttgtatttaacaaaacccctttctcgagaaatgtattacttaccttgtgggtggggaattgtctctgaacccaatcaggttagtcactggcccatgactatctcatttttaataaataataattttctcaattcagcgctagccagctcatctgctttcaaaagataagatatgattgctttgtattttttatattaataaccctcagcatgagaggattaactcttgatgcactaaaggcaaactaccggaccctgggagatccatttcttctcaccagataggctgacacatctttcagatgaatttaaaggtcaacgccttgtgcatgaaaagcaggggcctgcattagatggctgagctctagtcaattcttggtcatttgtactgaaacagaggcaagagagagatttcaaaaccaccacgaggaggcccctaaacatgcaggcatttctttcctttatctgtcgattcaaagagcatctattcagggccaagaaggagatcaggtttatctgacttagtcatacagccataagaaagtttccccctctaaaaaaaagaaaagagaaaaaataaagaggtgccttccattggtgaagcgtagtcattcagaacacaagctttgcagccacccacagcccacagcccacagcccacagccactgtgggtcgagttatactttgcctcttagcagctgaccagctttgggtctgagcctgtttcttcacagtggtcagcccccttgtctgcctgataaatgtctgtctgctcacgcacttggctccgcagaagtgagcttgctgggtccatggggatattcactggagattttgcacaatattatgctctggaaaggggtctgcaaactctgatctgagggccaaatccagcctgccacttgtgtgtggacaactagcaagctaaaatggtttttacatttttaagtggttgcatcttaaatgcttatataatggctacataaaatccttaattttgcctcttggcccacaaaacctaacatatttactactggctctttaagaaaatgtttgctcaggcctgctctggagtcctcaaagccacatatataattttaaattttctgatagctctgctaaaagaagtaaaaagaaacaggtgacgttaattgtagtgtgttttctttaacccaatatattcaagtagtatccctgcaacgtgtaggtaatatagaaattgcgaatgaaatattttacattcttttttcataccacgtctttaaaatccagtgtgcattttgcacttaacagcacctcttaatttggactcaccacatttcaggggtttaacaggcacatgtgaccggtggctgccgcattggacagtggcagctctagagagctggaaccaatttatgctccttctgacattcacagggaatgctccgtataaatcttggtctcttcttcctttttaaggtcacatagcacctggatttaaactccaaagctaccccaattttagctggagggaccatattccaagctgcaaatattgtacccacccagcaaatttcctgggatgtgcttcctggggaaagtgaattcagttgctgtagcccttgatttgataaaatgctcctctttctggccttacccttgctcaatcatttccaattccgctgctggttatttaacacgccaggggcagtaggtgcatacagtcctatgctcccagcttatgaggaaatgctctgtccctccacaggcttgatcagcggcctccctgctcctgttctctagatagaagtttccctagttttgctggtctcaactcatgcacaggaggaagccagaagtgccctgctgtgatgatcaatccatatgcatgtttgcctccagcaaaccaaggacatttaattcttggccagagtctcatcagctccatcagtctatgacaataaaatgaatgtatgtcttgatcacaccaggaagtctctgctaccaacacccccaggagaaaacagctccaggctcttgaggctcctcaagtagcaaagtctcatcgctcaggtctcgcatgtcagaatttgccatgattcactcacagcatgtgtcatgtgtatctggtagaatgtctgaaatgcattcttcccatatggcttttcagggccctaagtgtgaatatgaactttgcatgtgaaagatgcttcattttgcattttgtttgcttgtttttgtttttttgagatggagtttcactcttgttgcccagactggagtgcattggcgcccaggctggagtgcagtggcgcgatctcggctcactgcaacctccacctcctgggttcaagcgattctcctcccttagcttcccaagtagctgggattacaggtgcccaccaccacgcccagttatttttctgtatttttagtagagactgggtttcgccatgttaagcaggctggtcttgaactcctgacctcaggtgatccacccgccttggcctcccaaagtgctaggattacaggcatgagccgctgtgcctggccaagacgtaattattaaaattaacaatgttcatctcagtatactgcctaaaattacgtgatatgccaaagtgggtgtatgtatcccactttgaggaatactgatgagaaaggatgttaggcctacagagatcttcatcttcagaagagcacagataagttctggtataatggaaatgacagcgtcttggcattttttactgctgccttcaaacagcagacatcacagcccacgatgatgagcctgctgatgccgacttcctgcattctgtggtacacctgggctcagcttagaaaggctctaccccaactcatacttcttcatggcaagatgaggtgaattcatttctacccatagtcattctaatctgcattttcataacccacctttccattctccaagtgtgactttcatttttaggacagagttattcagtcggtgaatatgcagtccctttaaagggatatttatcacccttgaagaatcttattgccaaatcttaatagtctttcttataacaaaggctcaaattcactatcaagattaagaggtggagcttgaatgagctttgctggagcatctcatgataaaatagattaaagtcttaaaatgggcaacccatcgaggtggaagtcaaacaaatatgcaaaagcgtccctgtattttcctcaggcagtttgggcactgtgggtgagcccagagggtgaatggtgggaagtgggagttaggccacgtggattttccctcaggctcagcggggtgacctcccatgagaagctgaaactatcttaattactttgtctgtaaaatagtggtggtgagcatggggagagcttgcctacctcagaggcttgtggtgaggattacggggaaaagtccatgtaaagtgctcccccctggtttctggcacagaacaaatgaatgaaattcagatccatcatttatgtcagaggtccccaagaccacccccaggttccttgatccccaagtcctaggaagtcctagagtccccaaggccacccccagtttccttgatccccaaggaggactcatggttaagatttattacggtgaaaatatacaaaatgaaatcagcaaagggcaaaggcctgtgagcgaagtccggaggaaatcagttacaagatttccacaatcccctcccaatgcagtcacacaggatgtgcttaactcccccaagcaacatatggtgacaccgtgtgtgaaatggtttctacgagggaagctcactggaggctcagtgcccgagtttttactgggagctcatcgagctggtcacgtagacagcctctgcctgatacatagcaacattcctgactcccggaagaaaagcaagagttcagcataaaccgaatagttcatacaaacatgaggcacttggagccactcttaccagttatgggcatgggaatactctccaaacccaagttcccagatgccagccaagggccagcctttcaggcaggcctttccaacattgcagtctgcaatctgcttcgtaactcttttctgcccaggactagaggtcataaggcccctactaactctctggcttcatccccagtactacctgttaaccaacctgacattcctcccatcaccccgcagatcctggccccaaagccttaccttggtgctagcagctgcctctgttttgaaagctcttcccctgagttctccatgaccaagtcctcacccttttcattgcagatgcttgcgtgttcccatcactgagttctaatttctctaatggaagtatcattctaaagttatcctttgtccttcttttattcttgttcatgggtatctccactagaaggaggatatatttttctggcagaagaacatgcccgtcctatttattgtgttatcactagtgtccactatagggatggacaggtggtaggtgttcaatatttgcctcatggatattgggaattactatatttattgttctgtgtcccaaagaacaaatgaagcccccacacccttcctgtttattgacttaaagtattgtctttgaatgttgaaaaaagtttttagaaaatgctgaacttacagggaaattcaccaaagtaatagtaatatcatgaagatgctcattgcttctgggctttccaaatctcatctttcctcaattgtgccttctctgcatgagcctaatttgaaaaaaacctggttcacagagggctgcttaagaagttgatggttttgtttatactcaaagtcattgtggggacctctattttcaccttttttggcctaggttgtcccagtacttctctcattctgtgattgatgtcatacgtgacaagtgtgatgggtcacttcactggcctctccaggcggtttattctttagctgacttcaccttgctctggccttatgtaaaggtccctgccctctggcttttagtgggttcaacccacaagtctgcaaactttctcaaagagccagataataaattttcagacattgcaggccatccagtctctgggcagctacactactctactctgccattgtagcatgaaagcagacatacacaataggtaaaccaatgagcatggttgtgttccaataaaactttatttacaaaaactgacaataggctaagatgtggcccgtgggctttggtttgccaatcaatggtttagccagtggaggattgggacaagaactcagagggagagaggagaataaatctttgcaggctgctctgtccttccattgggggttacagttcttctcagggagccccctccatgtggccgcgtcttttgggtctggaaattgtttcctcccctggccctctaggcttagatgtgggaaaggtgccccattattactggcatgttgctttatgctgtgggccccttttccttgactctgactgtacttttgctggttcctgcgtccatctcttgtcacatagctcaatttgcgtgtgccatcaatttcctgctgggattaagatacctggcagtgcagggtttcctgggatatgggacctctaaaaccgaaacctagacagtcccagtaaatcaggaggattaatctccctaactggaacccagccctgtctcctcccttggccctgctccaattaccttcattctggccctcagtacccccaacttggataacggctttgctggccagtgactaaatacagtggccagatggggtctgtggccatcgccatgtgcacctctctgctagggcttatttgcccttggaacaaagtctgtagctgatgtttgacaagccaaggagactctagtgtagtcccccagcctactgtagaggctcttcacattatcatattttatactgcataatttttgaagatgatcccttttcttccaaattgtagtacaggagaggtatgctatttttccataagaaaaatcagacttactttgaaagagcagtaggattagcagacactttgaaatattacattaatccagcttgggttgaaaatatccaaaggactgactcatgaaatttcaagtaattgaacttctggactcaaacagacatgagaagaaaaagttatgttccttcaaactatttcagctcagatgattttttcctttttagttcaaaacctgacaaaggtttgcttgatgaggagaagagaccaccttccccacaatgaaagttaacgctataatgataataggagggcttatgactgaatctgtattcagatacaccgattttgtttgcttttagtggcaagcaggtttagcaggttagagaagagggtaatgttttgatactgtggtgaagctgaggagggcgatgtccttagtctgaggagaccagcatgaagccacctttattgccctaaaatgtctctgccttcaaacaagtgggctaaagagggagggcctgatgctctgaaaaggaaaaaaaaaaaaaaacttggccgggtgcagtggctcacacctgtaatcccagcactttgggaggcccaggtggacagatcatttgaggtcaggactttgagaccagcctgaccaacatggtgaaacctcgtctctactaaaaacacgaaagaaacagccaggtatggtggcacgtgcctgtaaccccagctacttgggtggctgaggcaggagaatcgcttaaactagggaggcggaggttgcagtgagctgagaccaccccactgcactgcagcctgggtgatggagtgagaatccatctcaaaaaaaaaaaaaaaaaagaaaaaaacttgcataatggagcaggctaattcaggttcccaggatctagatgacagtaaatatggaagctgctttaaggagatactggagacattttaatggtgttggccgtttcattgtaacacaaatgacttctctgcagctgttcaaggaagactcttttcctatgagtgttggtagatgaagagtggaaactcaggtgcttggcaaggtcagaaagttagtgtcaatgagtgaggaggcttgggtagaagaaaagtctgtatgaagacataagtacaaaccaaaaatcacttttagttgactatgaggcaaacagcagtgcaactgtgatgacagaaggcaaatggtacttgctggggacacatgggatgcatggcctgtggacatctagaaatgaggcctgtccatcaggaggtcaaccttaccatccacggagtgttgccctgtttgactccaagctcaaagctgtcccaaatccagatgctcggtgaaaatccctgatatttgaatggcagcctctgcaagctaaaggccatctagcagatacagtggccatatgggacgtgccagccatgattttttgcagcctctctgttagtgcttgcttgcccttggaacaaagcctgtggctggtgtttaactatcatgggagatactagtgtggctgaaaagtctgtgttctgaacagtactatggcactatagacaaactttcaaggtcaaattgattatcctgtagtttagcaaagcagcagctccctaattatgtcaggaggcaggattatctctgatcatttgagctaggactccagataaaacatcaaaagcaatatttaaataacacacagccatggttaaggattcattgcattttctcttactataaaaccaaaattgtggtggcccattttgttccattactggaagggttttccaggctgttttaactcatacatagtgtaaccctttcccttattacaaaatttcactctgggaaagagcaaagctgtactttgtggtacagtgttatgatggtttatgttcatgaaggtcctacaaaaattcagaaacattcttaatccaaatgatctagaaataggaactggaatacctactgtgctggagctgcttaacccatgaaagacagttgtacacagctcttcacaactccgtattcagtgatttcacattagtagcttgaaattagccatgatgggagcatttatgccctggacattgtcaaaactcagaaatcaagtcatttatttcttggggagctggtcattaaacactcactaggatgcccttgggtacccctcactgctagaagaattccctccctccctgtatttctcccttgaaatctgagccagtcttgcattctacatatatatatatatatatatgtatatatatatatatatatatatatacacatatatatatatatatatatatacacacacacacatatatatacacatatatgtatacacacacattcctatcttctcaaaaattcttgccttttaaaaagttgttatcaaagacaaggaattttttaatcatcagggtagctcagtcttgagacatctgagtccttctgagtagtaaccagtagctgcaccgaagagacagttcaaggactacaaatgatggtagtccttgaatttcaagtccttgggagttcaaggcctatcctcatttgtagttcttcacactgtaccactctttatttgtttaaaatataagagtgcacaggcaaaaatcagctaaatgggagttgtccagaacagtgctttctccagtgaccttactcacccctccatgaggactcagttaattctaatctctattttgctgtttctatgaggtcagaagtccccaactttttggcactaggactggtttcatggaagacaattttcccatgtaccagggacatgggggaggggaggatttggggatgattcaagcacattacatttatcgtacacttaatttctattattattaccttatataatgaaatagttatacaactcaccagagtgtagaatcagtgggagccctgaacttgttttcctgcaactagacagtctcatctagggtgatgggagacagtgacagatcatcaggcattagattttctgaaggagcatgcaacctagatccgttacatgtgtggttcacaaagcacctataagactctaatgttattgctggtctaacagaggtggagctcaggtggtaatgcaagtgctggggagcagctataaatacagacgcagctccactcatgggcccgccactcacctcttgctatgtggtccggttcctaaaaggctgcagatggatacccatccatggcctggggattgggcatccttgtattagattactaactccacccttaaactttttaagttgtgttttcaaagaaggtatcagcatgtcagtctttcctataatgttctgtgtttcttgaagatagggaccttgcctttttgtgtatattgacaattagtgtatattgtcttggcactgacacacagtaggcagtcagtagatgttacttgcatcaatgcatgagtccttcagaatacatccaattggcattcagtgagcagttgttcaaattccttttaattcaggatggtcaaatgtttgtatgaacatttggggaaacatcttaactgtctaccaggcagttagattttaaagaaaagacatgtattcatatactccgacccaggggaagatatgtggcattctgcttaacataatcagttccttgctttccacaccaatttgtgcttgatttgtttcttttcttctagaacttttcagagtgagaacctttagcagaaaaaaaaagcttaacaagatagacattttagttcaatagaagaatttttctggtgtgaaaaagtaaattacaaaaaggactttggttctgaaagataattaataaaaaccttcccatgtgatgacaaatctgacatcttgtctaatgtctggcagagaagaaagtgttgagagctgcacagttggaataaaatgttccactttacagcaaggccgggtaggatctgataattatttctaggcaacaaaagttcatagtctaattgttcaattgacacaacaccaggcctggctctgtgactatgcaccatcagtgaggtcttcgtttaggctttcctgatttcacaggtaaatattgccaggaatgtgggtgatcatggaatgactccctcgtggatattttggactacagctgtacttatagaactttcctttccctcttgtaagcttctcatgggctgtggtaggctgagtaatggtcccgtaataagtctacatcctcattttcagaatgtgtcaaggttacctgtatgacccagatgagtatgatgtaatcacaagcttacagaagggaagtaggaggagccagagttagaaacagaagacgatgtgatgaaggaagagagacagagaaaaacaggtgagaagaggccatgctgctggcttgaatgaagaaggaggctgtgaactaaaggatgtagatgacctagctggagaaaacacattctcctgaaggagttcagccctgtggcttcagactttagaactataaggtaataaaactctgggaggctgaggcaggcggatcacaaggtcaggaggtcaagaccatcctggctaacatggttaaaccgcctctctactaaaaatacaaaaaattagccgggcgtggtggcgggcgcctgtagtcccagctactcgggaggctgaggcaggagaatggcgtgaacccgggaggcggagtttgcagtgagccgagatcgcgccactgcactccagcctgggcgacagtgtgacactctgtctcggaaaaagaaaaaaaaaagaactataaggtaataaagtattttttttttttttttttgagacagagtctcgctctgtcacccaggctggagtgcggtgatgctatctcggctcactgtaagctccgcctcccgggttcacgctattctcctgcctcagcctcctgagtatctgggactacaggcgcccgccaccaagccctgctaatttttatttttattttttttttgtatctttagtggagatggaatttcaccgcgttagccagaatggtcttgatctcctgactttgtgatccgcctgcctcagtcccccaaagtgctgggattacaggcgtgaggcaccgcacctggccaataaagtatttttaagcctctcagattttagaactttgttacagcagcattatgaaattgatacacgcgggcatgttttcctgaaatcagagcctgagaggagaaccaggtacaggtagttttctttgggaggtgatccaggaagcaggagtaaggaaggatgagaaggcaggaaaggagagagaaccaatatattaaggaatccttgagctcactgctgtagacagccaggggccagtgcacagggacctcgagaggcacagggaatgactctcagacgtgtctgtctgcaagaaggcaggtgggagcattcagccagctgtcatttccaatgcactgagggctgtccataggagcattaactccccctcctttcccatctctgctttccctcacattagccaagctcctgcagtgtaggagaaagagccaaagcagaatgcaaagagactgagggcactctaaggggcaagcctgacttctttagaaactcatcgcagcagcaactgagatcagaggttggctgaggtattggctgcagccaccagcatcatcctctattgggctgacccctcagatgacagacctattcatttactgtttcccatcttttgtctctgtggattcaaggtttcttggtgtagaccagacaaggttcccagtgcctgccacatggtaggcattcattattttctcatttgaactccctgaggctactaaggcccacccaagagtacctcatataggggctcctttgtttgacttaagggaaacaggtattatatggcattcgacatcactaatttaattacaaaaaattcataaatagatgcaaataccaccaaccctgagcaggcacatcctctggtttctcctaagggccagccagcaagccaggcattcccagtgtagtaacttaaattcttacaaaactgtatttttccttttaagttttccaagtgagcccagtggcttaatcctggaatcttaatagtaaagagttaattccatttagacaaaaattgtgatttcactgagtgaattgttcttggctctgttttatccaaactgaaggagggcatgcatgagtcctattttgagacaaaacaccttcaaataatctggaaaacaacccagagtttatttctgccaaatggctccctgtttcttgaactggcatgctatggtgtttgcattgaccaaacttctgcgtggagcctttgttcttagaggttgtcatgtgaaaagtttcaatcatctttctaatatgtccttgtctgtgacatggtcccagtccttattttcatccaaagagcatgttgttccttcttctttatttccacaatactttatacataccctctatattaatataactataatattaatgtatacttattatataagaaatatatatcagctatcaatataaataataactagcacataacacctactgtgagccagtttctgtcctgaaacatttgatttgtgtttactcattgactcatacaaccaatgggagtagacacaattattagttgtgttttgcagatgaggaaactaaggcaaagagaatttaagtaacttgctcagggtcacatagaaactaactggaaaaattgagatttcgacccagttagtctagcctgcgaatctttactctgagctactttttaactgattctcaatgtatagtcacataggttgtagtttattatatgtccatgtgtctgtctttccttctagataataagttttttaagggttttattcatttttccatctctagtatctaggccagagcctggcagataatagaaatgttaaattttcactaagaaaatcaattttaaaatgaacctgatgatgctgtcataatggcagatcaaaatgtcccataatttgaaagaggcaattactaaaacaatagcaaaaaataaaataaaacaaaataaaataaaaaatgagagacaatgcttatttatgccaaggagaggagcacttaggacactcattgccacatcctgactctgacagccttgtcaaagcattccaaagccatgaccttcccttattctcccttccttccccacctcgccttcaaattccctctcctattcctttctaactcctctattttgccctcttcattggttttcccaaattatatttacatgttaaaataccaagtaaagggaacccatattttctgagtgtctattgtggggccaggctatagtagactgcattagttcccaatggctgctgtaacaaatgaccacaaatttagcaatttaaaacgaacatagtattgtacagttttgaatgtcagaagttcaaaatgggcttcactggactaaaatcaaggtgttggcagcgatgcattcttttctggagtctcatggggagaattccctttatgccatctccagtttctaggggccacccacattccttgactcctggccccttcctccatcttcaaagtcagcaatgtggggctgagttcatctcataacatatcactctgccctcaccttcatcatcacatctctttctcttatcctttcttccattttcaaagatacctgtgattacattgggtttacgtgattacataatccaggataagcatgctgttttaatgttagctgattcccaaccttaattaccctttgccatgtaatctaacatattcacaggtcctggggagtagggtgaggacatctttaggggactactgtctattctgtttgcgttatctcattaaagcttcccagtgaccgtttctctagcaaagagcatgtgaaggccattcactctgaattaatttaccaaaagccagagaaatcaccacacagccagaatttggacttaggttagttttggctttttgccccatgcttttccttgttttattgttttcttgtgcttcacttttttttttttttgtacttcacagatactgtatgttttacaaattgaagatttgtggtgttgaagtcaaaataaaaatgtagagatgaatctctaaatttagcatttcatttgggaagaaagacttgcaatttggggcatttatgcagattaaatagtctttggtatgttcaaagaacaaagagaaagttggaggttttgtaacaatgaaaaatgttatgtattgctctttgagaaagttcattgacactagtaaggttctgggaagctggcaagcttcagctggtgagtggcatcagtgagaaaattagtcctggagttgcagcaaattatcttgaagctatagataaaactgggttcaggttacagcagccaggcttgcagagaattacattgttggagcaatgctttgtgtccctagtgtgtttttgcctggcttcttgactttgctttagttgggtatgacaagaataacccaatttgtaggatcagctttcaccttgacaactctgcactgagcaagtttatgggtgctgtttttccaacagtatgtgatcactttgtgtctctgtctcatgttttgataattctcccggtttctttcctttttttaaattattactttgtctattttggtgatgtctgatcagtgacctttgatgttactattgtgatttttttttttttgggtggggggaggcaccacaaactgtgcccatataagatgccaaacttaattgataagtgcgtgttctgactgttccaccaactggccctttactcatctgtctccttctcctccaaacatcctatttcctgaaacacagcaatattgaagttaggccaatgaataagcctacaataaagtactttctttgcctctaagtgttcaagagaaaggaggagttgcatgtctctctctttaaatcaaacctagaaatgattaagctaagtgaggaaggcatgtcaaaagctgaggtaggctgaaagctaggtttcttgtgccaaagagtaaagttgtgaatgcaaaggaagagttcctgaaggaaactaaaggtgctactccactgaacatatgaatgataagaaagtaagacagccttattgctgacatggagaaagttttagtggtctgaatagatgatcaaaccagccgcaacgttccctcaaaccaaagcctaatcctgagcaaggccttaactctattcaattttctgaaggctgagaggtgaagaagctgcaggagaaaagttggaagctagcagaggttagtgtgtgacatttaagtaaagaaacgatccctataacataaaagtgtcaggtgaaagccaagcacagtggctcacacctgtgattccagcactttcggagaccaaagcaggtggatcacgaggtcaggagagcaacaccatcctggtcaacatggtgaagccctgtctctactaaaactacaaaaattagctgggtgtggtggcacgtacctgtaataccagctactcgggaggccaaggcaggagaatcggttgaaccagggagtaggaggtttcagtgagctgagatcacaccactgcactccagcctggtgacagagtgagactccgtctcaaaaaaataaataaataaaataaagtgtgaggtgaagcaggaagtgctgatatagaagctgcagcaagtcatccagaagatctagctaagatcattgatgaaggcggatacattaaataatacattttctacatggttaaaacattcttatactggatgaagatcccatctaggactttcatagctagagagaagaagtaaaggacaagcaaactcttttgtctgggactaatgcaactgatgactttaagttgaagccaatgcttattcaccattgcaaacatcttagggcccttaagaattgtgctgaatctactctgcgtgtgctctacaaaaggaacaacaaagcctggatgacagtacatctgtttacaacatgatttattcaatattttaagcccactattgagaactgctgctcagaaaactatattcccttcaaatcttactgttcattgacaatgtacctggacatccaaaagttttaatggaggtatataaggagattagtgttgttttcacacctgctaatataatttccatttttcagcccgtgaatccagaagaaatattgactttcaagtcttactatcaaagaaatacattttgtaaggctacagcttctaaagattgtgattcctctgatggatcaggacaaaatgagtcaaaaacctgctgaaaaggattcaccattctagatgcccactaagaacatttgtgattcatggggggtggttaaaatgtcaaaaataacaggagtttagaagatgttgatttcaatcctcatggatgattttgagaggttcaagacttcagtggaggaaggaagtgcagaagtggtcgaaatagcaagagaactagaattagaagcagagcttgaatatgtgtgtgaattgctgcaagctcatgataaaaatgtgaatggatgaggagctgcttcttatggatgagctaagaaagtggtttcttgagatggaatctaatcctggtgaagatgctgtaaacattgttgaaaagacaataaaggatttagaatcgtacctaaacttagttgataaagcagcagcagggtttgagaggactgctttctattttgaaaaaaaagttctcctgtgggttagatgctaccaaatagcatcacatgctatagagaaatcattcgtgaaaggaagagtcgatagattggcaaacctcgttgttttcttattttaagaaattgccacagcctccccaaccttcacaaccgccaccctcatcactcagcagccaccaaaatggaggcaagaccctcaccagcaaaaagacaaccacttgttgaaggctcagagatcattagcattttttagtaaaaacgtatttttaaattaaggtatgtacattgtttttagaaataatgctattgcatacttaataggctacattatagtataaacataacttttatatgcactgggaagccaaaaagttcatgtgactcactttattgtaatatttgttttattgctatggtctggaaccgaacctgcagtatctccgagggatgcctgtacatgcagcttccctgtttacagtttgaggagaatatgttgggtagcatcttttagaaataaagtctaggatgttggttcaaattttgtgtgaaagcaacaatagggccaggtacggtggctcatgcctgtaatcctagccctttgggaggctgaggcgggcgaatcgcaaggtcaggagttcgagaccagcctggccaacatggtgaaaccccgtcactactaaaaatacaaaaaattagctgggcatagtggcggatgcctgtaatcccagctactcgggagactgagtctggagaattgcttgaaccctggaggcggagggtgcagtgagccaagattgcacctctgcactccagcctgggtgacagagtgagatttcgtctcaaaaaaaaaataaaaagaaaaagaaaaagaaaaaagaaagcaacaatgggaccgacgaaactaaaagcagtctccccttttacctccccaagaactgtaaaaccatttgtaagtgtctgtgaccttaatgaccagaaacgtgtcaggttttctgtgttcctggggctgtaaaacaccaggaacattttaaggaggtcagactcagcaggggcgtggacatgagtacatgcacatgtgtgtacgtgtgtgtgtgtgtgtgtgtgtgtgcatgcacatgtcctggaatgctccattcctccatgctttccctgtaggcagtatgcctttgtaaacccttccaggactctgggtttgtgctccctgggaggataaagaattaatcaaaatacactgctgcgatatttttacatcctgcaagtcagaggcagtatcctttcttcctcacaaatctaagaccctccaaattgatctcaatacactgactttaacaagagtaaaccagagatgttttatggcagggataaagtaactatcaaccaacactaatgacaagaaagcaaaaagagttggagagaggaaagcataaaggatcccagagacactggggtgttggtttggaaaataccttcttggagctggtttaagaggggatggaacctgagagtgttctcaacctcgtgagattaattatttgtggcaggaagtttctctctttatttgtggctgctttggagacagttgtgtcatgtttttcttcagtcctgatatttttcactggcctctgggatatatctgtgatgtcagtggtatcaaagacttttctgcccttgttccatggatgtttagtgtacaatcagctgctgcaacaaacaacaccaaatctcagtgactttgcacagcgttccgtggatgtgtcttgtggggcggttctcccgagtaactgtcttctgtgcaatgactgattctgggctctttctattggatgactctgccaccttgggagtccttccttcctatttccatggataggagaagagaagatatcatgcaggacattcaggggccatgtctagaagacgtgagaatccttccacccttattctgttggccagtgcttagtcacatgtctaaaattgtaatggagcagcagcaccatgtcctattgtgagaagtagccagagactaatctcaatgacagttcttatagcttgaaaaggtatttgcaaaatctaaagcaaaagttgccaactcgaatgcctagatgtccaagcaagtgtttaactgaattgagtgagcagaaacaagaaccagggagtggtgctgagaaggaaagcttggagaggggcactctacataacatgacaatttaacttgatgacagacttctctggctaaactaaccacatctgctggccacatccatcccttatgctgccagttggcaacctacagtatgggagagaaaaagaaaaaatcctttctctggaagcaaactccaaagttgggtatattcttgaatcagtacctgtcaggataaaaaaaaaccctttctttttaagaaagaacgaaagttctgtactacagcaaataaatggaagctaaaaagaaaacctggtataaagagtgtgatttaagaatttgctttctgtgcatacatttagggtagtggctcttgcatggaagagagatctctgagctgctactttaaaggatgcttggtgtcctacagaggtaacacaactcaatcatatcaggcactgatgttctgatggtgcagctgatcctgagatgcaaacaccccatgatcttctgctgtctgattccctgctatgtccctgtatgtagtctaaacagtctattcactgaacagttttttagtaacaacaaaagtaataatatgttggtaatagtttgtcaatgtctaccctggagaatatcagtgaatcatgaatatggatttaaatataatacatagaaataataatagcaagcatttattgagcaagtactatgtaccaggaactacttaaggctctttacaataattaactcacttaatcctcataacgggtgagataccattactcctgcttttcagcttagaaaactgagacacagaaggttacttgcccaaggatagcccgctggtaaacgagattcacactgaaccaacgtggcttaaacctgtgcttatagtccgtctgaaacgtgaatctttgtagcaggctgatggtaatttttagataatagaaatcttttgttaatcatagaatttgattattgctgtgctttcaaaggtgtcttggttacctctcatttcttaggtactcactgatgcataaatggacaaacatgtcatagagtaagactatgattgccgtggcattaaagataaatttggaatgatgctcagagcatatattctagaaaatttacagaggatttggggaaaactatgtccaggtagtatttttatgcatgtgacatctcataatattggagaaagggcttgcctggttttggagtaatgtccaagttctaattcttacagcaatgaggggtgctgctttactgctttccatccccttaccaaagttactgtgaatgaaattgaagagcggatatcggtggcaagttcaagcatagatactgttttgaattctcttaagaaattaaagggcaaggctgggcttggtggcttatgcctgtaatcctagaactttgggaggccgaggcaggcggatcacgaggtcaggatatcgagaccaccctggccaacatgttgaaactctgtatctactaaaaaaatacagaaaattagctaggcgtggtggctggcacctgcagtcacagctacttgggaggctgaggcaggagaatggcatgaaaccaggaggcggggcttgcagtgagccaagatcgtgccactgcactccaacctgggtgacagagcaaggctctgtctcaaaaaaaaaaaaaaaaacagtaaaaagaaatcagaagacaatagcagtaactagaacattctactattattgactagtaagatatttagcttttggggaagtcctaaattagcctggaatcatttttaaatgcagttttgtaatttcagtgatgtgttacatgaaactcaaagagccacaaaataattcacgtgtaagcgaagagtgtgctggtttaaaagatgagtctgcattcttctccctttatgcagataattcgtaatcatctttgagatcccagcagaaatgtctcttttgtggttttgctttccttgatgctctagatgaagttagacttccctataccccaacttttacatgctcccagagagatctatattttcctttccagttaaattttaatcttggtgaatcacttaaattatgatttgttaatgcctcttttctttttgagaccataattatatttaacaattattgactccttatcctgtgtggcacctttctcattgctttggacaatgtgtagcaaagtcctcactgaatcccaggagtctaataggtatttgtgaatgaggagtgagtgaatgaatgaatgatttgactaattcttacctcactaagtcacccatggcccaggagggtactgtgtacctttatgttacaaatcatttaactttaattttgactggtaggtgaagtgtcccaagaatttgtaaagataaaactgtgcctttggggcttctcctactgctcccctcttccctaagagtcagcagctggaaaaggtttatttattttttttattttgtaactgtagaggaatcctgaatgggccctgcaaagtaatctcagagattgagccacacatagacaaagatggagaacacagctcacctgcagagtgctgtttctcatcactaactgtggtttctctcagtcctgactttttatgctgaggattctgggagaaatttcaccttctttacttcctacaggatatccagtttcctggtctgggagctgagagcagaattagccaattggaaggttaacgcataattgtaggcactgggtgtatggaggagacccttgaccatttgctatttaactgaattaatgttggccagttatagattttctgtttgcaaaattgccagcagatttttctgactcctggatctgcatcctgtgtatgtgccacttgggatgccagcattttgattgcttccagagcgatctaaccagagcctgctctcaagacaagggaatccatgattcacaagcggaaccgtacagatgccagaccacagcgttcttttcactttgatttgagggagatgatgttggtcagggtgatgactcccccatttcaatttctctgatgttgttcaggccagccacacggtgaacctcctgagattgattcttgctcccttctttggggttcagtgcatttcagagggctggtatttagagagaagccctggttccacagcttccaaccttttgacactgctttgagttctctggtggggatgataatgaattttcttcaactgtctgtgtgcagtggttaggattttgaggtctgatattgaagttttgttttctaagaaacacacagagtcgaggatttgagtgcaagtaatttgagtgatggcagaaattggtttaagaaaaatactagctggggccgggcacggtggctcacacctgtaatcccagcactttgggaggccgaggtgggtggatcacgaggtcagcagatcgagaccatcctggcgaacactgtgaaaccccgtctctactaaaaatagaaaaaattagccgggtatggtggcgggcgcctgtagtcccacttactcgggaggctgaggcgggagaatggcgtcaagctgggggcggagcttgcagtgagcagagatcatgccactgcactccagcctgggcaacagagagagactccatctcaaaaaaaaaaaaaaagaaaagaaaagaaaagaaaagaaaaatactagctgggtgcagtggctcacgcctgtagtcttggcactttgggaagtcgaggtgggtggatcacttaagctcaggagtttgagagcagcctgtgcaacatagtgaaacctcctcagtacaaaaaatagaaaaattagctgggcttggtgacgagtgcctgtagtctcagctacttgggaggctgaggtgggaggatcgcttgagcccaggaggttgggtctgcagtgagccacagttgcactccagcctgggcaacatggcaagactcggtctcaaaaaaaaaaaaaaaaaaaaaaaaaaaaggaaactttaaaagtcaaaaaaaatagaaaaaataccaatagggaatgaggaaataagtcagggaagagaaggcaggtaatgaatgtgagttatcaagctagattctctggtggactttggcactcaatcccaggtggaaactgggagacaaaatgcgtatctccaagtgatctcaccagaggggtgagggaattgggatatttacataccattccccatcagttattggttaaggaccactcccaggatgttaatttccaaacactctcttctggcactatgctcagataaaatacccttccacaagttttagagacatatctcgtacaaagaagaaaaaatgcaaagtcctgcacgttgacacagaaggtctgaggggaatgggtaggactctgacagagttcctttgaggacacttgaacctagattcagatgctggcttcacccattccaactgtatgatcttgggcaagcttgttaacctttctagaatttcgagttcgtcttctataaaatataccttataacattacacatttcataggcctgctgtggagatgatgcatatggtgagtttagcacattaatggccaaatactaagggctcaaaaatggtagctttcatttgttaagtgttacggagcctcttctctgtcccagtatgtgtggtaggtgctcagtagaaccagtggttggttgttggggggaggtaatacctgtttttatggccttatagcctttgcgtactaaaccttaagaccatttcttatttcactaagtcacaccttgcccaggagagaatcgtatacatctcatacattatgttccaaatcacgtaacctaaatttttgaccgctggatgaagtgtcttaagcatctgcaaagacagaactgtgcctttgaaagcaattgtaaattttaagttttatagtagccaagtttgcaaaaggaataagaaactggtgaaattaattttaataacatatatttaatttcatatgtaaaatattgtcatttcaacatgtaattaatatgaaattattgactattttacattcttttccttatttagacattgaaatccagtgtgtattttatacttacaacatgtcagtttcagacctatgactgttaaagtactcagtagccaccggtggttcatggtcaccatattgggccacagtgaaggcttaacaggtcctggattccttttagaagtaaattccaacagaatagttccattttctctttcctcctcttcatagatgacaatgcttctttgcttgtataaaaatgaagttggttttagcttaggcatcatggaaaattgacagtttctgtaataaaatttcacacatggaaaccatggtgagaatcttagcaggtgtaaaaatctgacgaagttatttctttaactgcaatttaatggaaactgcagcagctgttccatttgcgtattctccaaatctcagtgccaaaaagaattgttggcagccactggagaagtttcaacttacctcttcatttgggaaatgaaatcaaaacctcagcttgtttctaaaagttgcggatttggcgaaagttagcagggcaaacacataagccgctattaaaatattgatggctttggttttctcaggtgctgctgctaacatctgcagaagatttggactgcactcctggatttcagcagaaagtgttccatatcaatcagccagctgaattcattgaggaccagtcaattctaaactgtaagcaatgtcactcaaagatgcttttagactcttctcatatttgaatttactaatgtttatgactgtgtctcaggatgtggtatttcctaaactaagtgttttctgattatttttcttatgtcactgcttgacccaaagtggaaattcttgaatgagggcctggccaacttagaggttaatagagtgatatgcatctctttttagtattttatcatcagtgggtatctccatactgctgtcagaaaagggggctgtcagcctccaatgagagttgtacactgtgcaaaggaaatgaaattcatttcccctgggcagatccccaaaatcaaaatcattgccttctcgcagattgctgttctacctgtagtttctcatacatagcattagatcaaaataatggtgagagtatgacattggcttctgggaatttttagacacagacatcaaaaactcttattcttaaggctaataagatgggttttagaaagattcaaaacctctactgattattctatggattaagctcaactcatcctgaattccaattgatttatttaaaatatgcatctttcatatctgtggtgatgatctctttttgtttttaatgtcaatattatattgctttatctttaagaagtgttagggtacattgctaaatgcataacaagtacagttttagtgcaatagaatttaaaattggtggtagacaaatagctatttcattgtaggctcttgagtaccttgcttaacaactggaaatgaagaatatggaaacaactgatctaaactgatcagatgcagtcgggtgtgatggctcatgcctgtaatctcaccactttgggaggccgaggaggatggatggcttgaggccagaagttcaagaccagtctgggcaacctggtgaaaccccatctctactaaagttacaaaacttagctgggcatggtggcatatgcctatagtcccagctacgcgggaggctgcggcagaagaatcgctttaacccaggaggtggaggctgcagtgagccgagatcataccattgcactccaacctgggtgacagagcgagactgtgtctcaaaaaagaaaaaaaaaaaagaagaagaagaaaattaaaataagctgatcatacgctccaaggtcttttcaaggaaggtgattccacattggctcttatggtctcaggtttacgttccacgctagctaagttcctttagtcctatgctatgtggctgacaagtttaaaggaaagacaagaaaaaaaaaaaaaagcacacttgactggattattctgtgaggctgggacacactctaagagtcgaaaggaacacaataatgaagatgcactgttgagcatcaagggagctgtccaaggtgaagcccgtgcacctcccgatgaaatgacgccaatgaaatcatttcaataattagtctgtaatgacaaggtgcagggctggcacaataagtgaattccaatatgtgatttcctgctcatttgatctctgagtgtgactcctgggtcaggccattaggaaccctcctttgtcttttcatttttgtatttatcagaatcaatatatttcaaacagaacttgatttgtgagaaccatttttctggctctcctctcctctcttcctctgtcttccttttattttttttccaagtgattatcccaaatggcatctatgttaacatgcttggaaatgcgaagcgaccctgagtatggaaattaatagagttggtatgcaaagtagacctataaatgtgattgcttctgtaatcttcacgatagcaaacagtttttaattcgctgctgagaagctggaaacaatcatactttggggggatctttttaatttaaagtaagccatactgtacattgcagtatcacagttgtgtgtgtgtgtgtgggggggggggcggcggtgtgcgtgtgtgctttaatcccctaagtaattaagtgggttatggttgttgcttctgggtaagctagtaaatgctaaatgggactaggttcattatcaatgataacacattcagaaaaagtcagtgatatgagaattgaggacacttaaatttttatgcttgtatatgagttgttgggtcagcaaaatttgattagcccctcttggtgaaaccgtatgtccatgtatattactaaggtaaaaaaaaaaaatccaaagcagatctggttaggtactttcaagttcatctcaaagcaatgaacatattatgagtatagagcctgcagataaggttaatggtgcctaaatgaggaagaaaattgtcatagacttgagaatgcctattgaaaatagtttaggaaactctggatttctagaagtagtagcagtgctttgctttattccacttgcaagtagcggttcaattgaataaacttttatacctaaccaaccaatattttaagccagtctcactctcccctctctctcattctcagtttattttgcgtatttcttataatgcaaaacaaaaaccttctgtctctgaaaaacgtgattaatcaagaaaccaatgagtgaagtgtgctatcaaattgaagactctactggcacaaggctaaatctgaatgaaaaacgaaaagaaccaaacagaaccagaaaatgttaaatgcatagattccatttcctgaatcattgtataccaaagatccaggaaatggttagggatgttttagtctcatataaatataggtcagtgttgtacacagtgagaaaactagattagtagcatcatcttgtgccctactcatgacatttgcacttcatatttttcctttatctttgcaatatttaagagctttggttaccaatcattgtgaacttttgtgttgcagggggtgtaaacacagcataatcaatcaattgatgtctacactcttcacttttctttaaagttgtctgaaagtgctgtctctttgcctgacagacatagtatatctacccctaccctagacttgtgttcatccaattgtgtgttcagcttttagcaggttatggggaatgtttattctgtggatggcttcctgctatctttgttcagacagtaatatttccttttatcctttttcatcttcctcctcaattttcaatgacttatctttttctactttaactgttactaatggtcacctccactccttttatttccctaatattttattcactgttatctctgatacatctttctctcagttgttctgaagccttttatttgcttcacatctgaatcactctttattctactctcctttccactaactggacttgcttttgtcttaaaaacgccatttttcaacaatatgctgggaccaaaacatagcattcagctatttcttctaacgtaaccagtgggctcttcactgcatctttcagagagtgatgcaaagctcccaactcagggaaacttgggtaaaacttccttggcttcatctcagtcttgaaagtttatctgggaaaatgtgattcttcccatttgtcaatgaaaaatacaagaagaaaggagaagtcagcttagaaggcaaccactcagaaaggaggcatccatttaaggtctttgaattctgaaaggaatctgtgaaaagtttgtgggaggtgttttctggaggcctggcacccatatctccctcaaattgcccagcatggtagatcttgcttttccccaaacacgacaattgtgtgatctgggagctgacatcttagtaccaccagaattggacagcaaccctggttacatcatgacacccagaacagaagatccccagtcttagaagaatagctgtcttgggcaactgaccagccacccagctgggatgggaagatcccaagtgataaaatctgactatcctatgttctgcaaaattataaaacaggatagtctgctttgataccatcagctcagacagattttttccagcaaatggaaaaatgtgtggtcattgagctcattaggagaaaccatacccttgacctccagcctctattagcaggggatgagtgcagtctttggtgtccagaaagaagatcctcattggccacatagccaccattagaactgtacttttttttcttacccttgttcattctttatgggtcattcctcttaggccacccacatgcaaacatagacacataggtagagacagaaatcacagcatctgaatttacctacaatacaacttgcatcacatgtttaggaaagaacctgcattaacaagagcaggctaggctaggccatggtgtcaaacaactctagtgacttaacacagtgaaagtttatttctcactcagatcatgcagatgcagtcgggctgctctcctgggtaactctcctcccagtggttgccctccatgcaagaacctgatggccgaggctacttccaacttggtcctaccatcttgtagcttccagcttttatcactgagctggcagacaggggaataagaaagactatgaggaggtcactgcaggtgcttaaatacctcagccccaaagtggcatgtatcatttctgctcatattctaagatctaatcatgtcgccaacctaactgcaaaggagtctggcaaacgtagaagaacacatgggtatcgatgcaggatcacagtctctacaaagatcctaacaaaatgatgtcgcctatatcagaaagagacataaatagagacagaaatggaccacaaaggagccagctgtcttggagtaaccaaggcctacataggatgaagttagtcagtttaagcaggagagcaaggtcgtgcacctgcgactatgtcctgctttccttagtagagaaatattcccactgaacagaattagcttcttagaaacactataagctcctctccctgtgccatcttagaaacactaggggagggacagcacctactcatggactccagttgcttcctccaattggttacaatactgtggttaagatcacacagttttaaactcatatcgactagaattcaaatgtgcacacagtcatctattagctctgtggccatgagtgagttattcacatcctccaagtttgaattatctcatctccaaaagaagattaatggtagtccctgcttctagagctaatgcctcaactgatgggaaacatgcttagaacatagtcacaaataaatggaagctgctattattattattattgtccttataatttctgctgttactattattatcattactttcattcatagacctcagctagatccacttttcttataatggccatctgaaattggctttaagaagaaaaatcatgttggccattaaaaatacaaacaggtgaagaagcgactaaagcagtgattgtagggcatttgaacttcatggaccagtaatttttttaaatcctagattgatgagagtgtattttaaaaaattggtaagacttggtatgaattttttaaaagtaagtaaatgaagggaggggaaaacactaccgccatttacttttgccaggctttccttttaaaaggtcacttggcatcaaaaataaacataaaagaagtaaagactagttacagaagaaaagtcagttctttgagtaaattttgctttgtgaaaaatgcaccaaatattcttatttacttcgcttttgtggaaaccattgatctaagggattaggttgatgtcaccctttttgctcttcacttttctgatacttttctgaagttttaatatgtcgttgtttctgaagaggcaggggtatttcttaggagacattttcatgaagggactcctgtccatgttgacaaaagagagtgagtgtttctagataatgtgacaatcatatgcatgttaggaggtgtattagcctattttcatacttctataaagaactacctgagatggggtaatttatacagaaaagaggtttaattgactcacaattcagcatggctgaggggtggcctcgggaagcttacaatcatggcagaaggtgaagaggaagcaaggcaccttcttcagaaggtggcaggaaggagaagtgctgagataaggggaggagccccttataaaaccatcatttctcacgagaactcactcactataatgagaacagcatagagaaaactgcccccgtaattcagttacctccagctggtcacccccttgaaacgtgaggattatgggaatcatggggattacaattcaagatgagatctgagttgtgacacagagccagaccatgttattccgcccctggttcctcccaaatctcatgtccctttcacatttgaaaactaatcacacattctcaacagttcccgaaagtcttaattcattctggcattaacccaaaggtccaagtccaaagtctcaactgagacaaggcaagtcccttccacctagaggcctgtaaaatcaagttagctgcttcctggatacaatggaggtacgggcattgggtaaatacactcactccaaatgggaaaaattggccaaaacgaagggtctacaggccccacgcaagtccaaaatccagcagggcagataaatcttaaagctctgaaatgatcttctttgactctgtgtctcacatacaggtcaccctgatgcaagaggtgggttctcacagtcttgggcagttccacccccatggctttgtggggtacagccccactcccagctgctttcacaggctggcgttgagtgtctgtagcttttccgggaggacagtgcaagctgtcaatggatctaccattctggggtctggagggtggtggctgtctctcacagcttcactaggctgtgccccagtggggactctgtgtggggatttcaaccccacatttcccttctgcactgccttagcagaaattctccatgagggctctgcctctgcaacaaacttttgcgtggacatccaggtgtttccattaagcctctgaaatctaggcagaagttcccacacctcaattcttgacttccgtgcacctgcaggcccaacaccacgtgtaatatgcctaggcttggggcttgcaccctctgaaacaatagcctgaactgtattttggccccttttagccatggccaaaatgcagggctccaagtcctgagacggcacaaagcagcaaggccctgggtctggcccatgagaccattttttcctcctaggcctcagggcctgtgatgggaagggctgccttgaagacctctgagatgccctggagacatctccctcttacccaccagccctgttacaccattgacttggcgattaacatttggctcctttttatttctgcaaatttctgtagctggcttgaatttctccccagaaaatgtttttttcttttctatttcatcttcaggctgcaaattttccaaacttttatgctgtgcttcccttttaaataaaaattccagtttcaaatcttctctttgtgaatacgtaaagctgaatgcttttaagagcacccatgtcatgcttgaacactttgctgcttagaaatttcttctgccagataccctaaatcacctctctcaagttcaaaattctgcagatcactagggcaggggcaaaatgccgccagtctctttgctaaagtacagcaggaattacctttattccagttcccagcaagttcctcatcaccctctgagaccacatcagcctggacttcatcgtacatattactatcagcattttggtcaaagccattttacaagtctctgggaagttccaaactttcccacatcttcctgtcttcctctgagccctctaaactgttccagcccctgcctgttacacatttccaaatttgcttcctcatttttgggtatccttatagcagcaccccactctactggtaccaatttactgtattagtctgttttcttttctttttcttcttctttttttttttttttttttttttttttttgagatggagtctcactttgtcgcccaggctggagtgcagtggcacgatctcagctcactgcaacctctgcctcccgggttcaagcgattctcctgcctcagcttcctgagtagctgggactacaggcatgagccaccatgcctggctaattttttgtagttttagtacaaagagggtttaaccatgctggccagactggtctcgtattagtctgttttcatactgctgtaaagaactgcctgagactgggtagtttataaagataagaggttcaattgactcacagttcagcatgcctggggaggccttagaaaacttacaatcatggtggaaggcagagagaaagcaaggcaccttcttcacaaggaggcaggaaggagaagtgccgagataagggggaagagccctttataaaaccatcagttctcgtgagaactcactatcacgagagcagcatagaggaaaccacctccatgattcaatgacctcccccgatctctcccttgacatgtggggattatgggtatgacagttcaagatgagatttgggtggggccacaaagcctaaccatattaggaacatatgttggcatgcaagcttctgtgagtgtggacaagtatggcctccctggccttgataactgacagttactgtgtgctccctagtgtgttgagggccacctcgaacctcacaacagctcttaggggaaaggtactctcatctgcccattttacaggtgaggacatttaaggctgagctaggtgaaacaatgaacctgagatcatactgcttataattggtggtgtcaaaatttgaacccaggattttagggccctggttttcatccatagttctgtggcctagtgtctcttagtttttttgatgttggtggtgatacatcaaggaaatttgccggtgtgttttcccatcacttttatcaaccagggtgagatagagagaactgctgctgctgcgtatttgttgcttttcatagccaagctcatcctgtctctgtattatagaagaattagctttttctattctggatggacccagggccagattgtccatgacccttaactctcagctttccaccctctctgttagtttctttcaccaagacgttacttggtcatgccaccatgacactgaccttggttagcagccaggtcctccatggagtgtgtggaatcacattaatcatatttgtacttaacatacatgagtcatggcttttgagggtgcttttaattgactataaatcaagcaaggaacttgaaaaatgaaggcaattaatgaaaaagcatgtgagaggtgttttgcatcctaagggaggaaatacactgtcagtgaatttaatgtcacaacaaaggctcttttgaccctgctgaaaagatttcatgtggatagtaataaatggatgaactttgcagcctcacaggtggagaattgcctgtttcctgagttcaagctgacttaggcttttatctgtctacattctctatcttgagaacttcctagattcttttacttttgctttcatttcttgtgatttttaaaaataacaatgataattcttttcccattttctggtcattcttcacacatcctttacatattttatacaagcttgtatttactttcaggttgggagactgattaattgattagtgaggttatgtaacgtcccctgaactgcagtctggacagagctggacaaggttggggtttcaagtagtatatttgttttaatctgttgcgatgtgccaaggaaaattattctggtattgcctaattcactctatcattatgaagttgacgatacatcgggtcagaatgtggactcctatttacattaataagagtttttcctatatttaaacagagctcagtagaaatgttatgctttcacaggttttcccttccctcctaccaatccatttgtaacaatctagtagtaagtcaattaataatgattagaaacctcataaatgcattatcctacctaacaaatgtgaaatactataataaaatgacgtaagataagaaatgaacatatgtacacatcaaagacagatgtaacaaaatgtttagagatccttccattggacttgggtcctaacttgttctttaaagaatgggaaacacaagaagtaacagagtgagaaggacttctcagacgaggaacatgaacacaggtggagttcccttggcctaagttttcttatcagtagaatggaagagataaatagaccagaggtatcacactgtcagcctttgggctaaatttgcctcacagatacgtcctgtttggctgcttagtgtgagaatttgaggtgtttgataaaaggaatttgtcattaacatttagaatttcacctttagaaattcccaatttctgggtagtgttgcgtcttcagagcagacagagatgccacagttcagctgcctgggttcaaatctaaggccgatcctttaccaactaagtaactttggcaagttgggaaaaacaaaacaaaaaaactcactgtggttttattttctcatctggaaaattaatattataatggcagcaatctcaacagtctgttttgagggctaaatattaatctatgtgtgataactgctacattgtgtaattattatcattattatttgagatggagtctctccctgttacccaggctggagtgcagtggcgcaatctcaactcactgcaacctctgcctcctgggttcaagctattctcatgcctcagccttccgagtagctgggactacagaagtgcaccaccacgcctggctaatttttgtaattttaatagagcaaagttttgccatgttggccaggctggtcttgaactcctggcctcaaacgatcgtcctgattcgacctcccaaaggactgggttaggtgtgaaccactgcgctcagcgggaattttttttttttttctttttaaacacaagtcaagtgtagtagtgagaagtgcggaaggggtagaacaaggagtttgatatgtaactttatccttattaaaataccaatgaaattatttacagaaaaagaaaaaaaattctaaaatttatacagaaccccaaaagacccagaacagcagaagccatcttgagcaaaaagaacaaaattagagttatcacgttatctgacttacagttgtactacaaagctatagtaactaaaacagtgtgatactggcataaaaacagatgcatagaccaatgggacagaatagctaacccagaaatctatgcatttacagtgaactcatttttgacaaaggtgccaagaacataccttggggaaaggacagtcttttcaataaatgctgctgggaaaactggatatccatatgcagaagaatgataatagagccctatctcttgccatatacaaaaagcaaatcaaaatgaattaaagacttaaatctaagaactgaaactctgaaacgactacatgaaaacattgggggaaatactccaggacattggtcttggcaaagatttcttaagacctgagaagcatgggaaactgaaacaaaaatggacaaatgggatcgtaccaagttaaaaacttcctgcatagcaaaggaaacaatcaaaatcaagagacaacccacagaatgggagaaaatatttgagaaccacccgtttaatgagggattaatagccagaatatataaggaagtcaaacaactcaatagaaaaaaaaatctcattaaaaatgggcgaaagatatgaattgacgtttctcaaaggaagacaaatgggtaacaggtatatgaaaaaatgtccaacctcactaatcatcagagaaatgcaaaaaaatgtatatataaacatattctctccctgcagttaaaatggcttttatccaaaagacgggcaatcatgagtgctggtgagggggtggagaaaaggaaaccctcatacactgttggtgggaatgtaaattattacagccactatgcagaacactatggatggtccccaaaaaactaaaaatagaactactatatggcccaacagtcccactgctggatatatatctaaaagaaagggctggaagggtcctggggagggagaataaagtggggttggttaatgggtacacaaatacagctagaatgaataaaatctagtattttgtagcgtaatagggtaacaaaaattaataatttattatatattttacatacccaataagatgaaattggaatgtccctaacacaaagaaatgataaaggtctgaagtgatgaatactcaattactctgatttgattattacacatagtatatctgtatcaaaacatcataggtcccctctaaaaatatacaactattatgtacccataaaaatttaaattactttttaaaatattaatctatgtaaagggttttgaatagtagctgacctataatggtccctgaaatattagctgtcagaaacagcatagggatgattgtagctgaaagcttgctatggccctccaatatttatctttctgatatccagtaggcttcctagttaactctgcctgtcccacatgggcatctaaattcaccttcaggaagtcactattactcctaagactgttcatggagtcaaatgatgttccatagaagacaaaaccatcttgaagtttttgatgctgtcttgtttctgtcatatcagtaacactattgacaatacctgctattcactatcaaggaagcagaatacagtgctaaggggtgagaggacatgggctggctggtgttgatcaaagactttgaaatctgttttcagtgttttgaattgttgatacaggtaatgtatgaaaagggaaccatgtggtcagacagggtggctggctttctggaagttcagaataggaggaaggtgaaaaggatgagtgggcatggctcaggctgccatggagccatttcagaagtcctgagatggggacagtttgtatgtatatcagaggagagatcaacaagggagataggagtgttattggggagcacttgaacatgaaataagtgaaaggagagccccagggagatccaagggttgacactaacaggcatctaaaagaggttttccgaaagagaagcagaatcactggagtctaatcccagctctaactttgacttgcatgacagttttcctccctggacctttgtttttctcatttgtataatgagagcttgtgagttgggctgttttgactgtaatcaacagtaacacaactccaactagcctcagcaaaaacatataaaattatcagctcacatgattgaaaatttcacagtgtgagttggctttggaaacacttggatctagatgcattaatgatatcctcaatatcacccttcatcccccagctttgctttctataatattgatctcaatcttcactctcagagggtttccctccaagatggccaccagcaattccagtcttttattcttctagctaaaagagccagagcatctgttttcccagtgttccagcaaatatctcaaggctgaccgtccttggaccaacttggtttacgtgcttatccctaagccagttattatatccaagaaaattctgtacttctcttagccaggcctggggaaatggagatgaaattccctcaaggaaggaaatgatgctgggctggcaaaagtcagacagtccgttctaagggtattgtgctctgttgctaaggtcccattaagtactaacgtcttatgaccgcagactgtgccccaagcctgagaatttttagaacccagcatacacacaaatggaaatgttttttaggtggcaggggataaggacagccatcacaccaggtttcttgctggtgatgctggtgagcagattgcttaattaagactatcaaattctaagtgctgccatatggcctcactcttcaacctgttgagtgtcttcactcacttggttctggagctggtataaatctgtttcatttctgtttttctttaaggaattaagaatacaggaacatacggatgttacaggagcatctcctaatttaaggtattagaactacataaactgggctgctttaataagtaaggcatcaaaatataaattgggaaagattaagcatagctttaaataggctgagaaagcagaagttcttattattctgttacagatcaaatctacacacattctagtaatagaggtgccctctatttgttcttttcaccttaatgttgatggaaatttttttggcttgagagcaaaagggcaagaggtacaaatgcttgccagtcaaaatatccccaaggacttctgcatttgacaaaattcattctccttctggagatagaaatagggaatggaaaaggaaaagatgtatattgagtccctaccactcatttagccaactatagaagaaacactgaatgatcacctagtttttgccagaccctgtgctaagtataagggataaagctttgaatcagataaaaaatgtgcctcctgctgtggagctttgatgatatcagagagagaaaaaggcaaacatgatataataaacccttgagaacacaggaaaacggcacatgacaagacgatggttaagtatcatgaaggaaataaggcaaggtcatatgatagagatttctgcatggctgctgaagaatgggtggtcaaagaagatttttctaagaagccaagtcctaaactatgagaagaatccagtgaggtaaaaatcaatggtataaacacttaggctgagggagtaactcatgtcaaagccctaaaatgagagtgggttcttcagtttgagatactgtgatccaggaggagggctgtcatttgatacatttaatcatctcaaatgtcttgcaaataggattataaactctatgttatagataggggtataaagattgactaaagagcccaagatctcactaaaaagtgtcagtggtgttacaatcctctgactccaaaccccattatctttccatatggaatgctgtagctggtgttggagtcttctttcacagtaaagtgctcctgtcattgcctctgagaacagactggggtgtccttgatagtttcacaggacagtggtgtgggctcctaggttatattgcctgtctctgtcactcacaatgggtggtgtttttaagctacccaaacttccagctcctaatttttctcatctgtgaaatggagatagtatttcaaggattaaacaagatagcacatacaaaggagtgacagcagtgcctgctacatgcaatatttttattttaaaaagttggttggttttatcctttaaaagaataaggctggggtgggaaatctctgtgggatgatgctgtttgaatgggtagtgctggatgcccaccaaagatgacccacgaaattttcaatatagcttggctcctctgaaagagagcatattttcttcctacttcttctgagactctcttttaagtattttcatgttctagggatacttgttctcccccacccctgaccacttctcactcatgcttggtctctttgagctaaatgttaaaaacatactctatgaaaaatatttgagaaattagtactcccaattttaggtccagatgtgttctggaatttagaaagataataagatgcacacattgtattacacgattctacgagcggggtctcgggcagctccctgtattaaaacaggttggcatttcaatagtaaaacatatgaatgtttaccctcagtaggataaataaggaccacaaataacatcatgtcagttcaggttgggttttgctgccaaatgagttataaaaacatgtttggtatgctgagtctcttggatttcagaattgcagattgcagtccttagaacattcccgtgaaaagttgcaaaccttagtcgtgctaagatgttgagttggcgtcttcacatcccggccacttctgggagcagcagagtgtggtggctcagcccacccctcaacccctctactacttgtgaacaccttggtaaatgatgtcttggcaggccacccccgagaagtggccaagtgctgcaccagcttttttcttttccatttgaagccaaaacgattgtcagcgatccaggcttctcttaactgtgcctgtcagctgattctgaagacctcccagaggatctatttttagctaaaactggttttaaattttcatatgtatacattaaattccatagaggaaggggggattccaaatgaggaaacattgattctgaataacataaaagaaataagcagtgcttgaaaaacagttcaaaatatgagtcaaaacctcccaggaatatggttagcactgcatttttccatggaaggaagtctgttgaattgaaaacagaatgagagtaagtggggataaattatactaagaaagagactcagcatgaaattctaggtactgaagaggggaaggagaataagaatagggaggactgaacttagagggcagttgggattgccagatggatactcatggggatgtgtggccaggtaatcaaatcgcattgtccaaaagggacatggaggccatgggctaggaccaggcttttggccatactcaagagggagagagaagatacacctcccaaataaaggcctggagtctgcacatgacagctttgattatgcttccaaggttttgttcatttttggggcatgaccaaggtagttctagaatgagtgaggccaaagctgaaagtgtcacaaagtttttgcgtatgacaaaagttgcctgctttgcttttggatgctcaactcagacttcttgttttcatgatgtgcagttttgatcaggacattttagtgataggtatagcctacttctgtaccaaaggagaggttggattatctgttgaaaagcgttttgttggctataattacaatatgatgacttagttaggattctgataaatcctgactaactcaagactttaaagaaagatacttaattaaaatagaaggaagttgcatagtcacaggttcatccaaagacctgaatgacaaggtctcagaaaggacagaaactagagaagttccatgggcttaagcaatgggaactcatagaattaggacagtgcttttcaaacttttacagtgaatgacgatatttgtttcattttgttttgttttaatgtgtcacagtaacatacttttgttaaagaaaaatgtcaaatatagttttcaaaaagtttaaaacatgactcacattcatatctaaagtgaacacatcaaagattttatctatctcaacaatgcaaaaggggaccaataaaatgataagtatgattcaaagagcattcgagaaactagctatttgcatgcaatttaatagtaaaggagtgttagaataagtttgctaggttacatacgaagctggttaatgtcctgtattagtctgttttcacactgctgatacagacatacccgagactgggcaatttacaaaagaaaggtttattggacttacagttccacatgagtggggaggcctcacaatcatggtggaaggtaaaaagcatggaggagcaagttacgtcttacatggatggtggcaaaaagagaatttgtgcaggggaactcctctttttaaaatcatcagctctcatgagactcattcactatcacgagaacagtacaggaaagacccatctccataattcagtcacttcctaccggtccctcccatgacatgtaaatagtgggagttacaattcaagatgagatttgggtggggagacagctaaaccatatcatgtcctacaggacaaaaaactgtaacctctgtggttatcttttctacccatcattacttgtatctctgccagacagaaatctgtgaattaacatgtaatgttgttaagcctgaaaccatcattgagtagtgaatagtacattttcctagataattaaataatctttgaattgacaagttaatgcctgtatacgacattgaaagaacatgcaacccacatttttgtcttattttcaagttttgaaccttttttcttagtaatataatgaaaatcaagttttgtaaaattaaataaatccaaagacataaaaggtaagcttttaaaaaaatagatggaacaggtataacattactatgtcacattgctttcaacttctgtactcgtcatgggcccctaacaagaggttgggcattggtctgtggaccacacatttagtgttaagataggaataacttaactccaaataccttccagtttgggatgtctttattcaaattcctggtagagaagctgattggcctggcattgggtcaagagcccactttgtggtctagcagacaggtatcatgtttggaagcccattccctaaactagggactgtaaacaaacaaaaatcagaagcatccatacagttactgagtttggagaggtagcccaaacaaggggaggacttgggcagtgctgagctctgaccatagaaaaaaagtatctgggaactatctcaagcgtcatttaggctcccccatttcaagcatgcacccaaacagctcatatactatacagtaaatacaacttctcaaagtagaagataactggtgttaaaacaagactacatttatgagaactcacttccataagggcaaatactaccttaacagaatctcagcaacattccagaagatggaagtcagaatagatatttatagggcttgtagggagggtatagcctcaagcaatttaagataggaagatgattggtattgggtaaattcatgacatcttgatttaagattgttagacatagcaagatgagtttactgaaataagtctgacaagtaggttattgtttgatagatgagctatttatctagctaaggagactgttgtcccagataaattgatatgcatggattgtccaaatgaagcagtgaaattgttcctggtttagagccttatgtttcgtggacaaaggtttctgtgaacaattaagtcaggttgacgaaggtgatctcagttgttggtcttaagcactacgccatgttgatttaggtggtctgaattctcaggacatggtagttcacatttgttccatgttagcatttcccaaacttctgtctgtggaacactattctgcagagtggtaacagcaatgcaatggggggaaacatattttgaagttaagtaagtttgggaaattctgttttgttttttaatttaaactgtaggccctctcaagtctttatgatgtgaaaatgcacagtaaatattccagaaagcatgcaaaaataccccagaatctaactcctttccagtctgaagagctcctcaaatctctcctaaagttacttgctttacacacagccacctctattcatttttttttttttaaatttccagtagccagtgtaacctgggggccagggaagacctgaacctctaggactcaaaccctgtcatgattcttgaggagagaggaaggtggaaatacatacatacacatagacacacacacacacacacacacacacacacacacacatatacacacacacacactctatatatgtatatatattctcattctgctaaactaatcgaaagtaagatatagtaaaatgtttgaaaatacatatgtgcagctttgaaatgtcttcccatatcataatggctgtggaatcagcctcagaagccagattgtctgagccccaaggaaacgtcaaacccctctccctctccagtagcattccccagtctgtgtcacttagacgaaaaggatctcagggtgggtggcaatgctccttcactgaaatctgcagttatctctacccaaggcttacagtaaattttttgcaaattagaaagccctttgctctctcagtaaaccctggctttcaagatttttgttttagtaaagtctttagactaaatgttgaatctttcactctctttgctcctaatcatctctaagacagcaaatgcctctagcaaaaaagaggagacgtcaactgggaaaatttgaagagaaagtcacacagatacatttcagtaaggttgtctctgttacttgaggcttacaagaaggaaagaattccctctctaaacacactctaaacacacaggagttgagaacggggagatttattccagaaccccttctgtgcgttggggcttctggtagcttgcctttcttggtaacgattttctcagagactgggtagattcgagtggagcctggggcatggttgttggtccaatggcgggggttggggagacacaagcagttggcagggaacttacaaatctccaggaggttattgagaataaaaattcagatattgccatcttttccatttcaaagcaccaagagtctgtcatcagcaattgtgcctttctaggtgtcacctgaatatctaacattgaggcattgaaagatagatcaggactgattttactgagcattttcaaaggcagcaggcaggcttttcaatgctgcatgagatcctcaccttctctgaggtgacaggggcttctgttttcttgagtttccctgtttgctgatgtcatcccctcctaccccatgaccatgacaccaactacatccatgatgtatatttccaatgtgtttcaacttatggtcagctcccaccagctccatattctggtgggataagcaagccttgccttgagctttgcaggctgggcccatggttgtggacatcacagctctggtcctcatagtattggtggcaggcagatgcccagctctggcacctgaatgcttggatttggatgccagctctaatacttactagctctgtaacctagaaaaagctccttagcttctctgcactttaggtttcttttttaaggaacactgaaggaaaatctgaggctggtacagtctctgcttggcaaatggtggttatttctatccattaatgtcatctgatcatggcccctcaaacctcactttgagccttgtgagcaaatgatacatactgtttatatatatattttcctatatatgtagaaaaatatatattaaataaatataaaatatataatttaattaaatatatttaatatatatttatagtatattaatatttaatatatactatataatatatacatatattgtatattttatatacaatattatatattatatttatatgtaattgtatatttatacataatataaaatatctattatatgttacatatatttagatataatatattttacataaattataatatataataatataaccagtatgtttcattatatataatatatagatacatactgattatatatgagtatataacatatttacatgatatataatatataagtatataaaatatgaatatatattatataatttataaatatatataaattatgcaaattatatttgtgaatatataatagatttatctaaatatatgttatatttagctatagaaatatatattatatatttagatattatagaaatatataatatatattataacatcagtatgtatcattatatatagatccatacagattatatattaatatataatagattatattaatagatcatatataatcatataatggattaatagattatatatactatttatgtaatcagtatgtatatatattatttcaaacctcactttgagccatgtgagcaaatgatacatactgatcatacctactgatcagtgtatatttcagtctctttgtatcgccctatatattttccactttgcaatgagaggcctttgcttctcaagtgcagcgtcctcatgcttctcccacctgaacaaattattaaccctgtaaaccggctttcagcaagctacgtggatgaggggtctgaaggtttttagtttcttattagactgtctctcgtttcacttacatggtacccgctgggttgattgcttcatatatcggtggtactaatgtggatattgaatgtttcacctgccgagggccttcatctaattcatactgagcacatagaaaggtgatttgaatgggggcatttgctctgttattttggtgatggatttagggaaatggaaagtagcaaattgctttgtttttggacctttgccaggtccatcctggttatggataatacttgcttggttgattgaagaaggccagctgctactctaatagcccaagtcaatggccaacggtgcctgattagcaagcctgctatgcttactgtagtgaaaaacatcttataattataaattaataccctttctattatacatcaatatgctggtatatttcataagttggccagcccttcatgactaatattgatattaaggtcaactctagttttatgataccaaggcaaagaacatctttaagaaaatttagatacaactcctgactttgaatgagggaattcatactgagaacctcagtgttaccatttgtaaatcagattaaataatgcccaacatctggggctttgaaaaccaatgggataaactttgtgagaacaatttttaaagcctttagacattaccccgtggtgtctagtgtctcttcatattttcctctgggtttatcttgaccctttcaaatggaatgcgtggatgccattagtatttataacattcattttcagtgctttagtattgtttttttctttattgttgtgtaatatgtatggaaaaggcatatagcaaagggtgatcaatggctgggcttatcctaatctttgtgcatgtgcttgggtgtgtagaggcttccgttcgtgtctctgggccatcttgcataggggttcaagctcccatttggatgccatgggttgaagtctccggaaagctgacctcagatgaggattggtgtgtaggaagtttattagggagtattctgggggtcatctgctgtgggagggaggggaagaaagctggagtctgacagtcttatcaaaggctcagtcaatatcacagggactctgaagccaggatggctgttcacaatggtcctgagttggggcaagggagccaagcctgtataactccattacaatctgtttttggatgtgggctgtgggaaggagccatgaccttagaggaaaagactgtctttagccaaggtaacccatagaggactgacaggtgaaggctgtctgcagaacctgggaaacatagtccttccgtcctgaaaaggaatacaacaggcacattacagaattcactacagtcatctagaaaacaaagccatctggtatccatggagacagcttccatagtcactattgcccttggagacagacacccacattcctagtgtggttgcctgacagtggtgaggaggagggggctgactatctgagtgtccccctgcgatacgatagcatgtcacctggttcatgacccccacacccaggtctctttccagagctcacccctttttgaggctggcaccaccctggacccaccaccagcttctgtggcagtgcttactctgctgtttaacctgcagtactaattcctgtctttcaagaactctgtctttcaagttccccattattaactttaatgtatgattatttatgtgtatctattcatgcatctatgtttttattaatttaggtatgagtgagtcctcagctcagtctgattcacatcagagcttttttaaaaaaataaatatcaggaatttttagagcatgtaaattatgattcaattcacacttgtctttttatgagttactgccatggtgtgaataaagcacacaagtgtcacaaagatattaacataataataagcattaatctccactagtagagtgttactaggcagggttccttccagctgccatatcaggaatccttccagcctgggtactaatgtcatcttcctttggagaccaggcatgaagagtcactcacttcctgaagtcactgggactgaaatccaggcagtctggctctagtctccaactccgctgccaatgaccaccagcattgcaaacccgtacacatgcgtatcaggcagacctggccgctggcaggcaagctaaccagctgtgaaccatggtcaccgctgcagggtagggctcgatgatcagaatgtgttccttcatttcttaaccatgctggaaaaagtatgtagagggactaagggtgtttttattttctttggcttttttccttccttccctcccttcctatcacccttccttctttccgttctccctttttccctctctctctccctttcttccttccttttagaaaaaacaaacctaacagtatgtatgtctaatacatacaaaatctggtatttaattttaaaaatttattcatacgcttggtaagatttttaccaagccatttggttttttattcactctctctgatgtggatcatgcctattctccttcttgggatattaggagaaaaaaaggatactatgattttcttaaaatggagctgtttaaatgaaggaagcatgtataagcctacccctttaatgggagggttcaataaatcctagaatttgcctgtaatgtgtagaggtctaaagagatttgtcctatgagaaagttcactaatttcaattatctgggttttattatcaccttctaagggttagagagacaggattttatagaatgccatcacctgaggctgtgacaatggggtttcacaccattaaattcagaaagcataagagaagagataagaaatgagagggcttgaagtgcatgccagttccgttgtggaaaatatgacctactaagcagctatgagaaatgaaagcaggcagtgtcatctcatgatctattgctattgtatgtgaaatgctttctatattagctgttgttaattaccatcatccccaccatcacatcattgtatttaatagcaggagaaaggaagcagctgttgtaggcaaagctctcacacttgagtgtctatcagagtcacctgggggaacgtgtgcaaatgcagattgccaggccctttgcctagtggttcacaatgagtatgatcaggctggaacacaggaatctgcatgttttccatcgactatctcagctgattctgattcaggtggtatgaggattacactgaaatagcaaacccatgctttgtctcctgttagtctagacagtaggcatctttctgttacctcttgggtgtaatgtttagtttaaatttcagttcctcatctctacgagggagtcataaatttgcatcttgctcacagagctgctgtgaggattagctgagctcgtgcccagaatggagcagcctctaatatttgctgtgctgtctctagagagcaacagggaggcatttcatggtcttccccatcttggtcctcactgtatctttctgtccttactctgtgcctgggacagctttagggcttaatgaacataacagaatgctgaagagctcagccactggagcccagctgcttggatgcaaatcttggctctccaacttaatgcctgttcatgagcaagttatttaacctcctagtacctcagtttcctcctctgtaaaatgggcttgattatcatacccccatcataggtgtttttttttgggtgtatgagatgaattattatgactacaacacttaaaaccaataatgaagtgccatgtagatgttcattaggtgaataaatacaaatattgttgattgaatgcatgtctgcatgcacgctgtttctttccttatgctgtttctttccaacataatacagatgtattctactagctgacagacttttaaagtagaggccacttttaaaagcctgggctcccatgagaaggaaatctgcaggtataagatgggtttgtcagtcagcagaggcatgctattgagaaaaggaggcaacctggggagggggtgttagaagagagcttgggattcagttcttctaaccaggagagctgacaagtaacaaaatgagactccttctgttgtctgttgcagtagacaaagcaagatgcttagttaacagcagcaacccagtgcctgtaattttcaagtccttggaggcacaccatgtcacccaaggtaagccaggggacacaggagggaagcaagagaagccagggagaatctatttcctgtgtcccctgtaggtgtttgactcacctaaagttaacactaatagaacatttgctcagaaatgtcatcgctgaaataaacgtgttaaatttaaacttgactgccccaattcatctgttatgcaattgaactggaaacagctcagacttaaaaggcatctccaagtttttctcagccaacaagacttaggccactttgttttctcagatttttcagccttgtccaatttttggataaaaatcctttttgaaaacttcagcagccatattattttcttctccagtcatcaacttataacgtaaagacaaagctgtggggaaaatctaaagttgcgtcaaatttttattttctagccagctacagctctagtctaaagctctttcttttggggagaaaatcccatttgcacatttcctcttagttgggtggacttacccatatatacttgggtgacattcaggaggctactttgtgttttggctgtgtattctaatttttcttccggtactatatacagcaagagaaggggatgttgttcagctcttgttctacctagaacccaactgcacttttgcaagagatggatacaaagatggatgcataatgcatgatagtatattatgagcactactcttatggctttgcattgtaagtaattttaatgtaaaacatatttctatagtctggttacaaaaacaaaacattttagaaaatttggtcattctcctgaaaacagcaaaaagaagaaaaaaaatcataaaagatctgctgaaaaataatcagttttatgttttttctttcatgacagcttcatccatctatccacctatccattcttgtagctctccatccacccacccatctatatacacctcccacccccccacccactcattcattcatccacctacccatccatccatccacccatccatccatccatccacccatccatctatccattcatccatccatccatccatccatccagccatccatccattcacttatcctgccttgcatcctaccttctatccatctgtccttctaccttttcttctatctatctgtatattctttaatctatccatccattcatcctgggaagaaataatagtatctttaaaatgtagtgcattggttacaagcacaagatcttcagtgaatcattttgtgcattcaaattctgtctgtatgtatcatgcactttctatgtaaccttgggcacgtttttatgcttctatggccttttcagtctttaaaaaatggggttaataatagtgcctacctcatagggttatgtcaggatttaatgatataatccatataagatacttgacaaagtgcctggcatagaggaagttctcagtaaatattagctgtctttatcattattatcctcttgctaacttaacagagttttcaagatctggtgagaaaacatgtaaaagatacataatataatgtctattaaaattataattataaatgcagtcataaatatacacatgtatatttcatttatgttactgatatccatctgtttcatcagctcattttaaaggtttctttaatagctgaaaaatattctgtagtacaaatatttataatcaaactgttatagctattcatttagactatatcaaatttctgttgttattaataatgctgcagtgaacatccttattcagttatttccttagattaagttttcagaagtgaaattggtggttacagagtgtacacattgcaaagctgaatcatattgccacagtgcctggtgtttgcatttccatatggttttgatggccaggttttctgcactattgccagtgtatgtgttatcactgcaaacgtttgccatttcggtagacaaacatgggatgttattgctattttattaacttgtttttatttgatcaccagcaaagttaaactttgccatgtgttttttgaccatattcatttctgtttcttaaaattatcaacttagaatatttgtgcaattttttttttttacatgtggagcttgttcttaatgattctgccagggcttaaaatttttactttctaatgagaaagttttggaatttactcttttccaatttatgaaaattggacaccggctccatgcactgttctaagcctttttctgtgttctctgtgattccttagagcttactaactgtgaccctccagtcaaaaccatgtttaaccaagtgctgatgggcttgagtccattcccaagtgactcggaagttgcttacttccctacctttgagtgggtctcattttatctccgtgatgttttccttgtccttctaagtcatattcactctgctcattgaagaaaaatggttggtaattgtagtggataactactccattctgtatgccttctatgtcttttcttgatgtgtgcacctctttctttatccttatttttaaacttgtgcttattagataggtttctgtacaaccatatctgtgtaggtttctcaccctagaagcctccttttaaatagggcaaagaagctacctaaagatttctctttaatatagggaggaaaccactttcgaacttgtgcccaaagatttatcttcaccaatggtctaggacagaggtcggaaaacttttactgtaaagggccaaataatacatactttcagctttgcaggccagctggcctgtgttgtgactactacacaaaagtagtaagagtctaatttggcccaggagtttgctgattcctggtctaaatgagagtaaagaatgggaaagggaatggtgtgggaggaataggcattttcattcattgttgttaatgagaaagagtcttcaaacaccagcatgcccctgtgggttggattaggttagaaaatccttggaggactgccttttccaccccagagtcctggagagaagaatgcagcctgacaggaaggatctgggtaggtgacatgtggggagaggattaaaagaaaggagggccagtggctcacgcctgtaatcccagcgctttgggaggccaaggtgggcagatcacgtgaggtcaggagttcgagacgagtctggccaacgtggtgaaacctcatctctattaaaaatacaaaaattagctgggcgtggtggtgcacacctgtagtcccagctactctggagtctgaggcaggagaattgcttgaaccctgcggatgagaggttgcagtgatctgagctcgcaccactgcactctagcctgggtaacagagtgagactccgtctcagaaaaaaaaagaaaggagaagagtgtctcaagggtttttttttccagcaggtgaacccagcctccctagcaacccaaggttaagaacgtgttgaaaacagcatggaagcccattctggaaagcagtggtgattgtgattctgaacttaaacagcttcccttaaacacactgttacttcagaaaagtacggttttggccaaagggctgtatgtcaggtatttacttgctcatcttggtgggttttgtttgtttttgtctttttggttagccatctaagacattatttttctgagatccaagttccaaaaagcaccgaacaaccttttgggaagaaaacatacatagtgtgtaggtgctaccgatttgtatcctctatgaccttgccatagaaaggcaaatcagacgggcgctcccattgcctcattgcaggctgccattttcatataagcttcatgaaatctgggagaataaaggcaaaaggtttgatctggctgtgacagggaatattgtgaagctgctggactgggcctgtgggttgcctgtgactgtcatcaagttcttcttctctggaggcttcaaattcctcctctgtcaaatgaagggactggactagaaacagaatggcaagtacagggcaaatgccccagtgctctctgtccctgctgcctctggcagccacttctgctcccccacagcatctcctggtcgcctggacagaaagcctcctccatgcagcactgctccaggaactgttctcagccattaaagcagggttcagaaaagcttggaggaagatggccttgtagacctcccctagcactgaagttctgtgatgcttagcatatgtgaaactcaagtttcttctgttcctgaatggggattatttattgccttggacagcagccctgaaacttgatccatttagctgcccctaagtgtagttaagccccgtgaaatgtaaacttcgcaagtaaatggaccattgccatttgcctctgtcttctagatgcaattgttttctatagtctgtcttgtggccggttataaaatgtctgtcttgagcaagctggggaggagggtggatagctttcgatttgcccaagtttgttaatgtttcattgcttggggtgttttaagatcctgtgcctttaatagatttcctgaactaacagtttgccttatttacttccctgggctataatcattattgtggctgaccatgttgataagctactctgtgaagccttctctaatgaatgagagtcactcttcaagtggttattccccttaaccttattttcaatcacagaaaatcattctcacagaaagtattctttccttttgttcaaaaaatacccccttgaatgttttaaatgtcactgttttttcagttctaaataatttttaattggtttttacatgaagttaactgtagcactcttgattcaggaaaattgtgcttgtctgtctctctattatctctctctctctctctctctctacctacctacctatctaccaaccaaccaacctatctaaaatctatctataatctattagtttttcttgcttcacaaatgacttaaggcaactcgctttcgggttgatggaagaaaaaatacaagtagcaaacttggatgaagttggaagaaacttggcacccactgtgtctggcatgtgcagatatgagtgatggtctataaatttaggatcttattaacagccaaagcaaagagtacaatttttccatgtatctggtttatagtatccacaggatacaagcatgctggttgatcaaatgttgcatctatatctttgtgattaacacctgacagatatttctatgatgcgttctgacagggttacacatgacagagttggctctgtctatgttgtacttaatattattgtagaaagaaaaattgagtatatcttgtgaaaaatagttccatttgaaagtccatttctttcaaattcaaagaaagaaaacaactaaaatacgtaagtctaaagggcatggttgatttaggattttcgagtgggaagactattaaaagagatgcttgctcaagagagtatagactcttctttggaaattggcatgggccacagacctccataggtaatacatttaaaacacaaatgctttttggggtactgtctcccagtactttgtttttgaagatttgtgactacatggtttcagtgctatatctaataaaactggcttcaaaacgcagagcactagcattttcatatgtttcagtaagtctcccagccttcgtgattctagagacaccaatcagttgatgctagctgcagttgctagagattccttcctggaattttgatgtaggcttgtaaggagggaccatacttaacatggaaaattaatgacctgagagcctgtcccaaaagaaatgctccaggcaggagatcttcaacaatagccatctagagtttcagttatctaggatagaacagtgtataggctggaaagacccagccctttcagtaaggcatgtgagtttgatcactcaccaccatctccagcctcagccttcttggaaggccccagacttaatggtcatttccaaccctctttaaaaacgattcctttgctagagtcggaataaataattgaggcaggcttctccagaatctcattggtgtcagctatggagtcatcaacagatgaaattattccatcaggatagtaaattaaatggcagtcttagagtggagttttcaaggtcttcttacatttgtaacatttgttgtcctacatagtcttcatacaaactataaattgagcatgagagacattctttttttttttttttttccaagactaacttttgctctgtagcccaggctagagtgcaatggcatgatcttggctcactgcaacctccgcctcccaggttcaagcaattatcctgcctcagcctcccgaatagctgagattatatgcatgcaccaccacgcccagctaatttttgtatctttagtggagacagcattttaccgtgttggccaggctggtcttgaactcctgacctccagtgatctgcccaccgcagcctcccaaagtgctgggattacaggcgtgagccactgtgcctggccggcagcaattcttttatatacttggagggtaggcacttgaagcccagaaaggctaaaagactaggacattaagtcatagaggagggtttttttttttttttttaagttttgttgttggtcgtgatggtgttattcaattcttttattatctcagaactcatgtcatactgccccagcctctgtatcagcattatgtagcaatgatgttactgagcctgatctctgtaagaggctctgaataaaatgagttccatgctggaacttatgtggagaatctatgttctgtatctctcccttggggactcttaatttcctgggtagtgaagaggtcctctaagaaagaagcagatttcgtggaacccaggatttcccatcctctttttatctgcactgcattttaggagcttttaaatttctgttctggagttgggcatctcttcaaggttaagactcaagggctgtttgtattcctcttggatttgcctacatttagcaaagcagaaactcaacacattgttgaaaatactgaatttcactgggcatatattttgggttgtctggaagatcccacctattgagtacactgcaccatcacccctccaactgctcatgcacttatcggacatatgttgttatttttggatcagaaaataccatcccagtagaagtaggagtgatcagtgtgacagagagctgtctgtattgcggctgtaaatgccagtgaccatggcattgagcagaccataggttatacttactgtcgtggttctcacctaaagtacacatcacactttgggtttccataggaccaggcaacataatgacccacctgaagatgaaatgattttgaaataccaggcccttatcatgggctagggacagtgtggacattcatatatgtgaatgctccttaaagcttccctataaccttggatactgctggtcacgtgtcccttaaatatagatgaggaaattacagctctgagacaattgttgttggtcagtatccttttgatcctttgtttgtaaatcttgcccagttggggctgcatgaggttgaaagctcagactgcttcacttccaacctcagctcgtccctttatgaagggaggcagctcaactgcctcccttccaacctcagctcatccctttatgagctcatagccttgggcaaattacttaacctgttggtgttcagtttcctcatatgtgaaatgaaaatgatggtatcatttcctcctaatgctgacttgaggattaaatgagttaacacacataacgcttaggatggtggtggacgtacaaaacactcaataagaatttgcttttgttattattacttgttcacatctatgcagcatttgtgcctgcatgctcacacactctagtcttacgcagcttattcaccaacattggttcgggatgacatttgactgttttcaaaagtcaaatccacttttcatggacaaagattttccttcataagtgttattcaaaagattgtgctgtctgccctgaaaacagttcttatggaggagaccaaaagtatttttggtaaatgacagtctgtgtagagtgagtcatgtcactagatgtgtacttggaagggcaaaacagttatttcaatgtacaaattattgcctcattactttatcacataccagaagagagtttgggatggatctaagaagtataacaaaaccactgcaagttgttctgtcatttagcatttaattaaaaataactagagaaacaactatttgaaatgctcagtgtttttcttctttttttttcatgtaacaatatgtttagtgaatttttcaaattactaaaagcattcaggcagttctagaaatttgcatcttgtaaccctttagttgtttttatttagaatgttggcattttacagtagtgtcaagtatggtaattatttttcatagatattgaatttaaaagagtaatccctaaacacattttgacatttggctctccaagacaaagtttgtaaaaaaattgtgacctgtgaacggtaactttactatatacttgtttgaccattatctaagaaatatgcctttaatgaataagagggaaaaagatgaggtcagacatcaaagtccctgtaattctaatgtgaacaaccatgattcctgaattccatgtaaattagcactacagaatgaaagcaaacaaacaagcaaacctcaaacagagaaacctcaaaattactagagccaattagatattcaaaggaaaagtctcagtttttaataccttataaaatcacacaaatacatacacatatgtgttggcatcagcagttttgatagacatggcttaaaataggagaaatccaaaaatagataaaggcacttttaatatggcctaagccatagcaggaagtattaataacatgccgattttttactccaaaaagaactgagtgtgcaaagcaaaccaagaaagaaatgtggactgggccaactaatgggtttctaatcattgttaatctacaagtgtgatcagtttattataaagtgttaatttttcctgtgggtaatacttggagaaatacagtataccactcatttccaaagtgatgaaatggctttctgtttggcatgcaggaaagtgaacctctttagtttagaatatgggttggatatgcttgccaggtctgggctattccctgctgcctctgagcgaaagctcaggaagccagaacctgaatctcttcgaggaagttctacagctgacttttaatcattgggccatagcacaacacctattagctcgcttacgtctaggtcagtagaacctcctctggacctcagctactcttcccactctgcatctcgagacacttgccttctttccatgtgacttatcgctaagctcctgactgcatgaacctccttccttccactggtccaagtgacatcattcccccgtcctcactcccaataccaccacttcagtaacctcccacatgttttcctgctctactttaatccagtctacacagagagagcagccagccactatcctgttttatttatttatttttttacttccttaacagacgtttactggatatgtcctgaatcccagtcactgtgttaggaagtagctcaatccgttgtctgtacacctccatgcatccgttccttcattcaatgatgagtacataggacaggccagttttgttctccaggctggtctcgaactcctgggctcaagcaatccacctgtcttggccttccaaagagatgagattacaggtgtgagccactctgcccagctccagggcaggattaaaggattgttctcccatgttggaagaaaacagagttcaggccccaaggcaactgacattttactgggccagacagtgccttaacaataatagggcaggcgtggtggctcaagcctgtaatcccagcactttgagaggctgaggcgagtggatcacctgaagtcaagagttcgagaccagcctggccaaaatggtgaaacgtcatctctactaataatacaaaaattagccaggcatggtggcgtgcacctgtaaccccagctacttgggaggctgaggcaagagaatcgcttgaacccaggagacagaggttgcagtgagccaagattgtgccactgcactccagcctgggcaacacagcaaaacctccatctcaaaaaaagagaaaaagaaaacaataatataattcaggtagtgaaaacatcccagaaaaaaataaaataaaatagagacgatgggaagtaatgggaaggctgtagctagcatggccacggcaggccttcccagcagggcatttgagggagacagaaataaaatgagaggcaagtgacgtgaatatgtgtgagtgtgctctaaccagagaggaagactatggcgaaggccttggtgagtctgagaaatgccaagaaggaaggccaggctagggagtcgtgagcaaggtggcggatgggaaaggtggggacacagaggtagggaagggggatgatcttgtggggccttttatgccacggtaaggaggttggattgtatcagccatgatgttttccttcttcctgtcaaggtgaaatttatatgacgtagaatcactcattttaaggtgaacaattcagtggcatttagcgtatttgcagtgctttgcaatcaccacctctacctagttcaaaacattttcatcaccccaaaaggagagctcatactcattaagcagccgttctgcattcctctacctccagcccttgacatccaccaatactactttctgtctctaaaaatttaccttttttgatattaagaagaaaagacacccacacatatactcaattgtgtccttccctggcttgttaccctccctccttcatcacacttaggctcaaacacaaatttgccaccatcccctcatcatctggtccttttccatttctttagtctaacttcctgctagtcttttcttcactctttaagagtaaaggcccagactcactggttctcctcaagtggtgtgtttgttacaattgatgaacccacattgacacacaattaccaaccaaagatgccatgctttatatcagggttcactcttaatattatgcgctgtatgggttgggataaatgacatgcattcaccatcatagaaactttgaattatgtgaggtagtagatgatgaaacaaacattacatactaggaaagggacgcctctccctttttttttttttaaagaggggtgttttctgcttggttttgtccattataaactgttagattaaccatttgtacagccaatgaaatagctttaagggaggcactcaggagcttgaacacgtccacagaaattccaaggtctctccagtatcaacttgcagtacgtcaagccagtacacatgggagagccttgaaggggtacaagatcagcctcccctctgctctttgaacacactgagcttgtggctgcctcaaagccttcgcaggcattatccctcttgcaaattttttcatgggtagtgcttcctgtcattcagttctcagatcaaacactacctctttaagagctcttcactgcctactttaaggcatcaccctgttttatgttgtttatataatatttcacaacctgacattctctcattcattcattcgtatcttacctgtttccctgtagaagtataggcttcatggtgagcaatagccttattttccttgttaacgggtgtatttccagcacttcttacaacactgccaggcatattgcagattgagatagtctgagtcttctgagaactaggattaggatttttttttttttttttttttttttttttttttgaaacaaggtcttcctctgtctcccaggctggagtgcagtggcgctatcacagcttattgcagtcttggcctcctggactcaagtaatcctcccacctctcatcctcctgagaagctgggactacaggggttccccactatgcctgggtaatttttgtattttttttttagagattgggttttgccatgttgttcaggctggtctcaaactcctgggctcaagcaatccgcctgccttggccttccaaagagatgggattacaggtgtgagccaaggtgcccagctccaggacaggattaaagtgtgaaaaaattattaggggatatacctgggagatcaaatgaggtgggagttgggagactggaagagctgtcagaccagatgcaggtctgactctcagtgaataagagacgaaagaaagaaagattgagtggaattattttagactgctgtgcaattcttttttttttttttttttttttttttttgagacggagtctcactttgtcacccaggctggagtgtagtggtgcagtctcggctcactgcaagctccgcctcccaggttcacagcattctcctgcctcagcctccccagtcgctgggactacaggtgcccgccatcacgcccagctaatttttttgtatttttagtagagatggggtttcatcatgttagccaggatggtctcagtatcctgacctcgtgatttcctgcctcggcctcccaaagtgctgggattacaggcatgagccaccgtgccctgccacactgctgtgcaattctaaagaattctgggagtgctgtcagagagtacttgagccaaagttgcccatcaaaaaagttttaaattcacaggagtgggtttgccttagcatagcttttgaactaagtaactggccagcagcagcatgtggaagcatgaccttggcaagaaatgtggccacagatatcagcacacagcagctggggtagctgatcaatgtacttccttcaatgagagatctgtgaggtgcatttccatggccaccacagagatgtataagaaatattagttcaatgaatgaataatgaataaatgaatgaatgaaagaattactccttcatgttatgtttataactggctcttcctccaggttttctgcctcacttttggctctctcagctactttattactgagaatttatctgtactgtctagttttacagcaacgctgggagctgctattatccatccccattttatagatgaggaaaataagcctccagataggttatgcaacttactcaaccaagctcaacaactaataaatgactcagctctgtcttctgaagttgacacttaaagcccatacccttagctattaatgctgtacattgccaatgcaaggtggataaagacgtggagaaatactctgccctgctgagtagagtcctgaaactgcaaggggtggggaaatagcaatgaatcctaggcttaggccaggtaactaagatgtgcctttatgagtttatcttgatcatttctttattcattcatttatcattggccatttattcattgttcactagtcggcaaacatttatcaaactcctttgcatgccagtccatggactaagtgttaatctttatgcctctgatgcttatcatctgcaccgtccaatacagtaagccacgtggagctattgagcacttgaaatacagttggcctcaattgagatgtgttgtgaatataaaacatatacagttctcaaagagtgaataaagaaaaaattatttttaaaatctcatgaatagtttttatactgattacatattaaaatgatagtttttggtcatataatgttaaacgaaacatattgttaaaattaattccacccatttctttttataattattaaggtgacattagacaattaaaaatgaacatggccgggcgtggtggctcattccagtaatctcagcattttgggaggccaaggtgggtggatcacccgagatcaggagtctgagaccagcctggccaacatcgtgaaaccccgtctctactaaaaatacaaaagttagccgggcatgctggcatgtgcctgtaattccggctactcaggaggtggagacaggagaattacttgaacctgggaggcagaggttgcagtgagccaagatctcgccactgccctacagcttgggagacagattgagactccatctcaaaaaaatgaacatatggttcctattataattctcttgaattatagcactggtctcatggatgatatagatagtggtctaaaagtccagaggtttctgaggtcacagagcccggagcaaatgtctgtggggaatgtttacagaggtgggagatttcacctgggccttgatgagagcactagattttacctgatggatgaagcagggaatggtcttcccagtgaatgatggaagggtggagtagtggagagaaaagcttcatccagttatttggggctggaattctaagtgaagttgtctcaagttgggttttctaggaaacagagtctgagctgcagtttagcatttttatttattaaagtgcttgtttattaaagagtatgcttaacttcactcagtatgtagatatgggcttccctggaaggggcaaaaccttggatgaggcagctctctgcagctgaggtaattcccaagaggaccagcattcagactgtcccccaagatcacactcatcaactaggatgacaagtcctttttgaaggaccatctgaagggtccatcacagtgtccacttcagttgtctagagaaatagagggcacagtgtgccttcctttactgcaagctcagtccacagggtctcacattagctgagtgtgtgggaggaagaccaagtgtctgtgatgtcaggtgggtatttcggagtgtatataaattacagtaagggcagtgtcaaatgagtatgtgtaatgcatctacccatggtccctagagtccactagaagacaatttcttggtgtttaagagattattcttttaataattcattgatcttaacaatacaatacatcaatggtttacgcaaaagccatgttttatctgcaatgcacttctaaattgaaaggtatcataaaatggcacttaactttcagaatccttatgttatctaaagctcagtttcagatttgtttgatgataacgaatatcctgtctattttattatctagtacaagccctagtttcggaactcagaaataaatgaggcaatgcctgcaggtgggtggcacgtgtaggtgcctgtgtgtgtgtgtgtgtttgcgtgttttggagtatgcatggatttggccttatagtttattgagagcatttttgcactggtttatagtcatgcagtgaagcacctctgcatttctcacctggcccatttagtgtggacacattcctttgtcaacaaggacataaagccacaatctcctcctccaaacaaaacaaagtgaatcgctatgtgttcggtataatgggattgagaagtagagttctctttgctgttatttctccataataggcccatgatttcctggcccctggcattcaggatagtgagcatgtgcaagtgattacgagggcagagcagttgccagttttccctgtagctttcagaatgtcatcagaaatctacacgtatgggcagtgaggtctggctctcccatgtctcccctgccccatcttgattgctctctctctctcttgctttctatttcccagaaacatgaacttactttgacttttccaaatataccatgttccttaccacccagtgtccttgcagctgccattccctctgccaagagtgattcttgctgggccccttttagatcacatctttattcctggtggacagaaagaaccaggacaacaagcccatgcctgtcccaagtatagctgagtgcttgacacttagagaatgtgaataagtgaatgagcacagcataaatgaaataccacaaacaggccaagccaaataaactctgaagttgagttttacttggttattaatgatctttggcacaagagtttcagtgacttgataaggccacaagccaagtgtggcctggttcaagaagtacagggatgatacagacaagacagaaaggaaataaattctatcaaaaagctcagctgtcttgaaaaagcaagagataagaaataacttcagaggtgggtagaattgagaaaaggatttctattttgttattttccccgaataaataagccttaaacatgtttgtaagctgctgtgaagtaaccagcagagaggaagtgattgaagatgagagagagaaacagagtaattgatgaaccaacgtccccgaggagacgggagggatgaaatcaagagtataggtcaagaggcgagcctgggagaggccagtgctaaggcaggtgatatttctgcccggccgttagcttttgtgcagaatagtgaaggaagaatcaatcacttcctttctggctgggtaaatgccaagaaattctatggcagaaacttccccaggcaggagactcagaattaattgttaggattaagcataaaccaaaacgagcagggaaatcccaagcactaaatcccaggaatggggccttcatggataaaggaacttcatctgtgaatgatccaggagcccagaatgccaagggaagtttctaggttcttggagatcaagttaatgcccctcataaggttgtttcacatgagccaaaatgtatattgattttttttttttttttgcctttattacacttccagaaagagagcatgatctcctggaatctgtttagggaataaaaatgtccgtacagaagaaaaaggttgttttttgaccttctgctgacactgtcttcttgctctcatcacagcttattttctagcaatatgaggcccacaaattaggaatctccttgcaggccttcaaatatgatttacctgattaataaaatcttagtggaatagatagtattctcctgtgtgtgtgtgtgtgtgtgtgtgtgtgtgtgtgtgtgtgtgtctgatgattggggttcttggatacttagggtgcagggatgagggcaagctgaccttgtttttcatctaggagacctgacaaagatggtgggctgagatagccgtgtaaagctaaaacagaaatacttagtgaacaagcaagtgtgtgagtgaatagatcaaagaatgaatgaaactaccctctgcactctaggttctagaaggcaccctgaaaaaggcatgttgcttggggtataataattgctcaatatatttttcagtaaggaataaaagaaccaacaaatattgattggattaaatggattaataactgataaacacttacagggctgcggcatgtgctaggtataatgtattacatagataaaatggatacgaaccatataccaggccctgtgccaattgcctgcatgtaactcaaaacaaaagacaaaggtcttgccctcatggagcctgaagtccagtgagggtttcgttaaacttgtaggacaccatttccatgccttccatcagtagagcagattctctgtgcagatacttttcacacaaacaatgcctaaccatcccagaaaatctgagcggtgttagcaacctcactttctctgagataaagctgagatttcttttagtgacttgtccaaggtcacatagctattacgtggcagagtcaagactcaaacacaagtctgtctcatttcaaaacttgggctgtttgcctatatcaaactgcctttaatttgcccattttaaagcaggaaagaactaaaaggcttgctttgatggatgtgaggtgatttgttaaaagcttaagagactgccatttttcatgatatgcgtaaatgtgccctaacctcctgaagcaatataaagtggttctttatgttcttagggtattccccatctaaggtaaaaattatcaaaactactggggagaaagcttctctggagatttgccttataaaataaacagaaatcaattttgacttgttttctaatcatgataaatgaagccaggttaggagaaaaaaaaaaaaaagtcccagcattagttgaggatcattttgccaggatacattggtctttgacaagcaattaagaagtcctgtgattgtgcctggcagtgccacagctcagcacactcctgattaattctcattttctttctttcctcgggatttatttactcgtttcacttggaatgtgtttagcttcttaacctcccccacccctcttttctcacgtgcttctttgcttggccccctacaactctacctatacattaatcagtgtcatattcattactgctggtgaaatgccatacaacattggcattcattcatttttgtctcttctgttgagccattcatggtagatttccccaacgaaacctaccatgtttgttttctgtatttcccaccagatgttcttttaaaagccagaagatgtctgccttggtctggttggtataaagagggttcatccaatataaactgccaacagtaggttggaaatactcatcagtatggaaagggcgaagtctgggcaaattggatgggtcttggagaagctctaagagttggaatctacatcatcatctttgtcttcatggctagcaactgttgactcctttctctagttcaggcattctgtctgactcttacattatttctttgaatccttacaacaactctataaagatggtaatggaaaaagacaagatgaccaagattcagagactttaaagcacatgagcagtaagtggtgaaaccacctcaggcctctgcctgttgacttattcataggataacccacagaaacactaattcaaacatggtgtcagaaacagcagcagtaatgaatgcctcaatgaaaaacatttggcccagcaccttggttaggttgagtttgcatggcaaccctattgaatcatgggtttctcagagctgggagctgcaccatgccatctacctgcacctgtcctctttggaggctgggttggtgtttgaccctgtgaagagctttggattgctttgcctacccgcagtggacttgctcacacataagtgggagccctagctcatggtctccaaatttttatcctcatcgtttcttcccacctagttttttcctaattctggcccttcctggccacccaccctgccattatctttctctgacgcttaggacttgaacccttttttcatcctttttgttttattctggtgttttagtcgtgagctaactggaaaatgcttctcacagtttaattgccgtggaaactttctacttggaatcagaccctaacgggttttttccctttccttagggggctgtgcatataggaaaagggaacatatatgttatccctcatgtgttaggggctgtatagtaacaagcctggaataacccttagagcaccttcatagggaaggtagggtttattatccatgtttcgtaaataagagcactgaggttgagagaggtgatgcagattgctgaagtgcctatagctaggaagtggcaagtcacaatggggccccagttctgtctgctctaaagcccagtctgtctgtctgcttctctgtatgtctctctttttctctctccctattcttctggaagtcatagaatcctgtgattctcttccaaactgcttttttttctattaaaattataacccgttattaaaatatttaagcacacaaattaactggtgctaattatgatattttgaatggtaataagcaattagagtgagatttaaagaagaaaaaaacacctgtatataacttggcatcttttgtaataaatacaaacacctaaatataacttggcatcttttgtaataaatacaaacttttgtcaatcatgacttgatctaaccgatatgcctcaggtctgcacagaacggaaatgttttttggaaatcctagtacttcagaaggctttggcatccaaatccattgcaagtagctttctatttagtctctcattttctctctaaagagagattgatatgatgatttttagcttaatttgagagatgttgagttttctccaagacaccctcgttggttcaccttgctctgaatcctttgtcttctcaccctttgtggcaaattgagacgggggaaaactattaggttggggcgaaagtaatttctgtttctgccattacttttgccccaacctaatacctcccagcaaaatgcaggggttgcggagagaaagggagtgatgtatggagagtcagtcatagtacatgtgcaattcaagatacctgggtgggcatagtagtctttcccctggagttctatgtcattgcagcctcctctcccatcacagcataatttaagtgaagcaggtttaacgggtggtcagtatttaccagagccagccttctgcttctggccagctgggtgacttgactagcagaccattactccatgtgggccaccgtttcccatgaatagagtgcgacatttgaactaaatgaacctaggtttgtcccatggagtgcagtttctccctaaatgaacctaggtttctcccatggagtgcagtttctccctaaatgaacccaggtttctcccatggagtgcagtttctccctaaatgaacccaggtttcttcaaaattctagaggctctgactctagcagctgcaattggactcttccctagaagcatctcgctgagtctgagaaaggcacgtcaatgattcttcaagggaagtagggggaagcagaggcagtgccattcacaatgagccacggctgctgacagcagttctgtaaccatccggtgtgtttagacgggagaaagagcttgagaatcgcgattatatggatcatctctctctagatggacttcttttatgggagataatactgaggttaagaggttaagcaacttgctcaggtcacgcagcaatttataatataacaagatatttatgagtaaaacatatatgaactaattatatatctgatagtcgtttttaaggaggaagaagttaccataagaaaaagaaaaacaggacttgggtgttataccatgaatcacacgtgtgtgtgtgtgtgtgtgtgtgtgtgtgtgtgtgtaagataattttttcagcaaattaaaaacaaagcctaagaaaaatgagaacttcctgaacaaaaatattcaaaatgatgactaactagaaagtatcagaaaccacattttccttaaccagtactgtctcatacaaatataacataagtcacacaagtaagtttaaattttctagtaggtgcatcaaaaaagcaaaaagaaccaggtaaaattaattttaataatgtactttaacccatatctaaaatgtgacttcattgtgtaatcaatatgataaattattcacatatttgacctttttgtactaagttgttagaatccagtgtgtatttattttgcacttgtggcatgtctcgattaggacgagccacatttcaaatgcttagtaaccacacatggctactggctacagcattgtacagtgtggcaaaagtttctctcctttttctcttttcccaggctctgttgaaatttttctttcagaaaaatatttaaataggatatactctgactttgaaaaaatacacatatgtgtatgtttatataagtatatgaatatatacatgcatatttctatctatctacctgtctaatatctgtcatcgatctatctacctacctacctacctgtacatctatctctctagagatcttctccacaaaagcaaggaaagagaatctctgacactatattttcttaatgaagatggagaagtttttgcagttctcattatttcatttcaggctttcagatgttcaggagccctttactagaaggttgatagattaataatctccccactaagcttatagcttagcagacctccatggtggccatgatgaggattcctttaacacatgattggcccttagtccccatttctctggtgtgagttttcagcttttgttaccacatcaaagctccggcaatttgtgcaggaaaccccttgaagcaatcatgaacccacttgtactgtaagagttcttacttccatgtcctaaaagaataataaccacaaaaggatatttccttgctaatggactggggagaatggactgtgacaaaggctggtttctcattgccaggattttaatgaggggactcacctgaaaatgtctagtgcacattaggctcttctaatagtttccgagagctggagtaacagattaccactaactcaaatggcttaaaacaacagaaatgtgttttctcacagttctagtggttagaattccatattcatggtttcggcagggctgtactccctccgaaggctccaggggaggatccttccccaccccttcctagatgctggtggctcctggcagtccttggcattccctgcaggtgcatcttgccaacctctgcttccattgtctcatgacctcctcttctgcctctctgtctgtgtgtcctcatgtgtttttgtaaggacaccagtctttgagtttagagcctaccctaatctaaaatgaccgtaactttgtcacatctgcaaaggccttatttccaaataaggttgcattctgaggttctggatgaacatggattttggggaggcatcatttaacccagagcaactgtcactaaaattttcctaccaagatcccttactctagtttaattggcctcttattcaaggcctactccataagttattttggaatatagaatttcagaacagaaatgggatctgatgattgcctagttcagtggaaccctttctttaaatggaaatttagtcacagtaaaggacagaaaagaacgcgaaccaaagcttaggtgatatgtttgcaggaggaaggggtggcccacagtgacccccgctgccccctcctctttacccctcactaggctcccggaagacttccagagcatcccaagggctccacaaacccctgtttaatcataatccctttactgtagggattaaaaactactgtttagggagatatagtgaattttcccaagtcacactgcaacttgaatctgaggcttgacccatctatgaaatatccaaactgtcggtccattcatttctgcattaccaacaatggtcagttatatatttttctttgagaagagaaaagcaaaacagtccatgcttgcaattcttttcttcctttttgtaaactatgacagaaaattcatggtgaggccaaagccatgacaacacctgtgttgcctcacattgattttctgtttccaactggaggaagaggttcccggaacagccacttttgagtcaagtgtgtgaggaaggagtctctcttgccaaggactgctgtagatgattcctgcatagccagcgctgtgcagggcctccacttgagtgagcactctgttcccattctatttctcactagtattttgagtatgttccccccaaagtagagatagtatgtctttgaatgcaaaccatgggctgagccctccaaattacttttaaaaaattagcttcttcaaaaaatttttttccacttccctactgtcttaaatatactggtgcttctgccctaagacctttcaggaaaggtacatgttctacctgatttacaacaataggttattctgggtaaataatatatctgttggatttattgtgcttattattttattggaccacactatccttaacctagagaagaagcttgaggaaaggagctagggtcaggcagaagacaggtatgttttgaaataagaaaggaaaaggaaaacgtctggaaccttgacattccacaggatattgtcccatgaatacaaaaggtgatgggtagctagaacctgagggaggaggtgccttcttttggaattaaaattccagaatgttctggaaagtgccagatgcaagaccaagtaggaccagctagtaatggaaattcctcccatattgacaaggttgatgaacacatggtgggtgcagctcatggaacactgggaggtcaaaagcggtctcagttacctttgtacaatggacatggcaccccaggttaacacaggggccacctgcccagcaggcatgggcatcagatgaaggcattttttaaacaccttatttaacaattcagagtctagatacgagtacattctcattttaaatagttcagaaaaacagatattcccttttcctccttccaaacatattcttcccttagaggcaaccaacattattagtttaatgaatcactttccagacctttctctcacatttaggtacatacaatcacccctcggtatctgtgggggccaaaatccagaaacctctgtgaataccaaaatctgcagatactcaagtctcttttataatatagtgtaatgtttgcgtaaaacctaggcacattctccctatacggttgacccttgaactacatgggtttgaactgaatggctccacttatccacatgtttttaccaaatggcaaattgaaaatacagtattcataagatataaaacctgcatataaggagggtcactttttcatacacaagggttccacggggctgactgtggggcttgagtatgcatgggtcagggtatatatgtgggggtcctgaaaccaatcttctccatatacagagggacaactatactttaaatcatctctagattacttatgatatgtaatacaatgtaaatactttgtaaatagttgtactgtattttaaaatttgtattatgttttatagttgcattgttatttttattgttttaaacaatattttcaatccatgattggtcaaattcacagatgtggaacccacagaaactgaggactgactgtatatgtgtgtgtgtgtgtgtgtgtgtgtgtgtgtgtgtgtgtgtagacacgtagaattttgtgatctagaagtgttaaatataagaggtaattatgtgaggtaaataaaatgtgtgcgttaaatataacaggaatactactatatgaatttttctgaaatttgtgttttaacattttaagttgtttttaactattctttggtacggacattgtattagtctgttctcatgctgctgataaagccatacccgagactgggtaatttataaagaaaatagttttaactgactaacagttccacatggctggggagacctcacagtcatggcggaaggcaaatgaggagcaacgtcacatcttttgtggtggcaggcaagagagctcatgcatgggaactcccatttgtaaaaccaccggatctcatgagatgaggggaacagcatgagaaagacccaaccccatgattcaattacctcccaccgggttcctcccacaacacatgagaattatgggagatctcatcttattcaagatgagatctgggtggggacacagccaaacgatatcagatgtacttcgcatatcatgtatagatgagaaaacaggcatttcttcccaatttttgcccatacacatgtggtggacatttttcatgtgcaccaatatctggtccttttctgcttcctggttacaagaggttttattaataccttccctccctgccttcttggagttagctgtggccatgccactggatctgaccactgaaatgtacttggaagtagtggcatgcgacccttctcagccaaagtatacaattgccggtgttcaattctccacccctctttacgcatcccatcaaatgccgatgtctgagtcatctgtgtccctgggtgtctatgctcatcagaatcctgctgctgacctgcatgcagcatgtggcacaggcaagaattaaacccttgttgtttgacatcatgcagactttggaactacttgtcatcactacataatccagcctattctggccgatactcatagctatgagcagccttgtacatgcttctctctgcacctgtgatgacatttctccagtaatgaatgtctattgaaaagttaaaacattaaattgcttttaaagtaccttcttatccctccagcccctaccttttgtccctaggctcctctgcatctgttgactttagattttttttgtattatttattcatgttttattagataaatatcttccccagacaaaccttgaactccctggagtcaaccgattcccttgcccaagcctctggtgttagtgattgtttcattaaactctagtctcaaggctaatccttgttggaaaattcgttctgtcctataagaaggctcccaggctcctagtctcaaaccactaaacaggccgcacaggtgtttagtggtacttattggtggccatgtgacattgttatttctctttgcatatttctcatatgattcacagtgtttaaaaggattacctttttggttttggaggtgcagatttagagaatgggatttccaaagccatattgtccctttcagagcacagtgagggtgttctttcttacccagagggtcaacagtgccacaggcttgccagtggatgagtttaatcaactctgactgtgtggccagtgagcaaagaacatgacaggggtttctttgaggtgagcaatgccctccgccagaacctagaagtagggtaatgatgctgaggttggtgtacactcagaactcagtactgccgcagagtaaggcagacccatcccacctgggctgtagctcccacgatggtgagtccctagatcgtaagttgatgggaagcataagaaggtcagaaccaaaccagagctttgagcgttctctcactgcattccatagtttccccgagcgctgaaattctttgcaacttccattcatttgcacatctcatctggctgtaaggcataatgtggtctgtgtgaaaaagaaacttctgcaaaagagtcagattcagagtttatggcaacatcaaggaatagtttatcagttcagctgagtataaccacttgatttagcacttccttttcatcatgcctctcccctcatcacaaaactgcaaaggctccctgtgacatccaaagcctctttgtctttccctgtttaggaaaaagtgacctagagggaactctgcaggggctacatacggaatcttgatgttgcctcctgcctgctgtactgtcctggttaaatccttcctcttctctaactctgtgtctccatctgtaaaatggggatggtaatagagcctatcctgcaggataattgtcaggattaaaagagttaacccaaaacagataataaggggttctgaagatccaccaggagcctcactcagacaccttgatgcagacagcacctggtaaacatgggtgttcagaagtatggtccttcccttacggccccttactcaatggccatccattgtctgctgagcctaggtccctcacacctatgccccaggctcctgtcctggaatcctggcttttaccaccaaattccccaaaagccccgtgagtggctgttttgagctgagggcacctgctcctactggcttcctggagccttagacgcacccagtgctctggacctcccacaccttgttgaaccacccggcacttgctgactcctctcctgaacctcatgtgcttgtgacccacgattcagccactgtctaaccagctcttccgtgtgcagccctcagagccccagctcccacggctctaattccacggccgcccctgccgtctcttcagccatcccatcccgccatcaccatggaaacctgtgggaacagcagcttttcctcatcctcttctccccttaatctccagcccactcctcctccctcttcttgtctgtgtccttcccctgagacatgttcaaatgttgtttctgcatgttaatattttcttaactatttagtgaattcatcatggcggagggagtgagcacgaatggactctgtcatacttcacagaaattaaacctgagccagctaaatatcctttcctgctccattctaaacctttatgggtctccacaataaccagtaactccatggttgtagagttcagataatcatgacataaatgtaggaatgaaggcaaacaggccggcccttcccccagatgactggggtcttcccagctggtgtaaaaccctcttctaggtcaaaacatttcttaaagtaaatgagtgatgactatgacaggtgggaaagtacataaaataatgtgattgaaatactcttagttggttctgctccattgaccctagggaggaagaaacaactaatttgtgctttctgttattgcattgaaagagagtggtgactcgccgggcgcggtggctcacgcctgtaatcccagcactttgggaggccgaggtgggcggatcacgaggtcaggagatcgaaaccatcctggctaatacggtgaaaccccgtctctactaaaaatacaaaatattagctgggcgtggtggcgggcacctgtagtcccagctacttgggaggctgaggcaggagaatggcgtgaacccgggaggcggagcttgcagtgagccgagatcacgccactgcactccagcctgggtgacagagcgagactgtgactaaaaaaaaaaaaaaaagagtggtgcttcaaaattgtgtctttttcaacgtttgttgtctctacatggtaaaatctgaatttaggcctaattcaaaatccatgagattgggaatgggattgggaatctcattatttgcattaatgtatgagactctctgagtaagtgttggtttaagtaaatttttttcttaaaaaactcagtagaaatggaactcagattttaaaatggactttaaaatggtctaaaaagtgtttctaggtacaaaatgaattggagtttacctattttttccaaagggcaggtagcaggtctgaagtgagagagggaaacgttcgatgctgcgttgttctgggagatgtgagccgccggctcattcagaatgtgcagggatgtccattcccacaggagcatgtgtcgttcagccaggtgcatgttttaccttgatctactgtgcttggagccttttctttcccagatctaggtctgatacctgcccctcctccttaccctggactgtaattaaagggaatatgtggaaatccaggccacaactattttactttctgtgaataaggccatcaagttgatggcttgttactgtgggtcgatgggtcaaacatgaggcaatttggggaaacagcctaaggtggctataccacagaggccagcagagcaggtaaccaggcacaagatgcgatcgctgacgagagagctgctgtgacagagtaaggagtgcatggggaggagggaccactgaggtttgtctgcgtgtgggtaccccatgcgcagatcctcaacagccgttccaaggaagtagtcatttgggagatgaagggggtgcaggtagaggagtgggggattgagacagggaggggaagccacctagctagtgaggtttgtgtagcaagaaggtaaccactcggagcacctggagtttaatccttaaggagactgctgagaaacagagtggtgcacacttagggttattttactgagaggcaggagatgtagacagcgctgggggatgtagacaccacttgttaaaatctggcagaagagaatttagagaagaaaggtattgctgtgtggtaagagcaatgacttggtcaggatgagggtgggcatggagctctgaggaagggacgtacagaaaccaggacagaactctagccattatctcctttcttctagcgatctgacaaggtcctgctagatccttcactagactctagggcaggcttctacttagtacaactgataccaccgccatgcagccatcatggcccctcccagggcccatttgttagtaataataataataatgcttaagaagcattgagtcctaactgtgtgtcctataaactatcataacccgtatagtcttcataaagatgccttcaaggagacactcttattatccccattttacagggagaaaaaaatgagcctacgttcagcaattttaagcaaattttctattgtctcatgactagtaaatagtggaataggccagttttgttttttcaccttgactgactgcaaatgtctcagtcatgattcctgaccatcttctaaccctctaaggacccagacactcctaagtagttaaagagtctgacgttatcaatcaatggaaatattttcaaaaggtaaagagaaaagaaattaaagttatgatgatcttttaaggcaaatcctgctttcttgaagcttggtcagccctggcacaggcaaaagtgcatgtcatttcaaggcatggggcaggtgaaatggaacacggctgtcctggcgtccacaactcacaggagagtggagaatgtggaagttacatgctccatttagacatcagtgttctctactacaaaatcgtttctgcagttcattaatcagactctccaaatttgtttaactcattatttataacagcattaaatccagtgacaccaaacggtgtcaccatgagtatcaggaagtctgattttaatcctcagaaaatgtgttcaatgtctttccctccctcctccacacttaacagggacagtgaatggaagccagtgttaaatttgcacgatgtgcagtggtctaaactttcactgaatcctaatcaacttaatatcctgttgcctttttgaaatccagtgatgaaatgtaaccctgagacagcttaaacagaactcaagcctggatgctctctgcaaaatggtctaatttggtggttatagcgctagtattgtatgtacaatgatcaaatcctgtgttttcaattgtcctttttatggtcaatcaaggcggtcttaggatatagatttaatatcgcaagagtctaatgtaacaggctaatgcatgccctccagttacagggagaatgtctttttgtgacagtggttctctgggtacgtcttacaggcttctatttttgaacttgactccaagggccaaagcagcacattttggaaatggttttgtaaactgtaacgaaggtatctttcttcagcagcttcctgcccaaagacgccagagtgctttacaaacttatcaaagtgatatacagggatcgttttagcctctgctgaaatacaggggcccaggggggaaattacagtcattgttgaaaaatcttagattgtcaggtcgacaggaggagggagagtgtacagcacctaaaatatcctcccaaactggatggcatgtcccaagggctgtggtcttatctactgcctgctgcaggtgacgtttgtgaaaggggtcctgtgagttttgatgattgtctctcttagacatgctggtaatacagctccttgtaaagctgattcttcccttggatttgctcatctcatatcagagactttaaggtaccctctgacatacaccctctacaaaataggcatgttgcattttttggcatactagaccatcagaaggggaactgctatatcacagcctctggaatcctggctaactacagggaagagatgtctgaattatagcagaacatgaaagaaggcagcttgtgctttaaaggaggtgttcaaagcatgtctgagcagagacttttgggctctgttttaattaatactttaaaataattcatatttaaaatatcagatgtttccataaagaggaggatgtttaaatgcctccagactacattcctttttattcttgattttacctgggagtccaaagttcaattccataaagcaagcgtttatttgtcactttcaatatacatcgattgccatgcttaagatgcaatatgggctgcggaaataggttaacccacaggctcccagggcccagtgtagaaggtgagagattcgtgtaaaatgattcaaataaaaggaagaccctggccgggtgccgtagctcacgcctgtaatcccagcactttgggaggccgaagcgagtggatgacgaggttaggagttggagaccagcctggccaacatcgtgaaaccccgtctctactaaaaatacaaaaattagccgggcatggtggcaggcacctgtaatcctagctagttgggaggctgaggcaggagaatcgtttgaatctgggagttggaggttgcagtgagctgagatcgcgccacagcactccagcctgggtgacagggtgagactctgtctcaaaaaaaaaataaataaataaagtaaaaataaaaaggaagaccttgataaatgccatgatagatacattctcataaagcccagtagcatattcgggaggtttatgagaacatatcaataatttttatgtttgttaaaatattttaaacaatatttttatgtttgttaaaatatttagttgtagtttatcttaattttaattttgaagtaacagagcaggagacctaaaaaatattccctactaggagatagttgtggaatatatagcatttgtatttctacatttttatgtgacacatttaggtgttccttaaataaaatgaaattgaccaaagttctggttagtatgtagcaaactaaaattatgtgaaaatatccaaagccttaacagagctaggatattcccgcatccacactcacacagctactcactgtaaaagtgatcgttgacaaacataaggaggcaaataaaagggcatagcctttgtcttttaaaccactgtgacaggaaaagttatggggagtgggtcagtgaggaaggaagtctgaacattgctgcattcaacagagaaagtaaatgaaaggaagacgcttacaaataagagagaagaaaggaccgcattaactctaaagaaggggctagcaggtcctgtggagccgatggggcagtgcaaaagcctgaccatgctgatctccattgggtgggtccaatggaagaacgctcagggttacgtcaggaaggtgccctagttttggggaaagaacatttcaactcaggttcagaggaaaatttagatatgttaaaactttagataagttaatagacagggcagaaatgaaagaaagaaagattcttcacagggaagtcctggctatctaactgtgaaaacctgaaagatagttgagaaaggcaagagaggcaagaaggagtggaaatgagggggattcagtgagacatacgcaaagaaagggagagaataaaatgatacattcaaagaagcgtattgtgacaaaatgtgaacttctctaataaactcagtttaaaagagaacatataggccaggtaccatggctcacgcctgtaatcccagcactttgggaggctgaggcaggcggatcatttgaggtcaggagtttaagaccagcctgaccaacatggtgaaacctcggctctactaaaaacacccaaaaaattagccaggcttggtggctggcgcctgttatctcagatacttgggaggctgaggcgggagaattgcttgaacccaggacgcagaggttgcagtgagccgagatctcactactgcactccagcctgggcaacagagagagactccatgtcaaaaaaaaaaaaaaaaaaggcatgtaaagtaaatggatgcacatgtgaggagcagcatccatgacccatcacaagtgtatgggatcctaaagcttcctgacaattgcaaatgttaaataagccaaagatcacaaaaagaggtttgttttggcagttgtgcacaaacctgctgcgaggcagctggtgccctggtaaaaggtggcagagcaaatgcagaaccacacaggtgccgggtacctcctttctgtggtcaaagaaaataatcatcaccctgcaaaagggttggacaaatataaataggagaaaattgaaatccaagatagttgagaagattataagtgtatcctactgatttaaacgagttcacacctatgaaactagatgaattatttctcacagaagacccggagaaaatggtgattagaatctctgcaccagtttctgtgatttttttgagacatcctgaagatgagaggtgagtagacagcagatgggcagggccagcatggtttttgtctggttatttatttctgtggaataagttcctagaaataggatgtctctctgggtcaaaaggtatgtacactttcacttttttttttttttttttttgagacatagtgtcactctgtcacccaggctggagtgcaatggcactatctccgatccctggaacttctgcctcccaggttcaagcgctcctcctgcctcagcttccccagtagctgggattacaggtacccactgccacgcctggctaatttttgtatttttagtagagacagggtttcaacgtgttggccaggctggtcttgaattcctgacctcaggtgatctgcctacctcaaccccccgacaaaatgctgctattatgggtgtgagcccctacgcctggcccacactgtaacttttgatacatattgactaattgctcctctccagagtttgtacccaaattataaagccacccagagtatattagaggaccatttattatacctgtttgataaaactatgcatttttatcaaccaaatttttaaaaattaatgtggctttattgctcataaggtttaacttttttcatgtatttattggccatttacatttctttagtaaaatacaagtaatgttccttagtacatttttctgtttggctttttgttttatagtactcatagtaattgatatgacaagaatatcaattttttgttggcctatatattccaaatgtgttttttaaatgttatatttcaatcttactttttacatctttgtcatatggcatctttactttttaaactgttattttagattcaggagaatatatgcaggttagttatataggtaaactcatgtcatagagatttgttgtacagattatgtgatcagcctcgtactaagcctagtatccaatagttatttttttctgatcctctttctcctcccaccctccaccctcaaataggtcccagtgtctgttgtttcccctttgtgtccatgtattctcatcatttagctccaacttataagtgagaacttgtggtatttggttttctgttcttgtgttagcttgctaaggatgatggcctccagctccatctgtgttcctgaaaaggtcatgatcttgttcttttctatggctgcataatactccacagtgtacttgtaccacattttctttatccagctcaccattgatgggcatttagtttgattccatgtttattgtgaatagtgctatagtgaacatatgtgtgcatgtggccaacattttaaaagaaatggagaaggtaagttctggaaactggtagcagaacttaagccgcggtataattctgaacaggtccatctgttcgtcatcattcatctactctaaatccatgcatctctgttcattcagcaaatattgattatgtgcagtgtgctaggcattaggaaatatgctagaaaacaaacagaaataatagtccttgccttattgaaacttagagtcaaatgaggggaattattaaacacgttttgtgaattttaagagggcaatagtgagatttgtttgatagaaagagtaatatcgagatcaaaatgtgtgtgggtggggtcacgatctttgtgttagtcagggcctttgctactgcaagtgccagaaacttaaatcaaagtggctgaagcaaaagaacactgcatgcctcatgtatgcgagaagtccatgaatagggctggcttcaggcctggctgggtgtataaattcagatggcaccctccaccaggacttcgtcttcatctctttgcttggcttttgtctgtgttggctccattccccatgcgtcaccccttcccaaacctcttacatgtttttattttcccataagttctcccctcataatgcaaaggtagttgccagcagctccaggctcacatccatccttcagagaaactccaatggaaagagtctaacacagttcaaaccaaagcacaggatgaagttcacttaaatgaatatgggtcctgtgctcgtccatgaatcagtgatgtggccaacaaagacaacatacactggtgatcatgacctgggtcaaagtcaaatgcccctcctacaactaggaatggagtcaccccatctgtaaacagactgagagtctgtgggaacaaggcagtttcctatggaaaagaaaagaatgctgtctggtgaggctgtctccactgcaggccccactgtggatggtgctggtcagagactatcaggggtattaggatccattttttaatcttatattctctctcacacactctcttttttccccctctcttggcttgatttcactagttagagccttctttacaaaatcagacagaagggttaagaatggacatcattgccttgtttctgatgttaagtggaaagtatttcatctattaaacatttataccactaagtatgatgctccctgaaggcttttcagatgtgctctttatcatattgagtgagccccattcaatttcaaatttgttaaaaatcttttatcatgaataagtgttagattttatcaaattttttttctgcatcttttgagatgattgttgtttttgtcctctagtctattaattaagcttattgtattaattgattcttgaatattaaaccaaccttgcatacctttaataaagcctagttggttattttccttgaggtgtacaatccttttgataagttgtattagttttctgtggctgctgtaacagattaccataaatttggtggcttaaaacaagaaatttattttcttacagttctggagcccagaagtccaaaatcggcatcagtgggtggaattaagtgctggcagagctacactctctccagaagctctcggggagcttcatttcttgcttcttccagcttctggtggcagctggcattcctttgcttgtagtcacatcactttgatcctcaaggccactatcttcaagtatcccttttctctggtgtcacattgccttctctatctctcatagaatctccttctcaattccatttataagaaaacagtgctggcatttagggaccacctgaataacctaggatcatctccccatcctaaaatatttaattcaatcacatatgcacagacatttttttccaattcaggtagtatttacaggttgcagggctcaggatctgacatctttgggacccattatcagtctactaactatgttattaaatatagcttgcaaatatgttgtcgaggattttgtttttatattcctgagagatattggtctttttttctttagatatctttaaatggctttggtagtaatgtaataatgtaatagtggcctcatagaatgagttgggaagtgttctctcctcctatattttttgggagagtttgtaaaatactggtattatttcctctttaaatgcttgataaaacttacctgtaaatctatctgggtctgagcttttctttgcagaaatattctaaattactgattcaatttattattattattatttgtttttaactgttttctgctattaagatttttaatttcttcttgaaccagtttggtaatttgtgtcattctagaaatgttttctatttcatctaaatagtctaactgttggcataaaattattcatagcatttccttataatcatttaaatttctgtaagatcagtggtggtatgccctttgttatttattaatttggtgatctgtgtcttctctcttttatcttggttagtttaggtaagatttgtcaattttgttgacattttcaaagagcaaatttttggtcttattgattttctctgatgcatttgtaccttttttgtgtacttcaaagaagccattggcaaattaaatatgactggacaacttttcacataagtaactaggaaaggtaaggaaagacacagaatataattcaagtccctgaaggcctgtattacagaagaagacataggcagattctttcacatgccagggagtagaactcagattagtgtatagaagtttcgaagaagcaaacatgagtgttgttgcccccatcctagaacacagactctagaatcaatcagatttagaccctaattctggccttgcccctcttcttgttgtatgtattaattaaggtaatgtatgctgctataacaggtatgccttcaaaactcaggatcttaacaagttggtacttatttcctgctctggagagaaaagctcacagagaagaattttatgacccatgcctgaaagtgagaattctacttatgtgcacattctgttgactagacctaagggaggctagaaaattagtcaaatcatgtgcccgagaggaaaataaaatctctttggtgagccactagctagtctgtgccacactgtataacctggggtttaactactttttgagcttctgattccttaaatgtgagaagggtatacaggcctaccttgttgatattgaggatttgattccagacaacggcaatcaaggaaatattgcaataaagcaagtcacacatattttttgtatcccagtgaatatgagtcatatttatactgtagtctcttaagtgtgcaatagcatcatgtattttagaaagtatataccttaaagaacattttattgcaaaaaaaatgttgacatagagactcaaagaacacatgttttaggaaaaatggcgccaatagacttgctcaatgcagggttgccacgaagctgcaatttgtaaaaactgcaatatctgtgaaatgcaataaagggaagcataataaaaggaagtatgcctgtaataatttctgtcacatgggtgtgtccatactgctcagtatctggcacaaggtgggaatttgatgaacatttgttccatgagtgaagtgagtttaaggactggtgtgcatggtatgctcagaactacatttggtttatagtaagggttcagtacataagcatatttactgctgttattgttcttaagactttagagaggaataaagccagacaagaacattttaagctgaagtttgaagagtgaagtttccatctctaaaagttttcaggcaaaggccaactcttagggaggtcacagagtcctacttttgtactctgaggctatggaatctagtggggcatcagacaaaccatagtttcatttactatcttgtaacttcaaggaagccactttactttcctgagtctgtttccttggatccaaaaacctacttagtaggatagccatgaaaattcagtgagataaatcatatgaaaccagaacacagctgatacatgcagtgaagcggctcttaaatatgtgcttctttcctcttacttcgcttcctctttattttttcctggtctatgatacagaaaatcgtctgaattaattgcatttgaaacgaacattggttgtaatttaagataaagagaaaattcctaggttgggaattgggatcctggttctgcattttcccagcccttcctctctgcaaatgatcacagaattacatagtctggaccccaaaagcaatatcttctgttacttaggattcaaggcacacatgtttgtaacaattggcttctcaaaacttgtaagaactactgatgggtaaacaagtcatgaatcagttttttatattcaatcaaagttgatggagattacccaattaaataactggtatataactagtttccctatttccttttccctgtttcatagaaaaactagttatacattgcttttctgtaagaaggtggtaaatgtaaattgagaagctcgaggttagcaaaacagaagataatgatcaaaggactccatgtctatgtggttgctttatgataatgctgaatagcagccttgttcatgcagagacaatataaaagcctttccccaacttctccccctcctccaattcgtaaaagtcaacataatgttaaaacaaaacaagaagtttagaattaggatgaaacccatctagtaatacagtaatgtcaggaggacaatatcaaaacaaatatttatttactcaggtggtggttgcggttttcgggctttttctcagctgcggtgcatttgtggcttttatttctgcactgccgcttgttacttggagccattacttcctatctgtgttgtcaatcgtgtcttgaggttattctagcaccttacgaaaagccaccatccacctaattttagagcttttaagataaagcccgggagcactaggaaggtgagtgagttaccgttatcaatctggaatgtgaggtttccagtgcagtagcaccacctcttctaggtcaccatggccagcccttctcagaatacagaatgatgtaataaataatgcctgtgtgaagtgaaagctttgagcaatggaaccagctaacatctagaattttattaggcacaaactttctcagatgttctcagtgctattattaccccctcgttaaagctggtaattcttgtttttaaagcactttggagacactcattgatacatgcctgaaaaaaaaatagatgtttattttttccttaaaaacttcgcatgagactttagaaccgtatacgaataatactctgattactgaagtgggtggattttccagtctttatttttcttccattaatcatcttaagagatccaaactttccctgccatgaaatgccagacttcatgctgcaagattcccctagttgaggggaagggcagagccaaccagagcccctggccctctgtcaggggctgcctcctttagctctcagtaataccatcagctcctggcctccttatcaaagagggaggaggtgacataaaattagagaaatggcccagagaggtggcccctcagagcacccctagctggtgtttaaaggggagcagttatgacgttgttactgcagataattgccagttgagtgtggaggccctgtgttgccagtcccacccactgatcaggaaaagctggtaatcagccatggcatttgtatgctgggaaggaagaacaatgggctacaccagctttatgtcaatcagcattgccctgacatcccctatcagacttctgcttaaatctttttggctagaacaggtcatgcactagctgcagaggaggttgacaaagtgagtattcgtgtccccagccattgtggcagatgaagatcaggggaaggtttttaggaatgggtatggcatggccaacctgaacactgcctaccaacatgtagacatgatattggctgggtattaaaggaaacaaacatgtcagacagccagaaatggcccacagcccatgaatttaaaacctctacctaagagcagcccattgctagctctcgcaccctctctgcccttgacctcaataatataccatatcttgattcactggctccaggtctcctaccaccgaggacttgccttactttttttttgttgttttctccatggagtccatctgttggaacattctgtctacaaactccttttgttaggtaataatgagttttcccattttaaaaaattcagcaaagactagcagagctgccaaccagagcctctgatcaacacaggataaccagcaggagagttggtggaattccagacagtggtaagaaaaaaaataaaaataaaaaagacattttaattagtctgtgcagctttatcttgcataaatggatacattccactaggccagggattcctaactttttctataaaggtccaggtagtaaacattttagactttacaggccacagggtctttgttgcaactattacttcttgccattagtgtgcaaaagcaccctagacaatatttaaaatgaatggacatgacagtgttccagtaaaacgttatttccaaaaaaaaaaaagaaaaaaaaaggccagaagaccattgttttgcagatctcttgcatgaggcttttaaaggtattaaaacattttcgcacccctgtgcctgttttcctgaaagtttagagatcctgagttggaacactgatttgcattataaaccttgccctgaacaattctcagcctgtccagattgctaagttctgcatgacattcttagtaatgatgtccccactttcttccctctgctctgaagctcattcttgttgagcttgatggcattttaggcttgactttctctagaagtcttcactagattcctagaagagggaggcacagaagctcacaagctctaggtacaaaagccttgaagctttcgagaagacagataagccaggaagtgattctagctctgctgtatatctgtgtaaccatagttattcacccaacctctgagcagtgtgaggcatggacaggaggacttcaaccaaactggggttttcatctcagccatgttcatccaggggtatcattggtccattagtgatgaagatgttgtattaatactttactatgtgttttattccagtgtccggttataattgtataagaaaccatcataaacttaccatcttaaagcaataacaatcatttgttttactcacaaatgtgtcatttgtgagggctcaatggggactattcatctctgtttttcacggtgtcagttagggtagcttgaaggctggggtaactcaatagctggaggttgggctcctttattcattccttaatgtgcttggtggttgattctggctgttggccacagtatccacacatggcctctccacgtggctgcttgggcttcctcacaggatggtaggtggtgccaagagtgagcatcccaagggaacaaggtagaaatgagtgatattttatgactgaggcttgactttaccatattttatagcagttggggcagtcatagattcccctgaggtcaaggagacagaaaataaactcctactcacggagagtcatgtcaccattaccttgcatcgtgagcatgagagatgtaatatgatggctattttgggaaaattcagtctcccatacagaatataacttgagctattttcagcccatgttttaccatcttcataatgccttatagttgaagtaatataaggatacctcacgtgagtagaggctgcgggtatttagaagacccaaaacagatgttaaatgttcatatgtgccattttctcttcctataactatttttcttcttctttctctgggaaactccagcttacattttacttttcggcctagaaactgttcctcaagaactcttccctagtaagtgatcccatagaacgccatgtttccccatcatattcctcatcacactgtattgtcattgccagcttatgactttggtcgtgagtgataacaggtaaggaaccatgcctgtgttactcaccgctcagtcctcagcccaggcaccctgcctaacacacagccgatcatcaacaatgtacttattgagtgaatgagtgaccagtgctaatgagttactgaatattgagagaattggttggtacttcataaacaattcttgaacccttcttaaatagcagtcattgtattagatattggggctataagacatggtctagttggggagatatatggttctaataataatttacatttagtagctatgtttttgctgtgtatctctcatgcttttcatgcattgtgatggggatggtgacatgcctctcagcgagagtagcagattgttttatttcagaactatgatcataccatttgtactatttggtcatttttctccattcaataatataaagtaggcagtcgtgtatgtgtgtgtgtgtgtgtgtgtgtgtatgcgtgtgtaatccacataaggctttttgatgactgcatattatttctcatcattgctgtcttctaattcatttgaccagtcctgtaattgatgggcatccaggttgcctctaggttttcacttcttataagcattgcataaatgatatttcttcatgtggacccattgcatgtggcattgaattatagaaatgatactgttgaattgaagataggcccaattaaaattttgacacagaccattaactgtcacacagatttatattgccaccaggagcatttgaaagtgttctattcaattccacacaccagggatactatcatccttactcaatatctgccaatcctttgggcaacatagaatattctactgttgttttcatttgcatttctcttaagaccttatctggagaattatgttttttcaacataaataaataagaattgtccaaggtaagagttgtgtaggctctgtaaaaactccccaagtttcagtaatttacagatttgaatggataaacatccttattgttcttaaatactaaagtaagagcagatgtaagaagagcttacactttttattatatctgacattcaatgggaaaccactggaaaggttggagattggggtgaccagtgtttctgagatgaactgaaaacacttagcctcttttcttcttatgtccattcttctgtgtattgataaagcctccatttttctgacattggaatgggaagagatgtttcagtctcagtctaggttcaatattaccaaagtgcataacattatattcaatttttgcctggcactttctaagagatctctgatttgtagttgtagtgatgactttcataatctatttttggaaccattgtttgtattttttaaatgattagatcacctttaaaaaatatgctatcattccaatcaggttgataccatttgtttttaattgttcactaaagtatagcatatatcatagaaggaatgtttgtgctccccagaattcatattttgaaacctagcttccaatgtgatggtgtctggaggtagggctttcatgaggtggtaaaatcattaggactttactctcaggatattatgagattagtgtctttataaaagagaccccagtgaactcgctcgtccttttctactacatgaggacacaatgaaaagacagccattgcctgtaatcccagcactttgggaggctgaggcggggtggatcacaaggtcaggagatcgagaccatcctggctagatggtctagccaggtgaaaccccgtctctactaaaaatacaaaaaaattagctgggcatggtagtgggcgcctgtagtcccagcgactcgggaggctgaagcaggagaatggcatgaactcgggaggcggagcttgcagtgagcaaacgtcacgccactgcactccagcttgggggacagagtgagactccatctcaaaaaaaaaaaaaaaaaaaaaaaaaaaaaaaagaagacagccgttgatgaacctgaaaagaagccctcacagacaccaaacttgctggtgccttgatcttgtacttccacctccagagctataagaaataaatttctgctgttaaaaagccacccagtcaatcatatcctgttacagcatcccgaagagaccaagaaacatacctgtagaaaggagtagtcataacaaatctatagattgattagttttcacaaaccaaacacatacacataacaacactcagagaaacagagttatgactggccaccggaagccccatgccctctcagtcatattccacaagggaaatcactatcatgacttctaataaaatgcattagtttgtctctttttttttttttttttttttttgagatagagtcttactctgttgcccaggctggagtgtattggtgcaatctcagctcactacaacctctgcctcccaatataacctttgtatttttaagagagatggcattttgccagttggctaggctggtctcgaactcctggccttaagagattcacctgcctctgcctcccaaactgctgggattacaagcatgagccgctacgtccggcctgttctttatgtaaatggaatcatagagagtgtactcttgtgtgtctgtatgggactctctctttttgaatactgtaatagatcaacagctaacatttaacagagatgcaccaggtacttttctaagcactttatatatgttatattaaacataggtgtcttaactatggattatatgggaatgttttaactttttcttgaagtaactttatggtttgtatacggatgccaaatatagatacatatctaatttatctattttatttttttagaaataatttcttagaattaggaacctcttcagagccataattgcaaaaagagctccccgtcagctctctttgcagtcgaggtttgtaattattcttaaaaagaaaacatattaagatgttcttaggactctgagtagttatgccctcagataaatgatattaaactaagcacttaaaattaaagctataaagcattggtgatgcccagatatatcagtactccagttcaccctaggtgagaagggcagtggggattaatagccccctctgtccatttcctttttaggaaatgatgacctatcagagaggacataaatcactcctcttcccaaattagattaaaatcctgagctttaaaacttgcttttacctgcagactctaatgttcgacttgtggctttgtcatttccccacaggggcagcttccgctggttttacaggacagaaaagttctgtttctattactgaagaggttgaaccctctgctgaagctaattccaaacaaagtaggcaccatatcttctttcaaaagatcccttagggaataattgcaaagagatgctgtgattaggtaattacatgtgtgactctgcccaagaaacctgctttctacctaatttatactttgatttccctctctcgtgtcaaaaagcatatctagccttatttatctgactaccctgcacagaattttctcatcatgtaattgaaggtcactagaaaataatacttttttgaaagcgtgtctgataacaaacaaacaaaaaatggttagaatcactgctaaatatgaataattctattttccaatgctaaaaatgcacatctgttccagaaagacttggactcacatcctacttttcaaaatgcttcagccattcaacccttgatgctatgggcataaatgaagtttagaagttctataagcagtggggaagctagaattggaccttgaggtcccccccttttttttttttttgatgtttgttaggaattaagatggccttaggtattagtctgttttcatgctgctgataaagacatacctgagactgggtaatttataaagaaaaagaagtttaatggactcacagttccatgtggctggggaggcctcacaatcatggcagaaggcaaaggcatgacttacatggcagcagacaagagagaaaatgagagccaaatgaaaggaggaaccccttatagaaacatcagatctcatgagacttatttactaccaagagaacagtatggaggaaaccatccccatgattcattatttcccacatggtcccacctacaacatgtgggaattatgggagctacaattcaagatgagatttgggtgaggacacagccaaaccatatcaccttacaagttccatgtctagtacagagcttgaccctaagtggatgttcagaaagcatcttcagaatgaaaaggggggcacagttaagacctctggtaaattgtacgatagcttgtggggggaaaatcactgtagttagtgggaagaatgtggcttctttgcttaggacagttgtggatttactggctgaaggaatcactcacagaagtcattctacattagtggtcaaaagcatatgcttttgagtcatatagatgtaggcaaatcattttaaagattgttgctatatttttagtataagtgtgtcctgcccaacattgacacacacttattctaaaaaattgtttatctgagattcaaatgtagctgggcaccttattattgtatttgtttgtttgctttgaaatcctaactcagtcccactagtcccatttttgtaatgtttagctttcaggcaacaaccgctgaagaggtaaagagattatttttgaagagtcatgtgattttggctgctcctagctgacctactagagaaaaatcttaacattttccacaaacttttccattaaaatagaggataggtcattgctaaagaactggcagagcttcccaagacaaaacttgtggatagagtggaaactatgatctagcccgtccagtgaggtagactcaagatcaggtacataaactttactgaaaaaatgtgttttttctcatgggacgtatttacttgaggaagtatttaatcccttagcatagacctttaggttttcaatgaaaatatgatgagttgaaacatttgatatgctgatggcattctgactgatacttttcataacaaattcagaagtgaaaaataatttggtatgctgaaatggtggcctaaagtgtgaacgattaacttaataggaacaaatgtaagattccgtacttgattctaaacaatgaactttactagtagagaagttgactagtagagaatgaagtttactagtagagaaattgggaagccatgatttagtagaggcataaatgaaagcaagggttagcattttaatttaattttaatatcagtatattgacttaccaatttcatatttttttatatttttatgacatatctttgagaaaggggtttgcatgaatctttaggaaggctgaatcaaatgattcagggttgggggagtgatattggcagttacatgttgtattagtccattctcatgcagccatgaagacatacttcagactgggtcatttataaagaaaagaggttttaattgattcatggttttgcatggctggtgaggcctcaggaaagttacagtatggccgaaggggaagcaaatatgtccttcacatggcagcaggagagagaagtgcagagcaaaggggagaaaagccccctataaaactatcagattttgggagaactcattcactatcatgagaacagcatggggagactgccctcatgatccaatcaccactcatgaggtccctcccccaacacgtggggattacaattcagattaccattcaagatgagatttgggtggggacacagaaccagaccatagcattctgccacttgcccctctcaaatctcatgtttctcacatttcaaaacaaaattatgccttcccaacagtttcccaaagtcgtaactcattttggcattaacccaaaagtccaagtccatagtctgatttgagacaaggcaagtcccttccacctatgagcctgtaaaatcaaaagcaagttaggtacttcctagatacaatggagatacaggcattgggtaaatatgctcattccaaatgggaaaaactggccaaaacataggggctacaggatccgggcaagtctgaaatccaacaaggcagtaattaactcttaaagctccaaaataatctcctttgactctgtgtctcacatccaggtcacattgatgcaggaagtgtgttcccatggccttgggcagctttgtccctgtggctttgcagggtacagccctcctcctggctgctttcatgggctggcagcgtctatgacttttccaggtgctctgtgcaagctgtccatggatctaccatcctggggtctggaggacagtggcccttttctcacagctcaactaggcagtgccccagtggggactatgtgtggtggctctgatcccacattccccttctgcacttccctagcagaggttctgcatgagggctctgcccctgcagcagacttctgcctggacatccaggcatttccatacatcttctgaagtctaggcagatgttcccaaactccaattcttgatttctgtgcatctgcaggctcaacaccacatggaagctgccaaggctcgaggcttgcaccctctgaagccacagtctgagctgtaccttggccccttttatccatggctggagaagctgggacacagagcactaagtccttaggctgcacacagctggggggccctggctccagcccacaaaaccattttttccatctaggcctcagggcctgtgatggcaggggctaccatgaagatctgtgacatgccctgcaatttccccattgtcttggtgattaacatttagctccttgttacttatgcaaatttctgcagcaggcttgaatttctccccagaacatgggtttttcttttctattgcattgtcaggttgcaaattttccaaacttatatgctctgcttcctcttgcaagctttgctgcttagaaatttcttccaccagataccctacatcatctctctcaggtttaagttccacagatctctagggcaagggcaagggcaaaatgccatcagtctctttgctaaagcatagcaagagtgacctttgcttcagttctcaacaagttcctcatctctgtctgagatcacctcagcctggacttcattgtccatatcaccatcagcattttggtcaaagccattcaacaagtatctagtaagttccaaactttaccacattttcctgtgttcttctgagtcctccaaactgttccaacctctgcctgttacacagttccaaagtcacttccacatttttgggtatccttacggcagcaccccgctccctcggtaccaatttgctttattagtctattctcacactgctacaaagacatacctgagactgggtgatttataaagtaaagtggtttaattgactcacagttttgcagggttggggaggcctcatgaacttacaatgatggtggatggggaagcaaatacgttcatcttcacatggcagcaagatggagaagtgcagagtgaagggagagacagctccttataaagccattagatcccatgagaactcactcactatcatgagaacagcatgaggggaaggctcccatgacctaatcacctcccatgaggtccctcccccaacacgtggggattatgatttggattacaattcaagatgagatttgggtggggacataaagccagaccgtatgacatggtgaaatagttacaactgttttcatgaagcttttttggtctcaagatctgtgtgctatttgaataaatgagatgcagctggtttccaacgtgttttcctagcattggggtttaaagaaaaaagtaaaaaggacctaccttggaaatcatttcagaaaactgattcttaagcagtgattctcgaacttgagtgtatatcagaatcacgtatagcaggggtccccaacctctgggctatggaccacagcaggagagtcagcaataaccccctgagctccacctcctgtcagattggtagtgtcattagagtctcatagaaagtggctatgttgcctggggtatataccctggggtttcttgttgtgtaccaggaaaatttaggtcatggacacacacgaggagtttaggagtggaggtttaacacgtagaagagaagagaaagagaaacagcttcctctatagaggaagtggtcttggagcagaaaaagaccagcgggtggcagctgtgctgaattttatagtcaggtttaaagaggcagtgtctgatttgcatagtgctcacccattggttctgtcaggtatgatgtttacacagggcatgggcaaggctggtcaccccaccctaatcttatgcaaatgggctttccagttgattggcaccatcttgtctgcttcttactgtacatgtggctggcagagaaaggaagacggagctgccatcttgaacatgtctagtccttagttcctgccagcattcacctgtgcaagtctccagcttgcttgtctatgtctgcagctcaactttacattttctttgttagaaaattatttggggttgctttttattaaaaagaaaagccttaccaaggattcccatgcccttaccatctgcctgtgtaatttcttcttaactcctgtatcatcaggaacgtgaaccctattgtgaattgtacatgccagggatctagattgtgtgctccttatgagaatgtaatgcctgatgatctgaggtagaacagtttcaacccgaatccaccccacccaccaactttccccatcccatgaaaaaattagcttccacaaaactggtccttggtgctgaaaaggttggaagactgctgatctatagggtttattaaaacagtaggccccccaccttcagcatttttaactcagaagttcagggatgaggactgagaatttgcatttctaactagtcccccgagtggtgatgctactttagatcgtaacgttcatattgaaacatttgtcctacctacggatgccaatgaccaaggcatatgttggacgagcactgtgagaataggtagaatcaactctacttgagtgcattgcccacacaactgcttagtcttgtgtgcgtttagggaaagaacaggtggggagtgggggaggtacacttcgcccaaccatttgcttgtagatcttcatggactcctcccagagttcacctttgaagactaaggtatggtagtgccaagagtggagatactcctttatcagggcctctggggtcatggtcctgggctgtgacctcagcacgacatcagcacaaccaaaacaaaccacaggctggtgtttaggttcttgtcaagacctcatgcatcattaaacagagggcaactgcagagctctccattctgttttaagaaaatagaaatagtaactagcattaaactaaacccacaaacgcctgttccctcttgatagggtggtcacgctactgctgcattgttttgctttttcttttttttctgatgcagctatagtacaagccgtgactcatgctaggtgctagcctcacagatatacataaacattcacaatcaggtttccaaagctgtttccttacttccctttgttgctattttacttttcattggaggttgggcgaggcaatctttaaatgaagctattttttctttgtctctctgtccctctgtgtctctctctgtgtctcacacacatacacatgcacacacacacacacacagacacacacacacacacacacacagtctagctgaatcacgaattccgtgagaacagagtcagcatttgtatattttctcagagatctattcctaaccttaatgccatacctagcacatagcagacacacaaaatttgtgactgactgaatgaataaacatgtatattattgcaagccagttgcaaacagatatattgttgcaaacagaaggttacctgttgatccttcctatgttatctctgaactgcaggaacttcattttttctatgaaccaaatgtaggtcatcatgaatcaagcgtccataatatctgtttgtccacatataacctattttatagcagagcttatattctgatgatttgtagatttaatgttgtttattcatcatatctatcacatttgttttttaaatatttctaaacagctgattaaagtacaattggatggaggtaaaaatatttttaaagacgtataatataaaaggacagtaattggatatagttattcaaatgtaacacttaatttactttgagtttttacttaaccctgtaacaatggaattgtgttagcttacataattttcattgtttaattgaaagaagaagaaaaagaaaaagcagctgcaacagcggtagcaacaacacgccaaaaaacggaaagataatactttttccacttggcatttatttctgggaagaatgtatcttaagagcctttactgaaaagggcattgagttacacaggcaatagctttttcaacagctatttttccagaggtgtaaaaacagcctttgcctggttacattgtatatcttacctcagtaaagtcatgaaaaggaatcgtgataaggtgaatgcactcctacagagcgctaagcttcctggcgatttgacttgattcgggaatagaactcagtaaactgagcagattaaatgatcaatgtttcttttagattagccctctcaaatatcaatggtctctgccagccttagatgagataatgaggtaatttcaatactgagcttttgacagagtgtctgaagtgtaaagagtctgtggtattagaaacatgtctcagcatggcactgcccagcatcagcaggggccttctgagaggccaccgttgtccagagtctaagacactggtccagtggggacacatgagatgacatgggtttgtgtgtgtcttaattgcagtcctcgagaagagacaaggatgtgagtgtgtatagtttatttaaaaggtgcaggaagcatcagtactgcacacaagacaaggaaaaagaaaggagagtcaacgtagggtgcagtattaagctatggtaggcaactaaagtttaatcctgtaagaaaactctggaagtaatgtagaagacacacttcagagttatccatcctgaggagggagggagttcccttcagctggaggtacttatttcagtgctcttggttgaggactactcccagaaaaagggtgttgatttgggaacacttccaaccagaggggcatcacacctgccacatacacaggaagattcatcttctgtggttctgggaaaagccttcaggcacagaactgcacatcctgcaatgggaggttgtctggagcacagtgaagtggggtgcagtctgaggaatttggcaagacactgacagcatctcctctggtgtggaaaatggcattagaaagcagtggtcacaaggctgggtgcagtggctcacgcctgcaatcccagacatttcagaggctgaggcagatggatcacctgagctcaggggtttgagatcagcctgggcaacatggtgaaaccctgttctactagaaatacaaaaattagccaggtgtgctggtgtgcacctgtagttccagctactcaataggctgagacagaaggaatgcttgagccagggagacggaggttgcagtgagctgagatggcaccattgcactccagcctgggtgacagagtaagaccttagctcaaaaaaaattaaataaaagggagcaagggagagggagggagagggagagagggagggagggagggagggaaggagggaggcctgttgacagaacaatgaataattacgcacatacctaaagcgaatactcaggtgagatccccaagtacactctttcaagtatgggttagatattctaactgaagcaaatgtaaaaattgaatgttaacagtgggtctcttctattagtgtggttgtttgctgtcttctccagaatggatgtttttaagaagtcctttctcctcaccggttcccactagctgcaaaggttacccttacatccttgaatctctggattttttaaacccatttctctaatgctgcttataatattgttgataatatttgtcaccccttggcttgttcaaatatatttcattccactataggtatattcgcacgttttcacgctgctgataaagacatgccctcgactgggtaataaggaaaaagaggtttgatggactcacagccctcacaatcatggtggaaggtgaagaggagcaaaatcgtgtctcatgtggcagcagacaggagagaatgagaaccaaatgaaaggggtttccccttataaaaccatcagatttcatgagacttattcactaccatgagaacagtatgggggaaagtgcccccatgattcaattatttcccaccaggtccctcccacaacgtgtgggaattattaattcaagatgagatttgggttggggacgcagccaaaccatatcagtaggtcaaatgcaaagcctgaaatatggagaggaagacatcagtataaatcctggttccgtcacttgaatacgttgccttgagcaaattattcccttgcagaatctcagtttttccacctgtaaaatggagacggcaaaaattaacagtcacctcggggagtaattatgacaccagaatgagctaataaacatcactgttttgctcggtggtgaggttgagtccaaaccttagcagttatgattgtggttgttgctgttgtccttactaattactccatagattgatttgagttttgcaatcagtttgatgccttgttccatagtttcttttttacttccagatttggttcaggtaaagttggcaaagcaaggagagctggattcttcttacctgcttcaccttagctggttcctgcttcatacatctttcaagatgtttgtagaaaactaatcagcgtctacgtttgttttctaattttcttttgctcacacatactgtggccacttgattaccaatcagtgctgtgttggcaggcacatacaggccctattcctactaatcagagatgtgggaagcaaatgctggtgtttaaagggaacccttatttgagctcttgtcccatgactcctaattgttgtatttctcaaactcaacccagctgcaagctttattagggaaacatttattcagataaaagcctcagttatgaaagaggggtaattattttgcaaatgtgtttgaatcactgtatgctgtagtgcaactcatccccaaatggagaaggtgcacatttgggctgaaatgttgctttgtagatggacaatacaacaagcatatgacggggaacttctggcaaacgataggaaaatggtcaaatgaaaagacaccagtaaaatgagagattggatgaaaagtgatcaggaagctctgaaagctgaccagagtgaacaaaatgcctaaattccgttcatccacattcatttatttattcattcattaaccattgaatattttggggctcctatacatagtttgctctcaaagaattttaggttttagttgggagagagcaatgaaaatatgttaactgcatgccaactgggatctcccattcagtgaaatctagatagcgttggaccaaaaccctgttctgtgccttgagaatgctcagtgatatccatgacatttctggaatttcacgggggtgggtgctcacctaccaaaggtcccctcctagctctaagatcagcttctgcttatttcgttgttttgcttcatcatctttacattgcacaatccacgtgtagaaaatagcccttccctttcctttgtgcgccaaaatttacataaagcattgtgtggatagcacactttattgaaattctagaaagttgtatttggagattgtatcaactcccagtggaatattaaacacggctattcttaaatgtcctccaggcaccaggcacattttcttttgttgcttgtaccgagctctctatctctaaccacctccgagttttctttttccatccctgttcccatctctccttctcttaatgttctgcccagtatatgggggctatcacatggcatgattattctatattcttgctccctcattgagttccagtctcaagcacttatattcatacccaggaagttgttctccagaatataacagttctcttccatttaaaagaaacttccctcagtggtaattcaaggagttcttcatatatcctgaatataagtctgtcagatgcatgaattacaagtctcttccctttgtgtcttgtctttcactttcttaatggtgtcgtttgataaacagatgttctgtattttaatgaaggctaattatttatttttcctatcaggcttattgcttcttgtgtcctgtttaagaaatatttgcataccccaaggtcacagacattctccactaggttttctaaaagcttgcttttcgtaggtttcatgattaattttcatcttaagttaattttgtgtatggtgtgaggtagaggtcaagatgtatgatttttccagttgctgccgcaaaatgtattgagaagatcaccctttccgtcactgaattgcagccataaatcaaataaccaatatgtgtgatctatttccgcactgtctttccctggtctttatatttaaccttgtgccaatatgagggtggtaaattttaatcatcttcctttttatgtaggcatttaaaactatcctgttataagtgctctggtaatagaaatacagactataacacacgccagaggatttgacctaagggaagagggtcagagttggctttctgagcggatgtgccatttaggtggagaagtactttgtgcgtctgcattctagggcatgccctgcttggcagttttctcattttatgatgggtcctgtgatgtggccaatgtgaaccatgctgtatgtgcactggcctggaatagataacaacaataaaagaaggaagatgcccaagaagaagtcaaataacctcattgtaaagatgtgaaattgaggtttaaagagaacatgtgatatgcccaaggtcacagagttgatgagttacaatgctgggattggaactcaggtttcccaatagatccaccctcttcccatgaccctgcattgcctgtaggtacaaatgctcaaagttgctgagctataatgtggtgatgcttggactcgtactcagttctgtttaacttcagagtctgtgctctaccccgtatccttgattacctccttggaaaagctgaatttatttgtatgcctaactaagaatgagctaattgattcccattttaatatgacagctctgccttagcactatcaatatgtgtccaaaaaatcttatggtgcatgactaattgcactttggaatcgtatacatttaattatatatttgatttgagagtttagcatttacaattattgtcatctcccacttactgagcttccattcttccattctgattgtctctgttacagactttttttctcatgcatagagaagaaataaaggcacaatttcctttttccatatttatgtgttatatattcctttagcatcatgagccacatatgatagtattgctagatcagttctcataatgtaccctttgcaggatagactgtgaaaatctaattttggcaaaatgactgaaatcccagtgaatgattttttcttttcttatataaacctaagcatccaatagtgaaagtttatatgactcaaatggaagaagaattcatgacaaaaggtgtgattattcgcataagaccctgaaattcctttctgggtgaaataggccctttcttccttccataagaggctctgactgatgagttggcttttattaggcaatgtatgtctgatgcaatatctgtggataaaaccaccagcccctatcaagtcaatcaaatatttactgagcacttattatgtccaagacactttggagaacaaagaaatataacctggccttgcccttcaggctgtatcaattgagatagaatttggactgctgcaatcaattacacagatgtctctcaaggtagtgtcttgatgcttgagggaaacaagacaaaatgctattaataatgacttagttttctttgtcaagcaatcggcttgccacatcattgaggtaacttcacattttcttgcatcttttacaattagcagcttcagctgactctgcaacctgttgagaaagagggcccaggcaatgttgtccttggcatcttattcaggtctggcttccactgcagtgaatgcactcagatagccctttatcagctgagtccccttgagattaagtatttaatgtctcttgatctccagccttaggaaataacccaattcattactcagccattatgtaattcattactgtcattagagatcaggagaatcgtcttaggagaactgagaatacaaggcaaaccacacctttctttgtccagcatgattaacggactgtggaagggccctaatttggagttccattcatgggatttggttttatgacatcctccagtcccaggcttctggtatgacttgcagaggcattggttaacctggtggaaaatggattactactcaacgtgtttaccgatactgtgtgtctgtagtgggctttggtggactcctttatgggattgttgatctctcaacagaacagagaagttggtcaggaaggttattaagggagaatgcataagggagctgctttttctagactggagtgagggtcatggattgcttcccagggaacatttggcaatgtctggagataattttttgttgtgacagtgtggaccaggagtgggaggagaacatgactagcatctagtgggtgaaggccaggggtggtgttaacatcctacaatatacaggactgcctatcatagcagaattatctggcccaaaatttcagcagtaccactgttgagaaaccctgggtacctgcccattactgctcccttctaaaacaacacatatttcttcataggcccttgtgaatttatttgttttatttgatgagagagagaaagagagagagagagacagacagagactgatacatttgtacctatctatctatttacaacttctccattccctacttcatttcacaaggtattaggtaaagcaggtatataaataacactcaataaagtagttaagagaaattttaaaaaaatacacagggggaaatacaaattaaagtaggcagtagcaactgtagaaaatatattatactggtaatctgacagtctgacttataattgctgtcattttctttgagcttcctgagagccaaaacaaaaatagaaacagtcattatactttttgttatccatgaggagaaaacagtgtagagaaagcttttaataacacaaagacatttctcaagtagaacttaatgtaaataagtgttggcaaaggacaagatagtaaatattttcaactttgtgggccatgaagtttctgtggcagtcactcaactgtgcccgtgtagtccccaaagtgtccacagacaatatggaaacaaatgggtgtgactgtgttctaataaaacttaatacaaaaaaacaaagggtcagatttggctcttggaccatagttggtcaagcctcagtgtaggtcttcagaaacactcctggatcaagtacgaaatggatattaagatgatgtttcctaggccactgactgaaaccgagagctttcccttacagggtgctaaacgactttctgcaccatcggtagtttctacgaggatggaagaacaataacaataataacaaaatatcttcttagggcatttactgtggtgcatatcaaggattttgtgttttttttcttcgcggttgtttagttttgctttgggtgacaccccttctcatttgctgtgaagataccgcaggatgataaactccctcttctatactaagtcccatctgcaaggaaaggaaacttcactctgctccttccatcttgctgaatatttaaagggtattgacacaaggcgttttgataggccaaaagtattattatcctaaaaaatatttcctgtgatttaggcacatggagaggcaccgtgttagagagtcaagataaaatacctacctaaagactcttcctctgagtcatttcctagggacactctcagttcctttggtggccacagtttggctgtcatttcctctgtgaattcttctacgactctttggaggaaggatgtggtcttcacctttgtccttccgtatgttttgtaattctgaattttatagcacttctcctggcgtcttataactttatatttctctttcccctgatcaactgagcttcttgaggggacagtataagtctttctgatcttttgccctcccctgtgtcttttgcaacatgtagaacatactagatttccataactatttgttgattaaattaatgactagatggatggatggatggatggatacatggatgaatggagggagggagggaggaagagagggatggataaatggatgtgggagggaagggtggaaggatggaataatggaaagaagaacatcagcagcttctcaaaaatgtaagttctaacataagtagtaatattacttatgaaatattttattgatagtcaagcaccctgattaaacttgtcctatttcatcatataaaattaagcttaatcttcatttaggccaggtgtggtggctgatgcctgtaatcccagcactttgtgaggccaaggcaggcagatcacttgaggccagggagttcaagaccagcctggccaagatggcaaaacctcatctctactaaaagtacaaaaattagcctggcgtggtggcctgtgcctgtaatcccagctgcttaggaggctgaggcgtgaaaattgcttgaaaccaggaggtggaggttgcagtgagccaagatcacaccactgcactccagcgtgggtgacagaatgaaactctgtctcaaaaaaaagaaagaaaaaacatactcattcagtaacaaaacaaaatctcaaggcaacatatctgatttatggttcactaacataaatacatatgcctagaaattcactgaacgtcaaaatgatttatacatacaatcactagagtgaagttgaaagtgttttaagcagaatctgcatttaaaatgcatatatatttattagaaaggatgccataacagattggatacatacaatcaaattgttgctaataacactaggccaaagtctttataagtgcgcacgcctgtgtgtgtgtgtgtgtgtgtgtgtgtgtgtgtgtgtgtgtgtgatgttgtaagaaagtttaaggctatctcccttccttattcctctctctgattactgtcaatgctagctagttgatgtcagtaatgacaagtttgtattttaatttttaagcttgagtgatccatcacacctcaaccagagtaggtggttattcctactacctgcttggatgtcaaatgcatcagttggcaatttgtatttcttcagctttctctccctcctattttctgtgtttattctgtctatctacttatttcttacacaagagtgaccaagagtgtgtacccaggaggtgacggtcaagagtataacgtttcagaattaaaaaatattatagttgcaaactggatattttggataatactggaaaaacggaaatattagatcatgaaatcagatattatccatacttctgtgttaactacgataattatcttaatttgatgtttcggtttttccatttgcttattgtatgtaattttgacacatctgccttaattaataagaatggtacaaaattaagtaaattttacaaaaagacattttaaaagaactctttattcaaggaggaaacttaacaaatttaattttctttgatataaaatatcaaaagccataactagatattttattcaaatattaagcttgcaagtttgggagtaggggtgggaatcccactacagtcaaattattttgatgttactttccaggcttagagtttatcttccatatttccaatgagaatcagttcctcaagtggaattttatgataaactgctgaaagtagtatttaaaatggaaaccctgacaagaatgagtgtcacagggagtaatgaattcatgatggaactagttgggagtgtgtgacattttaagtgcctcatcactctgaattcactgggcatttattgtaatagaaaggaccatattgaattcatttggcattcatgtggacttcacatgtatttatggagatgtaacatggtaatttaatatttattctactaagcattctttaatggacattgaaagatattgtcatacaatgcttagtaaagccggtaactctaacgttattcttctatcaaaacaaagaaatgaaacaccattttgattcccaaagcacccgagtaagttatttggataagccaacattatgtatttactcccccaaatctgctttctaaatttttaagccacaaggttgactctaggaccaagacaataaagcagaagttcagtttaggattctttatattctaaaattgtctgcaaatacattaatctcagtctaaaaatattaggggaagattttcttggaacatcagcagtaaatttaacacatggcatgccttcaatagatttctcttcttccccctttagagttcagtttgctgtcttcatcacagtcccaaaaaatacatttgtgtttcttccttgaagaagaattatttttagaacaaacacatcattatttgggaacaatcaaaagatcaaaggcataagaatctttgctggaaagtgaaggaagagttcttcaaccaaccaaaatgacaatcttttatttttattctaagaacagagttgttccaggacacagcctaatgcaaactctgctactagtcactttcaaaatgttgtctagaatgccttgtttttaaattttctctcagttgccttctttacaccactcaaaagcagaacctttattacaaacacaccaaaaggtaccatataactaatcttcctggtttgaatgtaaccaatgttcaaatatgattgtagagtattaattattttgacatcaatttactgaacacattttaatgaggaccagaaggaaagacaaagtttacttactttcgtgatatatatctggtccagaccttgtaagtaatagcactttcaaacttactatagaaaattcagtgactgtaaacatctttcaactctacattgtgagagagttttcaaatctttggcaaattaccctgtgtaaacctccttatgacccaaagagatattttgaatgaggggatgtattagtttcttagggctgacatgaaaaagtactgggtgacttaaaacagaaactacttgtctcatagctctggaagctagaagtctgaaatcaaagtgctgtcaagggccacactactttcagagtgtctaggggaggattcggcctcaccttttttaggttctggcagccccaggtgttccttggcttgtagctgaatcactgcaatctctgctttgttcctcacacagtgttctccctgcgtctctgtcttcacatggcattttcttatatggaccccacgcatactggaataggtccactctaacggcttcctcttaactcgatgacatgtgcacagattctattcccaaataaggtcacttttgcagattccaggggttaggagttggacgtttcttttagggggacacaattcaacccctaaatggggatctcctgacagttcttaatagggtcaatatttcaatgcgtgcatttgttttttataatgatcttttctatgatactgggtgagataaaaaccaacttatttgcctttaagagcttctttgttttctgccatttgtgctagcaacagtcagagaaaactttttttttatagcaaattgtttttctcaacacattctgtctggaaaagaatgttctctagttaccacctctttggtctaagggcatctccttggtttctgtgttacagcctctttgtgttaattataagttgctttgctttacagactcaaaatgaatgttacagtgactgataaaagccaggatcctgagttcaagatcctgaccaattgggtgcttcatttgaaatcagaatctgtgttcactgtggtttacttggggtatgtgttagatttctcttggttgcaagcaaaaggaattcacaatggttagtatcaagcaggtaagaaaagggaagaaagaagattgttgaggtgtgtcttagttcactagggctcctataacaaagtgccacaaactgggtggcttaaacaaaataaatttcctgtcaatctcttctagaggctggaagtctaaggtcaaggtgtaggtagggctggtttcttctgagggctgtgaggggaatctgttcatgcctctctcagcttctggaggtttgctagaaacctttggcattccttagcttatagccgcatcatcccaatctcaaccttccctttgcatgccagtctccctgtgtctatgtctgcctctgagtccaaatctcccattttttttggtaaggacgtggtatggtttggctgtgtccccacccaaatctcatcttgaattgtagctcccataattcccacgtgttatgggagggactgggtgggagataattgaatcatgggggtggtttctaccatactgttcttgtggtagtgagtaagtctcaggagatctgatggttttagaagtggtctccctattcgcttggttctcattctctttttcacttgctgctgatgtaagatgtgcctttcgcctttcaccatgattgtgaggcctctccagccacgtgtaactgtgagtccattaaacatctttttctttataaacatgtctttatcagcattgtgaaaatggactaatacaggataccagtgatactggattaaggtctacccatgactttattttaacttgattacctctgtaaagaccctatctccaaataaagtcactgagagttagaactcccacatcttttttttttttttttttggtggtggttggcgaggacagtgaaacccacagcagtgagagagttgtatgcacatggacacaaaagagcatctgatcataaagagaaggaaaccaaacctgtctgggcactgcaatgtgtgaatctagaactctccaactgctatgcttcagcttagatgttgcgcatcaccatatttctgtgtcctgaatttcacatcttcgagaagaattttattggtccagttgagcccagataccttcccttggctcaatcttcaatggccagggagtgagggcacaggtcacaatggccatgttttgagggatgtgcaagtttgtgtgtgtgcttgtgtacatgtgtgaggattttgtcctctacaaaagtcagtggaatcattgtgagactgtgagctggcaagaggatatctccttcccccacatccctcaccccatcccaatctctggagaggaaagactgcctgtgctctcaaagaagaagtggcttttcattgattcagaaagaaatgtcagttgatatctgcttcctataaggtgttctgtcctgagctggaggtatagatacaagaaatgggtcctgatattcagctattggcatgggtaagactgaagtaggaaaggacttttcatctcctcccaagccgaggacacagctcaccatgaggtcgttgggtacgctggcttcatctaaaagaaccacatttaggttcttatgcgagaccacggcatgagctcagtccatggcaatgagtcctattttgttgagatgcccaagcaggagtttccttactgccagcatctacagggctgccatgtgctccccacaactctcccaggcttggctcaagtgcagggaggcccaggtaactccaaagagagggtccattcatcatggacccaggctttctctgatgtccataactgtctccccctggggattttgatgaatattcaaggacataaattcacacacgggctcagctgttgtacacccatgggaatcaggaggctcagtatatcttcctaagtgttccatttctttcccaggagccacagaagtgcaacaaagagatgagccccataaaccactgcatgtgtgtgtttgtcatttttctttagtgcaaggtttacaagactccctcccaacagggtcgtcatctcaacacatgtcacttggctatacgcttcactggaacattgtgttgtgctggggctgaattaaatgtgcaattactgcacattttctcgaaaggagttttgacaatgataaatgcatagacatttttccacactcagacaacgtgactccttgctcatcaagtggctcaggattcactttgaagaactggtctcttgttaacaggagaacgtgggtgctgcccgagaagcgcatgggcctgagttcaagtgccacttctacctgtcatgtaccatctgagcgtgggcagctttcttactcctgctagcccgagttttcaatgagcaatcattgcacctctgataaacctcattggctatggtatttctatatgcaaagctgagacaacacttggaaagtaattaccatagtccctggttaatagtaagctttcaatgagtgttggctagcattcatgcccgtaagttatcctcttgcctagagcagtgatggctctaatgtgagttcagatccctacaataggagaaacagtgcttgttgcttttcaaaaagcagagaataaccataacttttctacagatccttgaatataataacagtagctaatatctgtttacttattacctgctaggcaatgtgatcaattttctgtggatcagatgattcaattctcatacaaaccctgtgaactttttggtatttattttacatattaggaatcctggtgggccaactgcagcccactggcccctccaggtccactgtccaccattctctactctctggtgccacaagatgcttatctgtatgaagccttaggaaggaaaccagaagaactgacaccctgtcttgttctccctccacctctgattcctcactagtgcttctaatttactgaagccagctggaaaccagaagacaaggctgccaggtgctctgacaaaggacggagcagggtatagaagggagagtaaattcagaggactaagcaaatgtactcagcacatctgcttgtgaacatactgccagcaagtgccatttgttttaagcgatagagaattagatatcctctttgctgtactgttccaaactgcttatttctttctccttctttttcctcatagactatgatcttttgatattatagcaggaaacttggcgtgggctagcatcttggtgtaatccaacctctcttagatttgtggatatttcattgtgaaaaggtcaagataaaaaatacattactaaatatccatttatcctttattttctcatcatatacagaaaggttattgccaaatatggccataaaggttttattgctccaatttttatagcaaaaacagatacacttcttaatgaattttggtttattagatcaccagtgaccaacatggggtttctagctcttaggagaccctgatggtggcaatgaaggtctgcaagctattttaaatatttcagaaaatctaatataatcttacttttacaaatgataaagcttcacaaacaaaaacatcaagatgttttgcttttgactgaaatgatattagctctgcatggtgaacttagtaatttaattctgatcagcagctctggttggcagttatatgtgcctttgattaataaaacatgggtgagaaaataaattattacttaatctgtgcagtttgctagataaagtctttgaaaacctggagtcaattggatggaaaataatgaactgggtgctcagtggtgaaataataagcacaataccagcttggcatgtctcacatatgtaggaaagccaagacaggcttccagatgggccgagatctgataaacaattccagtcaattatttgtttttagtaataacaacgacaataataatgatgatagtaggtaacaattattaagtggccagacatagtgctgaaatgctctgcatgtaatattttatttcttccttccaatagacctaggaggaatgcactctgattatcccttatttcaggttggtctccttcagaagcagactcagacatttatgggctcagatagtttatttgggaggtaatgccaagaagcactgtagggaatgaagaaagtcagctggggaaggcaaggaaggcaacaccaggatgcactgaatggtagattgtctctgtgggcacctgggatgccaccccccttggcacgtctggggacagtgtagaacacacctttgagttgtaccacacaatcagtgaggaagctgggtattgctcttccgactcctgtttgtaattagttcagagctgctttcagggaagtcgacttcccggaacttccagttcaccctgtggaagggaaggggctgagcatgttctggtggctagagaaagccctcaggtacagagatacaggggtttccagaaagcctctggtgacgcacaaggatgtgagcacacaagaacagtacctgctgcacttccgtcctacaagagaggaagtcaagaattcatgagttgaaataacttatccagagtcacaaagcgcttgtgatggtgtgctcttccaaagaatttttttgctccctgtgtctgaaggctaccaatgtccaataatgtaccaaatgagcccttgttcttagagtttttttaaacaacagctttattgagatataattcacataccatactattcactcttttaaagtgtagcactccatggttttcagtctattcacagaattgtgcaaccgtcgccacaatgaactttagaatattttttaaatctcctggaaaaaaaaaaaaacactatcctgagtcatacctcattttccaccattatatcctcagctcctggcagccacaaaatctcattctgtctctgtttcattcccttttatggacattttatagaaactgaatataatatctgatcttttgtgcctgccttctttcacttaggatagtgttttaaatgttcatccctgttgtagcgtgtatcaatacttcagtctttgcattgccaaataatattccattgcctggatatatcacatttgtttatccacttattgctcaatgaacattttagttgtttccactttggggcgattttgaataacgttgctgtgaaaatatgcctataatctttggtgtggatatgcacctacctaggattagaattgctaggttatcggcaactctatttttaaccttttgaggaactgccagattctttttccaagcagtcttagagtttattgatgattttaatttgctgtttaattaagcaagatgcctgccttacactgtttggcaaaggagaaaaatcagcatcaggcacttgcagacatagatttccagaattcctaaaacattcaagaaggatgttatcggtacatgatcagagttgagtaggttctggattttaatgcctgtacttgctttttacttataaatgattaatactttagcttcataattatccatttagtttatgattatgggttgcctggttaaccctactgggtgtagtgatgcatgctttcatcagaaacatttttggcctgcagtttctaagtagccagattttaaagcatatacaggtggcagttcattaaacatgcattcgtttttgtttttatttggcacctactgtgaatcagtcactgtgttaggtgctgtgaatacagtggggggacaaaaacagatacaattgtgttagagaaaaataaactttgaaggaaactgcactagaagatacagcatttagtcattgctgggattctcttcattgcaagcagctactgcattccgattattcaccctgaatctaaggcaagctctgctctaaaatgtcacacaagaaagaagtggaaaacctcttctccaggaggggtttgcaatgtaaataaagagacaaagaatgccttaggtgtttcctctacctagcataatcaaatactactatgaaatatgcaagagtctgtgtcatcactgacattcagtcttggatttattttttttaactctgtgtactagacactgcctcttggatgtcccatagttcattgaactctccaagtgcaaagttaaactcaatctccccaccaacctctaacctcaacccagccccagacttttttttccagtgtatgctttctattttagcaaatcaagggtgctactcaccgtgctgttgccaaaaccacaaacatgggcatgattctcggtgtttctgtaggcttctctcacctaccctctagtcaggcaggtcttcatcatttaaccttctacttctctctgacagatttgcttctgtctatcctcatcttcatcctagatctaaaccaccattatctcttgcctgcaaccttttattcctaattctagtctttaatatctaatttctgctccaaatggcagctgaaggattattttcaagctcagatgtatcctgccacaccctttggaactcctcatggatcgttattacccccaggtttaagtccattttctttaacatatcagagccttgctccaaatggcagctgaaggattattttcaagctcaggtatatcctgccacaccctttggaactcctcttggatcatcattacccccgagtttaagtccattttctttaatacagcagcgcctgtccttcatgacccagcccctgatgccatctctggttttatctttacccactcccttagcagatgcttgtgttgagcagagccaaaccaaatctcttactatccctagaatgtgccaggttctttcacattggaaagtttgcataagatgagctttgaaaagtactttttcaataacttgtgtctcagtggatttctattaattaggatatgggtttggatgccatagcaaagattcaaatgtcagtggcttcaataagatagatgcatattactctctcaagtgatggttcaggcaggagcagttctagattgacatggtggccccactgtgtcacttagagacaaagtggagacaggggtggagagacataaatctatctgagagatgtgtaggaagctgaatctttaaaacctggcttccctcttattttatggcatttgtggaatgtatcctgtgtcctcatggccccagacaactcaccaccacatccacattctatcccagtcagtgggaaaggggaaaggggagccatatcccttctcttgaaatacacaagtggaaagttgcatctaccacctctcctcatatcttcttggcgagctgttgaccatatgactaaatctagctgcaaggaaaatcaagagctattggtctttctttgggggacaaatagaagtttctggtaattattttatgtaaaactaatccgaagaaataagtacattttccttccaaacatggcaatcctggcagggttgtgggcactggaatcacaccattttttgctaactaaacaaatttccaagtcaacaatgtcagatattggaagttcaagatagataaaggccactagtatgttggcaatagcatgccctctttacaaatgataaaatttagagaagtcaggtgcctcccaagtacccataacatgtacacgcccccctgctatcttctgaatccaccctctgtgctgaacaaacatgcagggcagtatactttagtgattaagaacaccagctttggactcagaaaggtctggatgcataatcacttattattgtgatatttacaaattccctaagttttctgagctttattttcccacaaggatgttatatgcattaaatgggataatatctagaaattacctaggaaatatctggccaatgattagcacttaagaaatgatctctagtataactataatgaatatctcttaaactttttctgctatgaccagttattgcttcttttggagacatgatagctggaaaatgtgcactcataattttgccagtgtttatttcttcataaggcaagacaaaaggagtcctgtggaagacgcctcttcactttcttcttaatgtacttggtctaaggtatccacacttgtctgagagatggcagaggtgggtgaggcaccacagctctgtctttctcttagtaaactcacagattcctaactaagtactcagagtctgctgtgtgccatacctaacctaaaatcccaattctacccattcctggctgtcagatcttggaaaagattcttgacctctcttagcaccaacctctgcttctaaaaatgagaataacttgaatacctacttaacaattgtcctcggaggaatagctgagacgcttcacctagaagtgcttaaaactgtgtctgatatatcgttcatgcttgataaatatgagctgacttaaattcccccatttaagcatgaatttcagcagaggcagtaggggtaaaaaggagaggatgcggtgaagaaaaatttagaaggcataatggaaaggacccagtgatggtccagtgtcagggagatggcccagatagaaatgtagcaaaattatcctgaaaaatttgattatttgatagaatggttcaccaagatggaaaacacagtcggggaggagagggcttgagaggaagacaatgagtaaaacgttaggcatggtcaatttgagtggtcaagggattcaccatggagatattaaacaggcattagatagccaggtctgaagctctgtagagaagtgtaagttcaaaacattcatttaggagtcacttgacccaggaggcaccagccgcaggtcacaggctccattgtcttcagggaccagtagcagtcatgtgaaaagcaggaaagagagacggttaacttggggtcaacaatgcgatgcacgccctgcccaaaggccttcaagtgcattcacctgggtgagtactcagcctgaggtctgaatggaaccttccacctgggaagatgttaaagtggttatgaacgaatgaaatctacccccaaggttttcctggtgcagaaagagaagactgaagatcaaatttacaacgtgcttagacttctacagtgttgctgaaatctacatcagacagtattttggcgaggagcaaggcttccccagcagtgttcatgatctgacagctgtaaccaatacctgacatttcccttttggatataaataattatctttcacagttatggcacatacacaacaagtaaatttccccttttatttggaaagcctctactttacaattcatgtttaccttcctgaatcttttctacatttcaaattcatgttttgtttaaaaagatgacagacacaggaaagcgttggttatggcaatataattaaaggacattcatttcactcaaacctgcatggtgatttttggcaggggagggggctggcaaatgatgttttgcctcctgtattagttttctatttcttctgtaaaaatttatgacaaaatttgtggcttaaagcaacccatggatgtctgaatggctttggttcctttctggaggcccaagggcagaatccactttcttccctctcccagtttctagaggctcacagccccttccttcattttcaaagccacaaaagttggatctctccagccattttctgagtagttacatctcctttgcactcttttcgacctccatctctaattttcaggacccttgtgattgcattgggttcacctgggtaagtgagaagactctttttaaggtcagctgattaacaacccaaattccacctgcataggttctgtttgccatataagtttataagttcctttatatctccgagtagtactgcgtggcatggatgtaccacacggttgttgttgtttttaaccctctacctgctgaaagacatctggtttgcttccagttttagcatttatgagtacggcagctatgcacaattgtgtacagatttttcttttaatggaggttttcattctctgagatgaattcgcccaaaagtgcaatgtctgggttatataattgcatgtgttgttttattttttaaaaaaacattgctaaactgttttccagagcggctataccattttacattctattgaagagttttgagcagtaaggtgatgcaatcctattcatgttttaaaaacattctctggatgatggatcaagaatgccagtagggagggcaaatgcagaagcagggagatcagaagggagcctctgcagtggttcaggtgagaggtgagagagagagtcaaagcatgggtgggtgtggctgagatgatgagaagcagtaggataagggacatatattgatgatataattgacagttgctgcagaattgtttgtggaaattgggagaaaagattcaaggaggatttctgtgctttgggcttgaggatggtggttcatgatggacctatttgtcttgataatgggaggacaggggtgggagctgacatgggaaagagatgagtgcctgttaaattctacagtggaaatcttgagtgggtggttagaaataagagtctggagccaaggggagatgtgggaagctggagagaaagtggaaaaggactatgtctataaatatgcccgatgcaaagcgtggcatagtcacaggcaaaagctatccacttgatctcaagaacaatcttttttcaccttctgggcttcacaaacaaaatagcaccttcagtttccatttcggtatagcaggtacggtaaccacaagaacgtgcaaagcagaaacaaagagcacttggcacccaagtcttatagaggctcatttctgatatcttctagggaacttctttgtataaggacgtcatagagaaggtttgtctttcatttgtctgtagcaaggtcgtaattttttttaatctttaaaaaaaattattgttaatacaaataagtctattgtgatttttaattctaggaagaatgccatacaaatcttttttagtacacgtttctgttttatactgtgatttggaggggtaaaaagggtaatacaaaatatggatagttttttcattgctggaatgttccacattgggttctgccttggcaacgtctcctgtgagctacagttgagggccaaagcagatgctccgtttttatgcatctgtcgatagccacatgactctgcaactgccactgcctccccacaccccctgagctggcgccagcacggagcagctgaatccgactcaggcttcatcccagctcacattccaccttcccgacaaggacactgaggcccagagatgaagtgggacttcccaccacaagtcaatgaggagatggggtagccaggcctaaaaccccggcctttggcttacagccgcccgtcattttcccaggtgcccacctcagaggccatccttggaaaaggaaacgtcactaacctatggttctggggaaatggagacgagagaggaagtaatatgttgttcttcttttctttaggcttctttccactgggtaaatcttctccatacataataaaatgaaggccccagatgatttgtgaaagagttgaaatgaacttcctgcaattgaacaaactattatgaagcccctactgtctttatcagcaattcacagtcttttgtccataagaataagcaggggacttaaaaaaaaaaaaaaaaaaaaaaaactactggtacttgggccttaccccagactaactaaattagaccctctagggtggactttgctctcagtatttttcaaagttacccatgctattccaacgtacagccaggaatgagaacaaactggtctatggtactgtgctaattgatcctgtctttggttctcaagttggggtgatttggcctctgcagaggataaaaggaaatgtctggagacttttggttgtcaccgttgggatgggggctgccgttggcttctagtgggtagaggtcagtgatgctttttaacctcctacaatgcactagacaacctccaccacaaagaattatctggccccaaacatcgatagtgccaaggtggagaaaccctaggcttatggatgccatgggaaacaccagttacctggatgtaaatccatggtaaaataacatagatgctatgacatgtggcccactggaagacacccatgtcaaatcccaggagccagtgaatgtgagcttatttggcaaaagagtctttgcagaggtaattaagttgggggtcttgagatcaaataatcctgaattatctgagcgtatcctaaattgaatttcaagtggccttgtaagagtcatagaggaaaacagatacacaggggagagggtgatataaccatagaggcagaaattacagcaatatggccccaagccaaggattcccagagccaccaggaggtggatgaagcaaggaaggatccttttttagagacttccaaaaaagcgtggccctgctgacaccttgatttaggtcttctggcctccagaggtatgagagaataaatccctattgtttttttgccacaaggtttgtagtaatttggtatggcagcaataggaaaccgatcagatgcctgtgcctttgtttgcaaaattcaacaaagcacattaggagagatggggtccatgagaagggataggatgcatgcaactcataaggctgaagacagacgggagtgggagtaggaaggtctagaagagaatctgacaaagatgcgggtgaaactctgaacccctggccagggcagggaagtcatgaaggccaagcaacacatccagtgatgattcttctgtcgacatttcatttctgaaaactggttgtttcattaaattttttggtttttcagatctcaaggtgtcagtatcttgtaacagtaatgagcttgattcgctgtgaaaagcaagacgtgtgaaatagaaacaaacttaaacttttaataatttcatttactaatggtcactaatgacctagaacccaagacacatatctttaaaaaaattagattagggaaatgatatataagcaaaataataatttagtaaaaggtgtaattatttttcttccttttgtaaaagttatttgtaattaacaaatgatcatttgtatatttttctagtaacacctaaaacttcctgatctttatccgtttaaccaacatgtatggtgttaaagaaacaggccaggtgtggtggctcacacctgtaatcccagcagtttgggaggctgaggcgggcagatcacctgaggtcaggagttgaagaccagcctggccaacatggtgaaaccccatctctactaaaaatacaaaaaaaaaaaaaattgccaggtgtggtggtgggcacctgtaatcccagctactagggaggctgaggcagaagaatcgcttgaacctgagaggcagaagttgtggtggaccaagaatgcaccattgcactccagcctgggcaacaagagtgaaactctgtctcaaagaaaagaaaagaaataactggaaagaaagtaccagcaaggaacgtcctttctcaatacctcttacatgatccctgtcccctacgtcctatggtttcaccgtatcacatcctcacacactcccctctaactccactttttaagtgactctgtttcctcttacattttcccatagtctgtcttccccttatataactgtcattatataactcattctgtaatgatttacttaaacctgacttccccattaggaagtatgctccatggggagagagcgcatatctgcttcgtatttcccccctaaatcctcaacacctgttacaattcccagtgtacagtaagcagtccataaagctggatgattactctgcatgtgttagtgacatgcatgaagtacccatttccccttggcacgggaagcccaggggaacagcattttcctgcctgacttctgaagccctcatactcatgatcctacgggagcaatggcaagggcaccggaaagccaggtcggagaatagagacccccagcctgctctcacagttggactcagcagtgcaacatcagtgactcctttgtgggagtcccacacaccgctgttcacacagggaacaccagtgcccggtggagctgcgggcttttgagacctcccgagtcgctttgtgtgcacaatgccgtgactctggatttgtacagtatgaccctcagacgctggaacaggagcacacgccaaagagaaaaaggagtggagatcactgagatctcataaatccataatgggcctgctctgtattaataaaacaatctcaatggtggagctccataaaagagaggcataggctgatgtaatttccttgaagtcccctgtaaagcattttactctgtaatacagctacatttatgaagtggttttatcttgaaagatcccaaagggcttactagactgaaaaggaaaatatcaagtacacgacatctcaaaacaccaccaatgtacttcggtgataacagttggggattctgtgacagcaggtagccctcttaaaaagcagacagcggcttagcccattaaacctccagggagaagtaaagagaaagaggagataattgtccacattggataagggccacacaggttttctttattaataaaggccatggcttgtttccatccgccacgtggatttaagtgggtgagctttatcaacatcattctccttatttgaaataaaagaaagaaaccaacttataacacttcttcataaagggactgagaaaatatatgtaaagcttccagtggttaatagaggtcaggtgtagccagtgtaatttagaagctgtgcattttaaaaagtaaaatataacctacagttataaaatatatccgacaggaaaaatatcttttcccagccaaattttactgaatccagtcctgtcgaaatgactgatcctgggtttttttcttccttgttgctgtcctggttaggacatggtggcactaacttttagtgaattagccgaggatataggggaatggttggcaggggccagaagtccttcttgattatcctccaagaatatcaccccactgggagctaagaaggaaggtggaagcaccaggtgatgtaagtttagcaatcgctgagtactgtcaaagaaagcagtctgagacttcaaagtaaataaaaagtagctcccctttcttcaaaaatgttaaaactgatccactctctaaccaggaatactgttgtctcacattccctctgcagtttctctcatcccacttctgcttccagcccaaacccctcacccgtctcgttttcccaccagaaagtactccttgtctttttactaatactttgcttcttccctccccacacgatctctccaaagcctgggaactgagctagcaaagagaatgctcttctgagcttggagctgaacaaggagcccctatggaggagacaaagatgcaaaatttttagtttggttttattctcatttaagttttctatggagtatttttcttgtgatttaatctttggatgagactatcaatgtacgtttcttctaattttatttttcaaatattccattgcaaacttatttagcatttataattgaatactgataagtgaatttatttattcatttatttattcatttattttgagatgcagtctcactctgccacccaagctggagtacagtggtgtgatcttggctcactgcaacctctacttccaggttcaagggattctcctgccatggccagtattattttttaaatttttagtagtgacggggtttcaccgtgttggccaggctggtctcaaactactgacctcaagtgatctgccagcctcagtctcccaaagtgctgggattacaggcatgagccactgctcccggccagtaaactttattttattttaaaaacctgttttggagtattagcccactggtttacattgtcttccttacatacatcacacccatatggaggagtactttaaagacaaagttgcaatctggtagcatagctgcccagtggagaaaaagtgcacatgtaaagcctgagtaattcagggcatgaaaatatccctgtcagccaatcagtcaacgagttgaccaagcgtcttggctagcctcagaggtaccttggcaggcaggctcaggcattgtgcagccctgtgtaaaattttcctcatagtaactacgttgtctttacatcaacctgagaagtagatactatttttcctatttttgtttgtttgtttgtttgtttgagacaaagactcggtctgtcgcccaggctggagtgcagtggtgcgatctcggcccatggcaacctccgcctcccgggttgacgccattctcctgcctcagcctcccgagtagctgggactacaggcgcccgccaccacgcccagctaatttttttgtatttttagtagagatggggtttcactgttggctaggatggtctcgatttcctgacctcgtgatccgcccacctccgcctcccaaagtgttgggattacaggcgtgagccagcgcgcctggcctatttttcctattttattaatgagaaaactgaggctcagagatgctaaataacatatctgagttcatcactgccagtcaatctgggctcaaacattccgatccagattgctctgattctagagcctttgttctggaaatctgtcttttataatacacagggattttatttttaaccttttattttgaaatgaattcagacttacaggaaagttgcaaaaagaatgtaggtaattcctttatatttttagttcaaatttttcaaatgttaacatattatcacatttacttaatgattcctccctcccccaactattgaagagaaaattgcagactcgatgccccttttcccctcatcttcagtgtgatatttcccaaaaacaaggatgttttttctctctcatagaatcacagaacaatgatcaaatcagcaaattaacgctattaaaaattatctaatcaacacacttaatttggatttatccaattaccgcactaatgtttttttattgcaaaagaaaatattttggcccaggatctaatccaggatttaatattgcctcagatctcatgtctctttaggttcctttaatctggaaaagttcttcatctttgttctgtctttcgtgaccatgacatagttgaagattataggttggttagtttgttcggtgtctcccatgattagatccaggttaaagaaacagctggaaagaaagtacaagcaaggaacttcctatgtcaacacctaaataatctctgccacccccacccccatggctttaccccatcacatcctcacaaactcccctctacctccacattttaggtgattctctttcctcttacattttctcatagtctgccctccctttatagctctaatcacaacttgaattgtataacaaattctataatgatttttttaaaactgacttccccattagggtgtatgctccctggggactgagctcatacctggttcgtatttgcgcccgctgaatcctcaacacctagtacaattctcagtaagcagtccctaaagctaagtgattactctgtatgtgttagtgaaatgcattaagtgcccatttccccttggcgtgggaagcccacaggaacagcattttcctgccttacttctgaagtccttgaactcacgctcctactggagtgatggcaaggccactggaaagccaggtcggagaacagagacccccccagcctgctttcacagttggttccggcagttgttgcatttgtggcaagaacctcatggcagtattgtgtccttcacagtgctttgtatcaggcagcatgtagcaggcttttgtgtccttactggtgacattaacttggaccacttacagagggtggtgtctgccaggtttctcctatataaacttaatttttcctcctttgtaactaacaagggtcttggaaggagatatttccagactacacaaataccttgtttcttttcatattttcacccactgattctaggcttctttgataatttttgccctcctgccccaccaaaaaatattttaccattatggttaccaaatggcgattctctaatggcatgagtccttctacatttatttgttggcattctattttaaggaaaagctccccccaacttaagaatttatttccaattttaaaagtttcattactatggttttatgggttctttttttattctgtagggtaacaatctgttgctacccttatttattcttgtgcgccaattgtccaccgtttgtccagtgggaagcctaacatgcagtttttatattcaagtatcctagcacgtcaacttttattgcttcacttaaaatctgccaccttccaccttcatgtcctgaatcctttatctagaaaatgtgtaattttccaagaaggcctcagacctagtggtccagttactgtctgtttttgctgactaactcttgaaataagaatttttttaaaagctggtagtagggatgaagggggttaagtgacagttctcctaagaagcatactcatggccctgccagcggcttggagacataagggaggtaaactgaaatctttcctgaacacttcatgctttttggtttctctccactttttaacacactgcagtgtaattccctccactatcctgaaaacatggatttagattccaagacccatctctccttctgtgaagccatcctccctgccccacccaggcaggatgaattattctcttcttggcagctctagaagccctggtataggcttttgttctagcatcagtcatatggtgttataactatttttgacactccgttcccctcaataggctgtgagcctttcacaaatgggtttttacatatatctgtgttaagtaataataaggctgggtgtagtggctcacgcctgtaatcccagcagtttgggaggctgagtggggatgattgcttgagctcaagagttcaagacaagcctggacaacatggaaaaaccccatctctacaaaatatacaaaaattagttgggcatggtaatcccagctgctcaggaggctgaggcaggagaatcgcttgaaccctggaggcagaagttgcagtaagccaagatcgcatcactgcactccagcctgggcaacagaatgagactctctctcaaacgaaaaagaaataataaacatttttaattatttaaaaatgtgttagaatcgatatctaggtcattgtgtaaaccaaaggccagcaaactttcctgcaaagggccaggtaggctttgtaggtgatatagtttctcttataactagtaaactctgctactgtatatctaatggccctatacacgatacataaaagaatgaatgtggctgtgtttcaatagaactttattcatataaatagacgtggggctgaattttaccctagggctataatttcctgacccctgatctctcccacctcaaggtcttcctattagctgaatacctgccttaggaaatccctcattttctctggctattttctgcatattctttttttttttttttttttaagcagctttctagcttctctctggaagagtggaaagatgatggggctagcccatagtttctcaacctgggcaatattgacaatttgaactaggtaatcttttgttgtgagggagtacattatagaatgttagcagcatgcctggcctctacacactggataccactagcagcactgcagtcatgacaatcaaaatgtctccggacatcgtaaaattacccctggttgaggagaatcaggctagtccgtgcacaatatatttttaaatttttctttagttcttcaagagccttccaggtgaaggaatggactgccacagccaaaaacaagatggctagcaaactcttctctccaggaaacgtcttcctaataaggcatattttattattttgtcagaaagtccatttctacacctttcttaatcctccatttagtatttctctttttttttttattatactttaagttctggggtacgtgtgcagaacttgtaggtttcttacgtaggtatacacgtgctatggtggtttgctgcatctgtcaatccgtcatctacattaggtatttctcctaatgctatccctcccctagacccctacccatcgacagtgtggtgtttccctccctgtttccttgtgttcttatcgttcacctcccactcaggaatgagaacatgtggtatttggttttctgttcttgtgttagtttgctgagaatgttggtttccagctacatccgtgatcctgcaaaagacaggaactcatccttttttatggctgcatagtattccctggtatatatgtgccacattttctttatccagtctatcattgatgggcatttgggttggtttcaagtctttgctattgtgaacagtgcatattcttttttttttttttttttttttttttttgagacggagtctcgctctgtcgcccaggccggactgcggactgcagtggcgcaatctcggctcactgcaagctccacttcccgggttcacgccattctcctgcctcagcctcccgagtagctgggactacaggcgcccgccaccgcgcccggctaattttttgtatttttagtagagacggggtttcaccttgttagccaggatggtctcaatctcctgacctcatgatccacccgcctcggcctcccaaagtgccagtgcatattcttaagggctcagcttaaaccttacctgtttgagtgtaaggcagagctccttgatctgcataatagattaagttccagtgctgtatttaccaaagtcccctctattatttccctattagagcattcattagtattaactataatgactataatgacttgttttacctttgaaattttattaaaattattgcaagagcacttttttaccttccaatgcccagtgcttcagtacttactcagagtgcaggcacatttaaaatatttgttgaatgtacaaataaatgtttaaaaggtttcacatagactaggttgcaaaatccatagcagacactgtaggtgctccacctatatcctttccttttaccattctggggcatactggcctaatttacttgcagaagaacaaacacattctgagaacagccaggcctcaaccaaagaccagcaggagcaggtgcataaataccccaactccctcacccttcgaatgcgatgactctaaggcttatgttttaaactggcttccataactcaccagcaggattcagttctagttatccacattgacagctgatttgataacagccgttttgttggctgctttccctgccttatctcatttcctattctcactgtcactctcattcctgttctcttattctcatgtagtgctcccatcaccttccacatcaaccccgcacacttgaatccttgttgcaaggtctgttcctaggacagcaaagcataaggtttccaacaaccctgtgagatgtgtatcatcacctgtattttaaaagtaagaagtgcagggcagagagattatggccatctaccaagtgcatcgaagaataggcatctaacccagacctctggctacaaactctggacatcatccagttcaccatgttgtttctataaggtgttcaactagtgtgcgttaaatgacaagatggctgggtgtagttctgatataaactcttcccaaattcaaccttgaattcaaatggtttctttctagtcgtagtatggtaccaaatagataagtctgtttaggtaagaattaaatgtaaaaaaacacaaacatttaagttcattggattgtttccccttaactgcctgtgccccttaaatgctaccttttcctgatcctatttgaggggggaagtatcttttgaatcccagacttgcagggacggattctgcatggcctgtacccttgtttgcagcgattactctgctcagaggaggatgacctgtgtggggagcctcttcagctacttgaggcactaaccctctagcccaggaagtcccattattgctgggccctgccataagcttatttgtatttcacagcgacttgcacagatgtgccagatatgtacagatggatttttatcagaagagagtctacccaagtgaagcagtgtagggtgaggctaaatcccaaaattgaaatttggggacactgattaggcacagagcaggaccaggggttaaaaccatgtgggaaacagatcaatagaatggaggaaaacagtccctgaggaggaccctatgacagaaatctactatagagaaacggcctgggcagaccaagcataatattcagtggagagtctgggtgtgagagctgtgtttgggtgagaagcagggaatgattgaaaggtaagacaagagaaaacatttccttttgttcattccatttctgcagaggctcttgtatttctgagtcccattttgaaagtcacacagcccagcatctcatctcttctttagccgaaaaacatactgcattagctgagtctccagagcaagttgttgctagccttgggacctggggaggttatttcagctgtgagtacctcacttccctcacatgcaaagtgcagtagtaacagcacttccatcctatggtagctgggacggaaaatgcataactccatgtgaattgccaaggatagtgcctgtcacgtggtaagcatttaacacatagtagctgtttttaatattatgtgtggtagattggcaccattccatgaatccaagccatttgggtatgataactgaactggttgtcaaagcaagaatcagccttgtgtttacaaccactgagaaagagcttgtcaagctcttagctgaaatctgtacaaaatatctgctgcaggtctctacctttttaccatttaaggtccatgaaggaaaccaggtcactcaggcacaacctgattttaatgaaccctcgtaggcgtctaaagaatcaccactttatttttttaaagtgttcaaaaccattactttaatgatttgttctggagtctcgacccagaacaatgtcagtctcgttacagaatctcagaatttactgccactttttgaaatagttggagatactttctatcctctgtctcagcatttctgccactcttctggattggatttatttagaacaattaaatgctgtcttacaatctctttccccaacttggggtttctcttcccttctaccaacgttcactctgcattttcattctgatgctcatttttcttggcattttgtctggagaagtttgaagcagagcagatgctcagacggtctgcatccctcctctttgccgtccttctcctttgctcacctgcaagaatcaggctttacgattcaactttctgttccaaacatagctttaaagcctgtttgggtgtccttagaaatttttctaagtgtcagctcatatgagacacccgctccagatgtcttgttttcccactgttcactgttcaatttaacaaaacacatattaggcacctactgtgaggcaggcattgtgctgctcttgaaagatacaaaggaaaacaaggtgtagtccctactttcaaggcgctcacggtaaagctagaaatgtaaacaaaccaacacaaaacagtgtgcaagaatcctgttaaagacctgccctcactgaactgtgcccctccacctggaggctgcagcgggtcaaggatggcttcactgaagggatgatatttgaacaagacttatttttatttctttttattcttctatcccatgacatttccttttctagtctcctaggcagccatcaacaaggtgcacaaatatgtctttttgcttatacagtagtcatacaaaatgcatgttgcagttttgtactcagctgtttcattgatgtaaatgatcctgtgtcacatactcacacaccttattttttgctttccctctctaagcatttttggtttttggttttttttgaaacagagttacccactgttgtccaggctggagtgcagtggtgtgatagctcactgcaacctctgcctccccggttctagcgattctcctgcctcagcctcccaagtaatccctgggattacgggcacccactaccatgcccagccaactgttttgtttgtttgtttttgtattttcagtagagacagggtttcagcacgttggccaggctgattttgaactcctgacctcaagtgatgctcccacctcggcctcacaaagtgctaggattacaggcgtgagccaccatgcccggcctaagctttctttgtaagatgcattcatgtcagggtgcaaacatccaggctgttatttccattcactgtgtgtccttgcatcttccacatccttcacttttccattgtctccatgtagaatgcccacattgtctctggttcccaacaccctgaataactgcagcaataccctttacgattcacatgcagatgggtgtaaaaggttccttggcttatatttgcccagaaatggaatttctggatcacaggtatgacaggcagaataatgaccccaatgatatccacattctaatacctagaaactgcaaatatgtgaccttgggtggcaaaagggactttgcagatgtaattagattaaaatttttgagattgagagatcatgttggacgatgtaagtgggcccagtataatcacaagggtccttatcagaaaaaggaggaggcagaagatccagagttggagagagatttaaagatgctctattgctgtctttgaagatagaggaaggggccaggagtcaaggaaagtgggcagcatgtagaacatgtaaaagaaaaggaagcagatttgtccctagagccttcaagagtctccatgtcagacttttgacctcaaggactataaaataatacatttgtgttgctttaagccattaagttcctggggatttgttacagcggccgcaggatgcccacacataaactacgcccagactgactttgactgtaatggcgctgggtcagtctcagaatggctgtccaggcccacatttctgatagccgcacatgaagtcctcacgtctgcacaccctcggcatcacttggcccaactcgtctttctgatttctttcagtccgatgggtataaagcataaacaagtcttgaataaagagtcagaattccttccaataaagtagggtggttgaggtgagatgggggatggccttggggccctggctgctgtggttggatggtctggtctttgggagaggatgcacaaatcattaggaaagcagagataaggctcccaaggggctacatggagagtaagtggagacaaaacccgtgcgccttgtgaggacacagggctgtgtggactccatggaagagagggccccagacagtggcaggcagtgtggggtcacagtcgtagtcaggcctgggtgtcagtcacagttctgcagctgccgtgtgaccctaggcatgctcttaacctctctgatccttggcatccttctccctgtgacagggataataatactatctgctcataggactgccatgtggcttacatgagatcatgcatgcaaagcccctaatacagtgaatggtatagagttggcacccaacaaataatcatcgtaatgatactattttcattagcacaataattgtaataataattacagtttcttacattcctcaactccaagaaaattggatttttcttgtaatctgcaggatccattgctgaccttgctcttctatctggagaataatgtattgcaatcagtttccacatatttatatgcaaaggcctttatatattattttcaaggagatcttcccctccttaaccattgcccttgtctatacccccatccctgaaaaatgggggtttccttttagggcttttaacagcataatgcagttgaatacaacttattttactgacatctctcctccaagcgctctcccccagcactttccaggactaaataatgcatgaagggagagaataacagggattgcataaacgacggaaaacagcacggtaaggattctgtgttgtgaagagatgaaagcccctggtcagaaggccagtaacaaagcaaagaagaaatgcaaaggcattgacgagggagacaagaaaagtatttttcaagataagatttgtggagagttaaaaaggagatgactcaggagacagtcaaagactcttcattagacaggaactccagagtgggtacaccagggggcctgggcttttgaagggctggggctctgaagaagttaacaaacaccagctccacttcctgggcctctgaagccttctttgacgtgcccaggtgggggccgattcttcttgcttggtgtcctatgcctccctcttcctacctttattagagaatgtatctcactcaactgtaacggtggattcctatgtcctttttcttcactgtgctggagctccaggcgcttttccagttatcctcatgcttttccatcttagatgcttttccagttatcctcatcatagattaaaataataattgttggtcatttagtctgtccctgtgctaagtgctccatgtgcattagataaattatgcctcaagacagccccagatacccattttacaactgtagaaactgaggcaggaggagattgagacttgcttgcagatgtgcaaatggtggagaatgtaggtgagattggcactgaggggttcagactcccaaatagggctgttgagtttcttttactcccaaaaccaagcacagtgctgagcacgaaaatgcactaagcaagagtttgatttgtgaacacattattctgcctggaactcagctagctagccaggtggtactcggagttggcatttctgttgctcaggccgggctgcatttggtgagttgcgggaaggggatgatgacatcttctccagttgacaaaagacaatggcttgttctgaggagagggcctggaactcttggtccatcagtctggctttgtcctgtctattatacacagtctaatcacccccaacaaatggtgctaggaaaacgaaaacaaaagctatatatttcctcttatagaatttttaaaacaactaaatatacctctggaatacactttacaaatttatgctaaaggcttccacaccaatgtggctcctaagttcccaaaattgagctccattttgaattgcccttggccctgctctctctgggattgctagagagttccagcatggacccagtgtcctttgtgggctgcagagctggacaacactgggatgagtaaggcagccaaccctcagccctgggaggcacagtgagggccagggtattaaccagaagcttagtagtcattttaccatcagcattaagtcacccacatgcacactgatatggtttggctgtgtccccacccaaatctcatcttgaattgtagttcccataatccccacgtgtaatgggaggaacctagtgggaggtaatttaattatgagtgagttctcacgagatgtgatggttttatatggggcttttcccccttttgcttggcacttccccttgctgccaccatgtgaagaaggacatgtttgtttccccatccaccatgattgtaaatttcctgagaactcccagacctgcagaaccgtgagtcaattgaacctctttcctttataaattacccagtctcaggtatgtctttattagcagcataaaaatggactaatacagcaaattggttctgagggagcagggtgctgctctaaagatacccaaaaatgtggaagtgactttggaactgggtaacaggcagaggtaggaacagtttggagggctcagaagaagacaggaaaatgtgggcaattttggaacttcctagagacctggaaggctcagaagacaggaagatgtgggagtttagaacttcctagagatttgttgaatgtctttgaccaaaatgctgatagtgatatggacaatgaagtccaagttggggtggtctcaaatgaagatgaggaacttgttggaaactggagcaaaggtgactctcgttatgttttagcacagggactggtggcattttcccctgccctagagatctctggcactttgaactggagagagatgatttagggtatctggcagaataaatctccaagcagcagagccttcaagaggtggcttgggtgctgttaaaagtattcagttttatgtattcataaagacatggtttggaattggaacttatgtttaaaagggaagcagaacataaaagttcagaaaatttgtagcctgacaatgcaatagaaaagaaaaacctattttatggggagaaattcaaggctgttgcagaaatttgcatcagtaatgaggagcaaaatattaatcaccaagacaacagggaaaatgtctccagggcatgtcaggggtcttcatggcagcccctcccattgcaggcctggaggccttggaggaaaaaatggctttgtgggccaggcccaagtctcccctgctttgtgcagcatgggaacttggtgccctgtgtcccagccactacagccatagctaaaagaggccaaggtacagctcaggttgtggcttcggtgggtgcaagccccaagccttggcagcttccacatagtgttgagcctgcaggtacacagaagtcagtaattgaggtttgggaacctctgtctagatttcagaggatgtgtggaaacacgtgatgtccaggcagaagtttgctgcagggacagaacactcatggagaacctctgctagagcagtgcagaagggaaatatggggttggagcccccacacagagtccccactggggcactgcttagtggagctgtgagaagagggtcaccatcctccataccccaaaatggtagctccaccgacagcttgcaccaccatgcacctggaaaagccacagacactcaaagctagccatgaaagcagccgggaggggggttgtaccctgcaaagccacaggggtggagctgcccaagatcatgggagcccacctctagcatcatcatgccctagatgtgagacatgaagtcaaaggggattatttttgaactttaaggtttaatgactgccctattggattctagacttgcatggggcctgtagctcctttgttttggccagttactcccatttggaacagatgtatttatccaatgcctgtacccccattgtgtctgggaagtatctaactggctttggattttacaggcttgtaggcctcgtctcagatgagactatggacttggagttttcagttaatgctggactgagttatgacttttggggactgttgggagggcagaattgtcttttgaaatgtgagtacacgggattttggagagtaggggcagagtgatatgatttggctgtgtcctcatccaaatttcatcttgaattatagttcctgtaatccctacatgtggtgggagggacgtggggggagacgactggatcatgggggtggttaccctcatgctgttttcatgattgtgaattctcatgggatctgatggttttataaagggcgtttcccccttttgctcagcacttctcctggatgctgccatgtgaaaaaggatgtgtttgcttcctcttccaccatgatcatagtttcctgaggcttcccaagccgtgcagaattgtgagtcaattaaacctctttcctttataaattacccagtcttaggtatgtctctattagcaggatgagaacagacaaatgcacagaccaacaaggagtatgtggtgagctttttcctgccttgcttttttgaaagaggaaaacaataagatcagaacagattatcactaaaattggcagggggaaagtgtggcacagtcattagaaaaaactggactttggagaccattttaggaaatcttggaatactagcattgtttggggccacttccttgggtcatgtttaagtaagatttgcagcagcccatagatgactcactgaaatttaatcattaatggaatattttataaaggggcagtttataaatgcatagttgaagtacagggaaaccacaagggatggcaccacccccaggggctagtgatggcagggacagttatctgccctggtctgaagggttaagaggagaggagggagccctctctgaagtggagacagtgaggtgtgtgtgcagaaggccacctgacgtgtctgagaccttcctttgagagatacagccagccctcagtgacccagcagggaagaagcaaggataaacacctgattccttttctccctgccttccctctgtaatgagttttgtctgttggtcaaaactagagactcacagagtgctttggctgggtccgtaaagaccaatctccagggaccaaagaaaggtggtgaagggaggagctgggtaaacagaagctatccagcctggttttcatctatccagagctgtacacaagatggtggattgaagatgattaaacacaacacagtattataagttttagaggaccaaataatgtactttaaaactaatgcaaatgtgatttttttgaaggctcatttcatggtaacactgtgcggagctcttaagtcaaacatctctttcaatcctcccaacaatctaggaagataagttatggtctccgtgttctctagtagaagaaacagactttaaagattttggtgacattttcaagcaaactaccatatacagagtcagagccctcaaactgtgaactgtatccttttggggttgcctttgtccccaagaacctccttgtcttctctggtcctcatttttcaacacagtcaagaaaatatctgtttgtttcatgactgagcattcatgagagccaaaaggaaacaatgatttattaaagtgtctatgtcaggaagttcttattggctgctcccgttgttaattgagtgtcttgaaacccttctggtgctttgtaattagtgctccaggacaaaacatgctgctgcttttttctcatcccctaaattttgccatttcagcacaaagggagctcaggtgcatcaggagccccagcctcctgcgactggactgcatacatacaaatacccattctaggtggtttccaaaaggactccatttctatgggaatattttccattgagctgtttatgaactttcacttagtgattaaaaaattattcaaaaggagggcaatagtaataaacttccactttccgtttcaccagcatatctcaaaactaaattaattatcagcctgtgtgaataaagtttgtgtcctgataaatgtattccctcaagaatgctcaattcacctttccccaggtctccagctcacacactgcagtccaatttcaaattcttccgtctcaccatgaatctccagtcttgaagccctctccttgaccccctccttggagggtgatgtggtaaatcaagtcagctctctgtgaatgtctcatcattctccacctgccacagcaattttgccccctctgctctcctcctggggtaaagagtctttccttgttagggcttaaccctttaaactagtcttcccctgctggtccaggcaaggagcctgttccagcatttggttctttcttctccatcttcttcaggtgttctccttccttctttaggtcagaaaagaaattcatgaaaaacaccataaaataaaattttaaaaaatccattttctacctttcttgcaagtgcttttatgtttctatgcatctcctcacatgggatgctcacattcagcctttgctgcaacattgtgccttcctttttgaatgttctacccaattttctcccgtaagcccttcaacagctaccagtggcttcctaatgaccattcacagtgtatgcttctcaatctctgcagcttcgaacactgttgactttcttcctttcctaccccagccttgaaataggtatccatggcaaaacattcagtccctactcttaaccttgctgtctgaatgctgttgcttgccattggactattctggaacaggaagtatagcattctaacagcatggtatatgaagccatatttccctgaatcaacttctagttttagcacttattagctaataagtgtatgatcttaggcaatttattaggaaaaaaattaatctcagtttacccaactataaaatggagataataatgctttgtaggaaggtatatgaattaattcatataaaccaatttcacaagctctgtaaaataagaatttcttcttattttataaataatacttatcttataaataataagatgttatttatgccaataatatctacaagttgacattttccaatattctgcttttagaactgtattaggttcctattgttgtattaaaaaattaccccaaacttagtgacttaaaataccacaaatttattatcatacatttctggagctccgaagtcctaaaaaatctaaagtgtcggcagagccatagcggagaatctgcttttttgcctttttcctgtatcccttggcttagggactattcctccatgttcaaagctgcatttgcatggcttcaactatcagttctatgtggaagattttttctgattttcaggccagtctcatatccccagagaaatgcattcttatccccccaactatttgccattgaaagtaatggcaaaaaccaccattagttttgcaccaacctagtagttgcaggtcgtctccctgtggctgcactccacacaaatacaagtaaacgcatcacaatcctataactaattctgttccttgtcctgatgagcttccttctacaaatggccctaatattccctccatttcccagtatttattgagggatgaagagtctttctgtcaactttcagtgagaagaagtaaataaaacagctttgatggatacccccatgaaccggagtgaaagggatactcctttaaatcatagttatttcgtttgctaagcatggtggccctgagaatatgcctcccagagcctccaccacagggaacacgactgacatgtgaccccagatgctgtactctgaagcccatgacagtatttgggctgacgctatggtttttattatctttcctcaccaaagacttcagcaagggagggatactaaggcaaatctgtttctgggaatcttcaaactcattcaacagctgatcttggctccagggcttccatatggccttgcaggacctttcttagactgcagagaagtccagaacactttttacttagccttcctttcctctctccttcactcaaggtcagattttcatctcagtttgatagctctccccgctcctcccagcttcgtccccattttttctcacccggctgtttcccctaatataataattggtcttcaattttaacttgcatttgctcctcaggagatctgaacttatatgtcatagtctgagtttggagggttgaagggtcaagacctgatggtgaagcccacttcctttgagttccctggattccaggaagacagaatttacaactgccagtaagggagcaaccagacgatgcaaactccttggcaccaagaagagaatgtgggaggaaaatgagatgttttagaaacaacagaggaatctgtgagacagggctgctgtgagatgatgtcacacttgacataaattgacagttaattgcctggagatttgggaacagttcaggggtgtgtgtatgagagagattgtgcataccatgaacaatggacacaaatatatatgcctgcttctgtgttgtgtgtctctctgaattagtgttccctggtccacttcataggatatttcaccagcacctgggactgactgtaagggggaaatggatttgctcatggacctttcagcagagggaaaaatgggtagaagcttctaggaagcgggaataatttcatgtaaagagggcttttcctgaagacacctgacagagtgggtagctggaggcatatctgccatagatacaaggactttctgccgtgggtgggaagctggactgggaagcccacaagaccttccacctcagacagttgtagaaattcaaaagtcccagcagttttctaaacctggcaggtcacttgaatcacatgggaggccattaaacacaccccaaatattctaaatttggatttcaagggaagggcttgaaaggaagagcaaggaacctggataaaactctaaaaccttctttcccttgcaattgaattagccagcctaatttgaaaaccacactgctttgttgaacagaattcccggaaccaccccagacttgaagtatcattcagctatgtcttcacatgggaaatgtgttgtgctatcagaagttgaattgcttgtttcaatgtgtttaagacaatgtacctccgaatctggcaggaatgagtttaaattctgactctgctacttatcatctgagtgatcttgaataagatattcaacttctcagaacctcagatttcttcgctgtaaaataaggatggtaatgacacctttttcctaaatttactgaaattatcaagtgggataatgataacagttaacattcattttcaacttgctctgtgccagtcactatttcaactcatgtattagctcatttgtttgtagcaactgtctgaagaaggttcagctatgattcccgctttacagatggaaagattgaggcatcaagaggtcacataacttgctaaggtttgcacaactaaacgggatacagctgatatttaaacctaggcaattcagtcaaaatctacttttcaggatagtatgctttatacacacatactatgctatgtgtgtataaagcacttaacccagagcttggaacacactatgtgctccataactattagctaatgttataatcactgcttttaccctgggacttacagtgaattgtcacaactctccagcatctgcaatattcctacttagctgcttgcaaagccagaacacctgtgtcttcatgccctctcctttttgtgcccagcccctgtctcagtgatgagcaggacagcatgcatggatcattaacttactgagactgagaatgtcaaattcaagacctgttgaataaggtcagtaagtaatagtagttgctgtatttctcataagtgttgaaaaggaatccttacagaaatacattactttaatcctaatgtattttgacttcttcaggatgcacaggtgtccagggaactgtagtgtcagtatctctgagaccttaggagaacttcttttgaatctaaaggagggggagttgaaaggcatctctattatagcaaaaagaaattagagggctgattcatcctattctgtagggaaagcagaactctgctcagagatcttgaagtaagtaaaacatggtagttacttttggaggaaaataaagtaccatcgaatgtagaatctgatggtttcagtgaaggtaataaatggtgctttgatgacaactgtattcattagacatatttgtggctttcctcctcctttctcttgcagataaattctcactcaggccctacagagataggtgcgtggttttagagatcatcagatgtgggtttaagatcacttttgccacttcccatatgcgagatcttgggcaggaccctcaccctctctgaaccttggcctcttctttctgaaatgttggtaattgatatggtttggatatttgtccccatccaaatttcatgttgaattgcaatccccagcattggaggtgggacctggtgggaggtgactggagcatggggacagatttctcctaaatggtttactaccatcttggtactgttctcatgatagtgagtgagttcttatgagatctggtcgtttaaaagcacatagcacctccctctttgctctgtcttgcacctgctctggccatgtgttgtgcctgcctccctttcaccttccaccatgactggaagcttcccgaagcctccccacaagcagagcagacattggcatcatgcttcctgtaaagcctacagaaccatgagccaattacacctttcttctttttaaactaccctgtctcacgtacttctatatagtgacgtaagaatggactaatacagtaatactcttacacttattgtagagatgttgtgggacaacataagacaattgtaaacacagtctgtgcctgcaagttcagccaggcactctgtagagatcaatactgtccctaggatgctgtgaattttcatattggtacgtctgagcctgagtaacacttggcaaccagagtgagccccagaactggctcatgtggaggtcagtgacaaacctttgacatttgatacaatcaaaaccaagccgctttgtttaaaatgctcatcaaatacctaccatgcacactgtgtatataaaagtcattgtcacaaaagccctttttcagaatctctagcttgccatttctctcagatttcttattgtcctctgggtcaaaaacactgcaaaatttcattcctttaccacagcaagcttttatttctggtgtacacacccgagtgttatctggaatgtggctgctctaagctgggcctctgctggatttaactctagactattggttgagctaaggtcttcttcctgtgtctcttatttttctagggatagcagaaatgaaagaggcaagtccaaccacacaaacatatctcaagcctttgcttgaactacatccaatagtacctgctggtcaaaccaagtcacaaggataacccaactgtaagaccatggcaaggtgatgaatgtctacaaataccgcaaatgggtgaagaattgagaccatatctcattctgtcatacctggaactccaaatttcccagttcttttaaacttttatgagttaggtactttcaagttgtgtaggacagactcacctggtttgggtgagttaagtctatggaaagggaacagaaaacatgtgaggaaacacttatcccatctattccatcttatcttgatggaattagaatttagggattcacttttcagggacaaaaagcattcaggaaggtgcctcacacaaaatggctactcaggaaatgtttatggagaggacatgtgaatcagtgaggagcggctgtagcactggtcaccttgccgttttcccagaagtagcctccattgctccctcctctgtggtcttcaatattctcatgattcaacttccctgtcttctttggttcttccagttactgctgtatcccttaaactcgcccaaaaggaaggattgtgttgcattaattagctgtctttctatctactgggcagagatcttatgatatgctgcctcattggcatgaatcagccaatttttgttttgttttgttttgtttgtttgtttgtttgtttttgagactttgagatggagtcttgatctgtctcccaggctggaatacagtgtcacgatcctggctcattgcaacctcctccttctaggttcaagcaattctcctgcctcagcctcctctgtagctggtattacaggcccctaaaaccacgctcagctaatttttggattcttagtagagactgagtttcactatgttgaccaggctggtctcaaactcctgacctcaggtgatctgcccgctttggcctcccaaagtggtaggattacaggcatgagccactgtgccaggccatgaatcagccagttttaaaaggcttctttttaagttgctggtcactggttgaatcgcaaagagtgtaaggaccatgcaaggaattccctatggctgcattcttcagcaagggtctgtgggttttgctattgcttagagactcaaggattttgtgttgggttgccccatctcttgctttgtgattctgcctcttgggatttggaaaggtaacctggatctagcacagagaggtctttctccctttgaagtgttcatcatgatctgatgagtcaacagtgcctcgtctcattgtttgctacactagctggctggaacactaccctcccagcagagcactccctgccagagcatgatactgccactgccaattgaagcacggctatgtttttacatcttgtagcaataaccctccttcctcaatcattgaagactgatcagctgggccaaaaccaaagcaatataacccagggtcgtgtgtgtacatgcatatgtggtgtgtgtatgtgcacatatgcatgtagtgtatatgtatgcacatgtatgtaagagcacgcacacacgtgttctttttaatataaagaaatgcctttagagaatgaaatgcactgggggcatccaaggtgaggagacttgagggaatgttttttgttttttttcttggcaaatcagtgaaagatgggcagataagtatggtgaacccctagtgtgaagtagagaaattggaggctggagttatagaggcagatgttgaagaacgtggaagcttctagaagagctgaaaacgtccatagactgagtaatcggccaggcacagtggctcacacatgtaatcccagcagtttgggaggctgaggcgggcagatcacctgaggtcaggagttcgagacctgcctggccaacatggtgaaaccccgtctctacaaaaatacaaaaattagctgggcatgttggtgggtgcctgtaatcccagctactctggaggcccgagacaggagaattgcttgaacccggctggcggaggttgcagtgagccaagatcgcaccactgcactccagcctgggagacagagtgaaactccaactcaaaaaaaaaaaaaaaaatgcgagtaatgaagggcagattcaggaccgggactggatgctcactcagtaggttgctgtgtcccgcaaggtaggaggtgttctgtgggtgaaaggcaaagacagagaggacatcaggtcagaacattccaagtgagactctacgttccttgaagactccattgtctcatttctttttatatctccagtgccaaagacctaagtgagccctctggatattagataaataaattaacttattaaaggatgaaagagtgaactactaagttaatttgaaattgaaatatagggtaaggcctgcacttacacagagaaaatgaactttcaaaaatgtacaaagcagacaaaggggagacggagagagagaatgaagactgaatgggtatccaactgatacctggaacatggcagtgtgagtagctgaaaaaggaaaagacctcaaggaatggggctgtctgtggggcctatatttatgttgacatcactcacaagtacaagtctgcatccctgggtgtcctcagacaagcatatagtttgcatatcgtattaccttttgtgttagtaatcactgattttgaatcttagctgactgtggaggtgctgttctgcctttgacatggcagtgtgagctggagagggatggggagatgaagaagccacatgtcccaggaatatcaggatcctataaacttattctgggtaaggcagtggcaagggtgaccagcaaagtggtgcctgaaggctgggaatccagtcatgtcaattttcttgtttgtttctctctggcaccttctctaggcccagagcctagatgaggctgtgtggaccagtgatacaatggagactttaattttctcgattagtgcagaggatgaagaaatctcagcagtcatgctgtattcaaggtgcagggtattgcctgcttctgttctcaatgctggctctcgtagcttaacccacctatacagaagtgacttgttttcatccccgtcctggccagtgactctttaaccaggcaatgtgatttacgtttagatgttagtttaatccctttgtttcttaatgaagctgcccttgttaaaatccctgggacctaatcatagaaattctctctagccccacgtctccgttcaacaactgcttagcaaatttctcatcagtcccatttttttttttaccagctcccctcaatagccatttcttgtctccaaggttttttgaagcccagaggcttttcttgtcaggcaattctcttatttcagccctgcagtgaactatccatatactgtatcacatcatgattttttttttctctgcaacctctcccttccccttgaaacaacttacctttatctgtgttccaaccccaatctgttgcgtctagaagtcagagagccaactgccaatcattctagaattcagcattttcaaagttcatctttgaaatggatagcctcttgttctgcagaaaagcaaggatcctagaaaaaacatgcaaactgcatttcaaggaggatggcatcatctttttgtttctcttggaatgactcaggagtgaggaaacaggaatacattactgtggttcccactcatcttggcctaccaatctctcccatctttctaggtacagcccatcttgtgatgggctgggacctgggcccctcctggacttacgttcaggatttcaaataacttggatggcagtctagccaaggaagccaaaagcttccatctcttccttgtcgtttgtgtgggttttttggtttgggttttttttttttttttagagacagagtctcactttatcatccaggctggagtgcagtggcacaatcacggctcactgccgccttgaactcctgggctcaagtgattctcccacctcagcctcctgagtagctagaattacaggtgcatgccaccaggaccagctatttatttatttattgtagaggtggggtcttgctatgttgcctaggctgattttgaactcctggtctgaagtgatccatcttggcctccaaagtactgggattacaggtgtgagccactgtgccccacagtatatctttttaaaatgaagactttcttatcagatttcagcaccaaggctcatacatatgttgactcaagaattaaagggctttagtttcatgtgctggcactaatcaatggctctggtttgagaacaattttgaaaccatactcgtctcattggaaaagagggcagtagtggtgcctaccagagatagggcatgaggaagcagtagtagcatccctgccatgcacctgccatccttgatttgataaagtccagaagcacatctgatcacaccatcttgcacaatggccttctcccaagcaacagtgacaacttagatggcctggaaaactatttcaaactaatagcaacatgtctaccaagagtgcattattaatgacacattcaactgaaaaattgatcacacgctcttaggtattacatgggtcacatttgcaataattttggtttttactgctgaaaggcaaatttaaggtaaaaatcaaatactttaaaagtatatatcttaatatgccttcctcttaacattcatctagtaaggggggagatgtagaattttgatataaattggccagccttatgttgatttatctttaacacagatttcaactccttcacttcagttgccatgaactgcaaggcccttgttcagtctggcttttcatctctttcctgcccaagtccaatttagctcttataaaacaaccagactactgcaatccctcatctcacggcaacctccaggacataatatataaaacttacccttgacatgtgggtgggtcaaataagtgatcaaagggcaagtcatgatctgaaagcatggtaatctcaagcaaccgctgatgtgaacattgcgtgtggcacagtgaaactcaaaggactcctgattttggcaataaaaacgattgtgtctataaactgagagaattatagaagtttgagcacagctgatcttagccttgaacatagttgaggaagagggaaggagaaatttaaaactttaattctgccaatttaacaaaaccgcttcacatcattatctaggatgagagtgatataaagaaatttaccagaactttttccattaatcaaaaagaaggtagtgaatgagatggaggatcaatcatgtcaaaaatttcagaaagggatgaggaaataatttctagcaaattatataataaaagtatgtttccactgaaaggagcattgaggaagaagaagagtatttcgtagaagtgaaacggcactgattaacctcattaaggacatgacttcctcatactttaataggaagtggtaaacttcagaatgagaccagcactatgttgaagtatgtcctagtccagcctctgttgtgagctagctgggaaagcatggccttatctgtttcagtatccttatttgtgaaatgaagagcttggcctgaaatcagcagctctcaaattttcgtgggcatcagaatcaccaaggatgtttgtaaatgtttttaaaagtcaattttcaagactccattaaatggagattttgatatatacaatcagagttaaatatgtgtatatataaaaaatatctttaagctagagtctcttatcagtgagactttgggctctacgtgcagagagactggtttacaaccagtcaaggggcagggtggggatagaattcagaactttagagataatctaacattctcagagactagaattctgcagtgttctggaacaataccccaaggtcaaaaagctttaactaaatgtttgtatgatcaataaattggtctgatttaaaattagcctataaagacattttttaaaagcaaatgcttaacttcaatactacatgacaagagggtgatatacaaaaaaaagttactatgtggttcttggcatcaagcagattaaagtctactttgaaataaagaccataataagtagttgaccccataaaaattaagcaataatgggaagaagttcagaggaacagaaaatcaattcatgctgagatgataatcaaattattggtaaaaatgaagatgctggttaggcatgtccttggctagagaagggctcaggcttgcaggtttaatgacctttagctgagaccaccccacgtgtccatctgcctcaggatactctaagtctcgtggctgaagcaaagtcttccttaaacagggcttccattgggccatgccagctattttgtttgtttgtttcctcaagacttaccaggccctatcttctgattccacctttgatcttaggtaggttaattcagttaatatattactaataactgtctacactctttctgccctcgatatctgtttccttctgctaacattttatgactattctttgtgggttaatttcacattttatctcccaaaggcagcccaagttccctcctttccagatgtcttgggctctcccaccgtagagcattggtgctgcctatactgttgttcttgatttcagagaacgttctacatcatacagatgcttacgcttattaaactactgatttaagttgttgcaggttttgagttaccactggcttttgactcagttgaaaaaaaacaaagaatggtccagggtgagagaggtgtgtaaattgactccgtgaggactctaggaactgatctttgacttcctcgccagcctctttgccaagcccaaattcatcatcattgtgaagtagcattgggccatgtttaagaagttttctataagaatttattttggattaatagcaaataattgcagctgagtcagcattaaagacatgttatatcagactgtgtctgctagttcagaggatgctgcttctcggatgggacttagctgaacacgtgttacacctctggggaagtgtctacagcattgtaccaaaaaacacagaaaacaggccactgaaacaaacaccagcagacatagcattggcaggatctaacaagcaggttttcctgaaacgtcattttgacagggttatagtcaggtggaatctcttaactgcagtggtcacctggtgcttcgttctttggtgcacagagagggggctgcagaggattaacatggaagaagcaagcactccccctccgttgttacccctccctgcaagatcctgaagccctgattctttccccatcattatatcccttttcaggaacggaaatgtcttctgcagagccagcccattccctctggtgctggtctcaggggaagtacagcatctggctcccaccctccatctaattacccatctgtttgtggggagggaagggatgttctattccccttctcttcccaaacattttaatgtgctgatgcatgaagacgacagcagctgcacctcagaacccatcctttgtgcatcacactcactggcttagcttttctgttcagttcttggatgggcctctttatagctagagacccacgtctctaactcctcctcatcctgacttagtacaaccctggcccttgcattagactgctccagattccatgttgctctctgattcagcatcatcaagcctcagcggggtgcctgagaccccctacctttagggaggggcagggatttccctgctctgctcttggcctagggcttctatcagctccagcaaagagaccatggagagcgtagcctttcatcgtaatctcccaacctttactcagctaatggcccctttggttatttctctctcactctggaagccatgtttagaaagagctgatatactgaacaaattgcacttaataaatattcacttattttccctctttttaaaaattaatcaagttctttgtaaggaagaaaaacgtattagtctttgacaaatgaaactaccaatctccattgatacctacgttgatagtattcaagccccaaacaaacacttcttagctggctcagatgatctggttaaggggaactttgtcagtttagttcagctttgtgaaatactgaaggatttcagaccactattaatacctgagtaaagtggttaagagaataactttggacatagagacagatgggtttcatttggccacatactagctacatgacctcgggcaagtttctgaacttgatgcggctccatttcttcatgggtaaaattggggtaattatactattgatcctgtaggattatcctgaagatagaatgcataatgtttacaaagcacttggtacaaagaggcataaagcaagaagtgagtaaatgttaactgctgctatctttattcccgtcattttaatcatcactatcaattatcatcacaacccaagtggctcagggatggagagaccccaactaggaccctctctccattctaggggaaacatttattcaactcaactgtggccagaactcatagtgaatctcgctatagtcatcctccgttttgcaacagcagattttgctgggctcgtggtcactcagctaaagactactttctccagccaccttgcatctaggtatgaccatggaactgggtgatggccactaagacatgagtgagcgtgatgttagcacattaatccatgcctttgaaaggcaagaagtctattttcccttcctgtttttcccttcttcagctgaaacgcaaacgtggtggtgaatcatcttgaattaagctgaaaagggtaacatggaagagatggcatggcaacaggatgcatccccaataccatcaagccaccattccaattctggactgccaacctagactcttaaataagggagaaaaaaagtcctttttgctttaaactactgaatctgatatcacctattataacaccatggtgtatcgtaaaaacacaccaaacaactattttcaaaatagatgtgatacttctccccagttatacaacttctggaagcaggaagccactgcattcccccacccagcttgtcatggtttacttctgattggatataactagatgataacagggatcacgctgcatccattgaggagaaagatgattcaaccctctcgcgggctgctggggaatcgatatcgtttaattatgagaaagtaaactgtgtttacattttacacagtggcaagaggaaggtcaaatcacaatcctcataccctttatcaaaaccatgcatcgctgtttgtcaagtgagattcaaaatgggatgaacttggagagttgccatcttcctgttttctcccttgtttgttcatatggctgtgctttacaagattaaaaggcttaccgggcaaaagcatagcagaaggaagtaaaaccttcgggcagatgaaataattcttccattttaggaaaaaaaggcaattagttatttgaggttttctgggtggggcagtgagtagaaggtcattatgttcctttcctgttgtatatcgaaaatcagttgagaagtaatgaaaatggtaagaaaaagaaaaaaaaagagtaaaccctcttcctctcccagtggcctctaccccatgactcatcagcttcctgaactggaacaacactgagctttatgactacagaaatgtcagctctgagcacagtgcatacttctttgtgtgaagatcttaggcggttgtgcaaaagccagcccaggacccagcatggtcctgctttatctctctgccgggctagtctccatgttcattagaaatgtgtgatttcttgacaagcactctttggatttgctgcagagtcaggtgatacattgaaatcagcaaaaacattaatgatagcaacaacaaaaacgaccttgtttaagttttacgccttataagggggcaatgttagccttgtaataaaaatgaggtaactgcaacttggaaatattaggaaatttatttaggatatcttagaaaatcataatgagagtgatgatgatgatgatggtagtgatgatgattatggtaatgataactatagtgatggtgatgacgatggtgatggtgggggtaatggtgatggtgatggtggtgatgatgatagtgatggtgatggtggtgatagtaatgattacggtggtggtgatgatgattctagtgatggtgatgctgatggcggtgatggtgatgttgattattatggtaatgataattacgatggtgttgttgatgatggtggtggtggtggtaatgatgatggtgatggtggtgatgatgatgatagtgatggtgatggtgatgatggtgatggtggtgatgatgatgatgatgatagtgatggtgatggtggtgatggtaatgacggtggtgatgatggtgatggtagtggtggtgatgctgatggtggtgatggtggtgatgatggtgatgatggtgatgatagtgatggtgatgatggtggtgatgttgatggtagtgatgatgataatgatggtaatgggtggtaaagatgataatgccttactctaggctagatattgtgctaaatatttcactgacaagcaaatgtgtaaactcacagtgctcagtattgtgattgaccctaatacgttttcactaattgttggcttcagggctaggactagagtgaggtgaatgaggtactctctttgggtccaaatttaaagggatacgaaaaatctcagtaattaaagtaaataatatttaatgcaatattttataaaaataaaaattagtgcaaaaatccatggtaaacaaaatgtcaacattttaaataaaggttctgtacatgcacaatatattctatttaccttcccctaatcccacccagttgtctcagctaatggcaatcttattttatacttgatgaaacaagcctgagcccaggttgttcttatccctgttctataggtgaaaatactgggcacaagagatttttccacaatcacatagctaatatatggaaaagctgggatttgagctcagctatatctaacatagaagttcagcagtctatctggcttctaaggtaagtttctgtcacaacattaaatattcagtatcattttctgggctatttttaaatggtagggagtcaaagagattaactaccagttgcagctcttatcaggccaacaatatcagctaaggtgaatctgatactagtagaactctaagaatgtgcatttattaagtcactcatataaataatatatttaacctacttagaaactctgtatagaagatatcagtgttgtatttcataaatagagaaagagaatctcagagttgagcactcacagtcatggtcaattcatggcagagttggtgaccagctcaaattttctaggttgacataatcctgtcctttctatggcttcaaagccatccacgtttgtctcttgatcctggaactttttatatttcgtcatacagaccttcctaagatcctcactttgcttgtatcattttccctagaataactattttctaaaacgcattaatgcattgattttaataacatcttgtgtcttatgtaattttaaaaatcagcatatattgactgaagacattttgacaaaagagaaagaaagaacatagcaaaaaagcatttccaactttcataaataagcaagagtatcactttcgtgaagttcttttctattttgttttgtcctgtttttttatagtgacatgtaactttttctttttctggacagcctgtcctcttggtgataataaagcatgatgataaaacaaatgagatctcactactagacttttctgtccaggaaatactcttgacttcatctgtcctcacctctgcttggaccttgtttcatccaatacctcatgccactctcagctttccaatttagatccttctcttgggtcattctcctctgctatgaattagcagacattgatcttgtcctctgacaagtagttatcagcagttattcataaatggatttagtatgttccatatccttagaataacatatacatataagcaaaaattaaatataatcttaggggtttcacaggctcccctaaatctcattcatgtacgccttaagcctgacttaagaaacgctgccatgtaatttccccttgatcctttttttttttttttttgcagatactgccccttctcatttttaactttcaccaacacttttcttgttaaagaagctttcattctctgccgctgtaattttccttacgcacatgaatatttatcttaatcaagtttctcctcccaagaacatcccttcagacaccaaaacgcgtattcttccacgttccatcagcagaaactttccttcatttgatacttgaagtccatcgctctggtgaaagcatccctcttcttgtttttcattatgttacattctttggacttgtcctcttatctatgtaccttgtaacttccatttagccctcttttctctttcaacttccttattgtagatactccttaatgttactagcatttaagttgtttttttcccccctcctttgtcagtcccaaagctcctatggctcaactgttggtgcacataaccttagggaggtgatttgaagaaattttaccgaaatgttgtatgacaaactcccaataacaggatttaagagaataccacttgttcttaccccttcagttctcttaacagggaagaaatatcataaccacataacacatgtttatatatatagatatgcccttacatcaaaataaattcttgatgataccaagatacgtgttcaaggcaaccataaaacactggaaaaaaatcaatcagaggtgaattttttcttatcttatggtcaggcagagtttaagcatgacaccaaaagttaaaataagctgaaaattgatatcattggctacataaaattttaatgcttctgtacaataaaaactgtataagtattaaacaaatgacatgtttaaaaacacagtttgcactatatattccgaagggcaaggacccctctccagcagctgtcgtccagcacatatttaacgtttccatatatctctgtcctcatcaataagatgaggctaatgacgctgcctctgcggtccttctaagaagcagatgggataaaagagtgtgcaccagtagctctaaacccgggacaatttcaccccctgagggcatttggcagtgtctaatgacatttttggtggtcatgctgggggatgctgctggcatcttgtgggtagaattcagagatgctgttaaacatcttgcaatgcttaagacatccatgcagaacaacaacaacaaaaaaatatcctgcccaaaatgtcaatagtgctgtggctgaaaaaccctggtctatacagggtggaggatgttgcggagcgtttggtacctggtaagtgctcagtaaatgtcagtcatttttacatcttattgggcaattctatgtaaatgccttgtccctaggaatatccacaggtttagcttatttttttttttttttttttttttttttttttttttttttttgagacagagtttttcctcttgttgcccagactgtagtgcaaagctgcgatctcggctcgctgcaacctccacctcccaggttcaagcaattgtcttgcctcagcctcgcgagtagctgggattacaggcgcccgccaccacgcccagctaattttttgtatttgtcgtagagacacggtttcaccatgttggccaggttggtctcactactgacctcaggtgatccactcaccttgggctcccaaagtgctaggattacaggtgtgagccacctcacccgaccccaaggttgtctcttttttcttttctcttttttttttttttttgttttgttttgttttttgagagggagtctcgttctgttgcccaggctagagtgcagtggcgcaactgcaagctccgcctcctgggttcacgccattctcctgcctcagcttcccaggtagctgggattacaggtacccgccaccatgcccggctaattttttgtatttttagtagagacagggtttcaccgtgttagccaagatgatctcaatctcctgcccgcatgatccgcccgcctcggcctcccaaggttctgggattaccggcgtgagccaccgcgcctggccatttatctgttaaggacagaacatgacttgagggacagcttactcattctatgcctatttgcttttctctctttcctcagcgcttttcactctcagctaccccttccaaacctcagctgattttactaccattcagatgtatcacttgtctcctgaaaaacacatagagcttcctttgtgaattcttactgctctacttacctgcttttaatctgtttatgtgagaatgttgtcaagatcttctagtagatcgtaagtcccttgaagaaaaagatgactttatatttattccaaaaaacccctgtggtgaccacacagcatagaaatctgcacagagcaggcaagtaacttacgtttgcttcgcaattccatcttcttaagtcgttcttgcaattgagaatgcatttctagccttctattggagctgcttagcacaagtagtgttgcattggtgtgaattcctccaacccatttaaatgagtttattgtgcattcaagtgagggttattcagcatgttcaagcaaatagtgaccaataatgataatggatattttttcatctcttcctgctccaatgggccagtattcaaaatgccattgctcacatgaaaacagagctgccagaccgtgtccagggcctcagccagggagctgccactttcattttaatttaagaaaaagagaaattgactgggaggtatttatgtaaatcagtagagttctaaggagttatctggcagccatgttaatggatgtgccactctgagaagcgaatctcgcattttgcttctcttgtcagaaggggttctgtgtgaccatttacacctacggatgattggctgtgacccagaggacatttgatgtaaaggatattttgtgcatgtcaatgagtcctgtccaggtggtgggatacaggctcgagacacatgttggagaagatcacttttgactgctggggagctatgggaagcccttccaaatgggcagaatgtgcaattactatctcagtaaatttgtctcaggagagctgtacacctcaggaacatcatatcatagaaaagggaagacaaaaaaggagctcaccttaaaagttccaaccacattccagggactgtttgtatttgactcattcatttattcaacaaatgtgaactgagcacttcaacgtgccatactgtcttctaggcactgaagatacaacagtggatatgatgggttgaatgtcggccccaaaaagatatgtccacatcctaatccctagaacctgtgattgtgaccttctttggaaaaagggtctttgaagatgtagttaagaatctgataatgagaggagcctggattatctgggtgagccctaaatccattgacatgtgtgcttttaagagacacacagaggaacaacactgcaggaggaggagaaggccatatgaatacggaggcaactcttggagtgatgtggcctcaagccaagaaacacctggagccacaggaagctgaaaaaggcaaggggtggaatctcctctagaacctatggaggaagtgtggtcccatcaacatcttgattttgcagcttccagaactgctagagaaaaatttctgttgttttaagccacaaagcttatagtttgttatagcagccacaggaaattaatacaataggctaaacagacaaaaatccctgccattgtgatgtgttcattctcgcttggtgcagacaggcaataaacaaataaaatgtattcaatgttgggttgtgatcaatgtaacacagtaacgaagcagaataagcggggaagaggtttgcttgtgagtggcatgatcatcaggaaagatgctactgagaaggggcgttcagagactgggaggaggtgagggaatgtgccgtgtaggtatgtggaggaaaagctgtctagacagaagggaatgaaactgcaaaggccgtgacactggagtgtgcctagtgtattggaggagatataaggcagcaaaggctgacaagaccagattatttagggcttttacttcaatttacccattgacttaacacttatctattgagcatgtaccaaatatattgttttacgacattcttgcaaaagcctggagaggtaggtaacaaaattcccactttaaagaggaaaacactgaatactggtccagcatgactcagctcatatgtggtggtactagaataggaatcttaatttgatgccaaccccagtgtcctttccccaacactggaatgacttatgtaaatatttatctcatttgtaatttgtctgtgtgttcagtcccatatgacagtcttgataagcccagctggcctctgaggccaatgcaaatatattttgagctgagaattgctcttgggcggtgagaggactgtagtttggaaaaggtcaagggctgtggattgccatctctcatggtgtcttcagaatgtttcagtagctttgtgactccaggtagcattgcattgataatttatctatttaactggcttaagtgggtttttttttttaattttctatctcaaaaatccaggctcataaatagggacagtatggaaaatgctgtatagggagaataaataaatgtataatcaggttagtaacatattatcattgatgcagctactgagcaaggaaaagcaaacaaagaaggagctttatttcatacccaagcaagtatagctcaattgcaaacctctcagacttgaatatatcacattggtcagtgcatatcatgtcctggaatgttacagaaagcagtaatggagagacaggtggatgaactaaaacttaacttacctctctcttcacatagcattagagcacagagaagattactacgacccttgggcatctgtgactactccattcaaaggttccttagaatgtttgctggaagcagttacagaaatgtgaacagggcttaaccagtgtactccataccctaaataattctgtataaataagagcttacatatctatgatgcctctctgtcacttcttttatattctcctttagtttgttttggggaaaattctaagtggatttgctccatgtaaatactgtacttccttatcgtattaacaaaggaagaggtaggagaatcaagacaatcgaatgtgtcagactaaagtagataataaatgctctttgggaaaaaaatattctcagtcaatgacagggaattctgatttgataaggaaattttcttgggttaatgaatgcaactgtagaatactgagtccgaccagcagaaacctacagccccaggccagctgaatcccattccttataccgtgagtatctgtgttcccttgcagcgggttttgtaggagtcagggataaagatagggaagcaggaggaaagggtcatagaatgctgccaaaggctctggaggctcaaaaggaagaactttgaattcacaaaacactatgccagctcagacctgggcatccaaatcagttaggatattggctaacagctgtaataaagaatgctacaaaaacagaagcttaaaccaaatagaattatacttcttcctcataaaccactccagggcagcaaggtaactcttcttttgaatgtcatgcaaggacccctgttttgttttgttttgttttgtttttttcccaagactgagtctcattctgtcacccaggctggagtgtattggtgtgctcactgcaacgtgtgcctcccaggttcaagcgattctcgtgcctcagcttcccaagcagctaggactacaggtgcccgccaccacacccagcaaattttttgtctctttagtagagtttgtctgtgttagtcaggctggcctcaaactcctgacctcaagtgatccgcccacctcagcctcccaaagggctgggattacaggagtgagctactgtgccacccagccaaggactcatgttttgaaaaggctgtggattatcatctcacattatgtctccagcaagttacagcagctttgtgattccaagtagcatggatggagatggcacttgtcatccccagggtggtatcctcattcctacctcctgcaccatagccaggctgtaggaaacagactgggaggaacaggagaagagcatcttccttttaaaggacattgactagaagtttctcctaatgctccctttcattccctgttgagcagagctgagtcacatggctatggcccgctgcaatggaggctgggaagtgtagtttctaactaagtagccaggtacctgaataaaacccagagggtaggagatgagattctattattacaagaagacacaatttctgccagggctttaaccggtggctctacccttcacagctggacattgctggatttttggatgattatttcattgtctccactcaaagattaagtttggaaaatagggaatttttctaccaaagcataggaactccaggccccagcccctcctcactctttctccctgttcattctcatctctttccagttccttacctcctgtaacctgtgggcatactaaagtaccaaggtaggcttagctgcaggcacggtacttccatgattcagtgccccgcccccaccactgagctaggccactcccaccaacaacctcaggccttcagatgcccaatttctgtgtagagctttgagcagtgttttccagttgtgaagggcaaaggaaattctccaattatttgtgtgttcatcttctctacctcccaggtaaaaaggagttgtctcaccattatagcttgtttcagaaacagtgtcaaattctcatcacagctcatgcatgccttctcaccagaagtaccctaattggttctctgactccaacaagagagctaggctttttgtttcttttgctttgttttgttttgatttgctcctttaaaaatgtttatggtgagctcagttatttaaaacaattcctggcagaggatttaagaggcctggcagaaattatgtaagcttgtacagtcatcttcactgataatgagtaaatcagatagcagacattaaaagattaagcactggtgtttggttttttggttggttggttttgttcacttgtttttaatgttgcaaaagtccttcatatgtcattgacaatagaatttaagtatttttgaaatgtactcagttcagattcaccattacatttcatgtccttaaggttggtagcttaagatagcttgtgcttcagttgcacaatactggcgtcagctctcctttaactcaaagctttctggtaattttcatctactggcagctcagtgggggcattttcaagtctcaatcacatcactttaatacataaacaaaaaagacccaacacaatagcaaatgaccatgagcttagtgccatcttgagtgtatgcttttagaccccagtgatgatacaacctttccttaatacagagaggaaaacaattttgatccgagaggctttctcccaggtgcatctgaaaaaacgttcagatatgtctcctgaatggttttgactaacacaacttactttcccccagaatagctcctctctaaaaaatgccaaagcttgcctttcagggacaaatcaaaggctaagcctgaggatgatggggtgacttgaaaaagactagccaagcgcttgactgctcagtgcagcctcgataacaccattcttggtggtgccatttgctccttgtccacagcccatatcccaatgagggttattcacttttgtaaccactggtttccctctgatagtgtctaaagaagcaaataatgatgaagtgagctgtacctccaacagagtttgaagctagccaggagcccttactgatgtttaaaaactggttcttttcaaaattgtggcaactttattttcagaaacaggtttcatcccaataagttatttggatgttttagaatagaataacgccatttgttgaaattcactgaagtaaggaacaatgtaatttgccactaaaattttgcacatttcatttttcttcaaaacacccagttttgattttttttgtttgtttgtttgtttgtttgtttgttttttttgagacagagtttcactcttattgcccaggctggagtgcaatggcatgatctcggctcatcacaacctctgcctcccgggctcaggcgattttcctgcctcaacttcccaagtagctgggattacaggcatgcaccacgcccagctaattttttgtatttgtggtagagacggggtttctccatgttggtcaggctggtcttgaactctcgacctaaggtgatctgcccacctcggcctcccagagtgctgggattacaggcatgagccaccgcgcccagcatgatgacttaaattctaatcatagtgatgttatgttcattgacacattactctgtgctaggcaccgtgacaggtgatctatgaatgctgtctcatgtagtcttcactataatccatgaattatatatattaacatgaaacccatttcacacgtgaggaaactatggttcaaaatggcagttagcttctccaaggttatataactcttcaggttttatccagaatcaaatctgagctctgattccagagttcttgctctgaactctattgctttcatgataaatttccctaagggctaaaaaatacctcgtaagaaaaatgtcttaaggccgggctcagtggctcatgcctgtaaccccagcactttgggaggctggggcaggtggattgcttgagtccaggagtttgagaccagcctaggcagcatggcaaaaccctgtatctactaaaaatattagctgggcagggtggcttgtgcctgtagtcccagtaacttgggaggctgagatgggaggatcacttgaacccaggaggcgggggtggcagtgagctaagatcacaccactgcactctagtctgggcaacagagcaagacgactctgtcaaaaaaaaaaaaagagagaaaagaaaaatgccttaaaattattatgcatgcaactttttctttctttcttttatccatagctatacttggccaaacaacattaagtcaggttatatttgtccttttcctcaattgttcctacctacctaccgacttacttggctattttcattcatcattaagtgattgatggatcatagttgctaagagaagacacggaaatgaaggaaatcaacccattccttcattgattcattatgtttagagagctaccatgtatgaggtattttccaggactttatgataccttaagcttacattctcgtgaaagaggcagacaataaatagtataaataacaaaaacatactatgggatacgttttaataataagaagtgctaaggagaaaaaaaatagcagagaaatgtcagggtaaacatgtattgaaatgttagatgggctgtccaggaaggggcagataacaaaggtgacctttgagtagatgccagaaggaagttaggaagttatgcaggggagccttggaaatgtgggggaattgcactgtaggcagaaagtacagcagatgcaaaggccctgaggcggagaatgcctgggggattgaggaagaactaggagaccagtggggccgagtgactgagtgagggtgagagtagcacaaaatgcgtacaacaaagtatgttatggagaaggctgtaggttagaacaggaactttaactcctaattaggtggttttcagtagacgagtgacacaaacataatgttatacttggacctttgctgtgttgagaccactgggtgtgggagatgggtggatgagggattgggaaatcagtgaggagcttaccaccgtaacccaggcagaagatcatggtggcctgtgccagaacgaggccttcctctctttctccctccttcctttcatcttcacagattattctatattagtccattctgacactgctaataaagacatgcccaagactgagtaatttatggaagaaagaggtttcattgactcacagttcagcatggctggggaggtctcaggaaaggtagaattatggtggaaggggaagcaaacacgtccatcttcacttggtggcaggaggaagaatgagagctgagtgaagcgggaagccccttataaaaccatcagatctcgtgagaactcactatcatgacaacagcatgggggaaactactgccattattcaattccacccccaccgggtcctttctaccccatgtggggattatggaaagtataattcaagatgaaatatgggtgaagacacagccaaaccagatcatagtccatgtctacttcattcaagagaatgaatgactgaatgacacttaattgggtcttttgatattagcatccagtattttgtcatcttctgagaggggctacttctggagacagtgacacagaaaaccagtgctcttgatttaagcagagtggatcagtaagaggtgtctctttcatttgtttagattatgatatttattcaaagagaggagcagtgaactgtggttgagtttgttattttaatgaaattacacttgcaactattgtaggtgtctttctatgtaatggatgctttacattctctcactttttttcctccagacaattctagacagcaggcatcatgattcccattttatagatcatcaaattgaggatcagagataccctgcaaagtctcatatggctgagtagcagtactctttacatctgaacccaggaccactctgactccaaagccaatattctctctgcatatttaatagctgttctttttaaaaaattgtatctattagtgcatatttgatggtggataatgtatatttaataaacccactgagtcatgtagctgtacaagcatttaggagattatgccatctaggaaattaaatattatcaagtgttgtcacacttgagcatgaacaaatacagactgctgggctctatccccaaagattctgattagaatggctcaggccgggtgcagtggctcacgcctgtaatctcagcactttgggaggccaaggcaggtggatcacctgaggtcgggagttcttgaccagcctggccaacatggtgaaaccctgtctctactaaaaatacaaaaaattagctgggcatggcggcacacgcctgtaatcccagctactcaggaggctgaggcaggagaatcacttcaacccaggaggtggaggttgcagtgagctgagatcacaccattgcactccaggctgggcaacaagagcaaaactctgtctcaaaaaaaaaaaaaaaaaaaaaaaaaaacaagaatggctcaggtaggggccaaaaatctgcatttctaacaagctcctaaggctgctcatgctgctgatcctggcacagcactttgagaatccttggtccacgccaatcccatcatttttgcaagaacaaattggaggtcagagaggttaacactattttcaatgatcagttaatacccctcccacctgcattaactgtaagagaaagcttgaatgacagagatgcacgactgtcagaaatggaaatgtagggtttttttggcccctttgcttgttttaattcaagagtataaaccataggtaatgttgtgctctcactttctcctgatttatctccttttgagcacttaatgaagaggaaccccactcattcacacacacacattttatttctcctgccctttttctttcctttccactttgaaatttctgttgcactttgtagttgtccagaatattttcagaaatacctccttgtgggtgaatctgctgcaaacagggctgatgaagtccctaatggttgttacccagagccctactgaatcaaaagaaatacttattttttctaaaaaaggaatcagtggtgggtttgtgaacctatgattagaaacatcctgcggggacatctacttgttcatatttaatgtcatttactagtagtggagcttacgtgcagttggttgtagcaaacagctctttggttctccccattctttaaggcgaaacttaaatgtaatttcttagcattttgtggctgaagctcaaaccagatggctccttcttttctttccagagcacttagttcacacttctaatgcgtagaacatgcaacatcgtcgcctaattttaaatggcttactcactggccagagtcatgataaataaagatggtgtggaacgtttcttctgtttcatgctcatggaacacagcacaatctttggggctcagtttactgagtatgagacagcaggacaaagtagtaaggggtgtgagcttcgaagccaagcaggttgtttggagactaggtttttctacatctaccacacagcttcactgtaggctcagtttctccctctattaagtggagaaataatagtaatatcacacagagttgtaaaaagctcttaaaatgatgacgtcatgcttgcaaagtcttagcacactgttcagctcatggaaagggctgaataaatattaaatataaaccagacctcatgagcacattcaatccccagggaattagtctgaaagaaggtgagccctcaacttctacaagtagtgcaaatcgaaagcccttcctctcacatatggtaatccccaggggcttgtactgtcatgacccatgttgcttctgggtcctgtgcttgaaaggctgtctctttccccatctgagtcaaccgggcggtaaaacgtggctcctgtaccaggttgcacaagaaacatgcatacacacatatcactgagcaaggtgaatgccactgagggttcggggaccaggggacacctgtgtgatcttctaccacctttccggccctttcctttcttcccttcttcttctactcccagttaagctttcattttccaatgctcttcagcaatcgctattttactctcccaaacttctacagccaaacccagcaagtgttcagttcagcagaacaaagggtcttgctctttgctggatctacctttctttcttagaggggagttggggttgaacaactgtttcgttcattacagctattattaatattttcaaagttattattaatgaaagagtgagtaacgctgccttattctccttttatttctcacccactctttttgtgttcagatcactagattttaattttacgccctttccccagcccaggactaggtctgtgttacccaggaccatttgaaagttgaaagaggaactcattggtgatacactggcttaaaaaactttaggaattcagaaaactatccaagaataacttataaaattacagatgaaatatgtgttatagtttaaacacaatatttttctgagttctttggatttttaagtacttaaaatacacagtgactatctcttttcaattttccaaatatagcatctaaatttagagagatgttaaaacaatttgggggttgtttggtttctttcctttttttttttttttttttggcccctttgctcaaagaaatagtgctttgctttcttctaatgaagtaagccctggtccaaggaaaatataaaataaaatcgctattttcctaccacctttgggctatgtaattcccatttcattttccaagaggctaaattttcaaatggtttcacttacacagtgcagaaaaattagacatcttcgtcatttgggggaaaataatgacagactctctacaagaaaaaactatatatatatgacaaatcatattaaaagataacggatcactttaagtatgggaaacagaccttgaagacaaacagttttgcacccgaacttgatctaagcatgattcccagctaattgtttggttctaaattaaattattccttttgataccgaaattatagatacagttccatttggcacttcagggtatatttattttctctgtaagtgcttgtccatatatttaaagactacagataatggatttttaagtgtatttaaaaagttaagcctcttgagaatttattttaaatggaaaatatctcccagcagattgtaatttaaaaaattaaaggcaatacaatacacatgcatagagataacattcaggtgtttgtgaatcattttccccactctgctgattgtctttgtggttaatcatggaactgatggtgcagaatacactgtggatgagtttacttgcctgagcacttaggtggcttagagcagatctcttgcaaaatgcgagaaaaaatatgaccttggcctacagcagtgatcaacaaacttattttgaaaaggattagaaagtaaatatttaaggcttatgagcgagatattctgttgcaactatccaactctgctgttgcagttcaaaagcagccatatacatgtaggtgaatagtgtggctgtattccaataaaactttatttacaaaaacagtagtgggccggatttgacatgcaggttgtagattccagactcctggtttggaggcctgacttcacaactttgtgtcatcctataggagtatgagttcagctcctggattcagcatctcagttaggcccactctagtgagttagcagagcagccttctttacgcagctgccataaacaaaccaagcaagccatgaagcccacgcttcagtgtcataatcacatttcccttccacatgatctgtacacacctcaaaccccaatcctcacaagtgggattaagagcctcaggaagagctccaaataaatcctcttctcctgtccatctcaccacagaaaagcagatgaacagaaaatcagaaagtcagtaacttgtctattcctcagagttagatgtcagtgtgatacctgacatagagacaatctgacagatcacaaaagtctgattcatttataaaatatctggtgagtggctactgtttgtcaagctctgtgctagtgcgagagatacaagggttgctgggatggcccggtctctgcaagaatggaggttttattctagtgagagagacacaacatagggaggaatccaaaagacagaaggagggtttgccctgagtttcctgttggaaattgggactctggtaagcagctgtgtgataacagaaagaaacatcagcctcatctgtataagcacgtcttcattcaataaaacacatataacaggcctttgctaaacactcgaggtaaaatggcaaacaagacactttcttccctcaagaagttcacagtctgataaggaaaaaagcaaaaagaacaagtaatgacaagttgaactcctgaatattctgacagatcaggcaattcacacacacaaaaaaaggaaatagaattgccgatattataaaacaatctctaaccttcccattcattgaaaaattttcaaactaatactacactctcttccaaccatcagattggccaacaaaaataaacattgtattatcaaccgttagcgtgaggagacaactcttagagcccaaatcgataaaaaaaaaaaaaaaaaaaaaaaacttagcatctaactaaattttaactgacgtttcatttgaatcagcactttcagaatggctctgaactacttaaatatatgtataaaagccaggtataaaggtatttgtggccgaccatggtggcttatgcctgtaatctcagcactttgggaggccaagacggatagatcacttgaggtcaggagttgaagaccagcctggccaacatggtgaaaccctgtctctactaaaaataaaaaattagccgagtggtggcccatgcctgtaattctagctacttgggaggctgaggcaggagaattgcttgaacctgggaggcagaggttgcagtgagctgagattgcaccactgcactccagcttgggcaacagagggagactccatctaaaaaaaaaaaaaaatatatatatatatatatatatatatatatatgtatatatatatatttgtatatatatatgtatatatatttgtatatatatatttgtatatatatttgtatatatatatttgtatatatatatgtatatatatatgtttgtgtatatatatatgtatatttacatttactactacacagttggtaattaatgaaacggaaaacctcagtgttcagcaatagggaactgctttaatgagagcagatagatccatactaagagataatatgcagtcataaaaaagcaatctatataaactgatgtaaaaagtatttaatagctattaagagaaaacctacctactgaactgtttaagtgtatatatagcttgcaaatttggtagaataatttaataatcaaaatgtgtggctaatcggggaagtcagggcttgttgagatagtaacaggctgcatctcctatttcacttcagttgattccatttttaattatttttgtattttaaaatgactattaaataatatgagttaaaggatgtatacctatttaaagactatccactgagaaatctcacccttaattctaaagggcgctgcaattcagtgatcaatagaatgaccaaatctccaccctcaaagttccttggttattttgaaaaccgtactgctaaaaagagaaaaaaaaaagtgtcattcttttctgcctgatatcttcccagcatatgtaaagtagtattcctggtgatagtatctgaaaatcaacataatccaaaggtcctcactttgtaatgtttgcagtaagattccagcatcttagcatttaactgttttcagattacatccatttaaacatctgtgattcattatcgtaaatatcacagttgtggggaccatatgcttcagcttgcagcatatatgtgtgtgtgtgtgtgtatgtatatatatatatatatatatatatatatatatatatatatatataaagaaaaagcacgagcaataaatctcaggaaccttagacttgccgtgggtatgtgcaaaaagaacatttccaaacacatggggctgtctataatcacagtaatgtacttgagatcccatgtaagaattattcaattgcaaaagttgccacttgtgatggaaagctatgatttacatttggcttgtgcacttcccatgataattcaaatagggtggaaagcagcacaaaagccttctgctgcattggcttttacttcttaaggaaatatgtgagcgctattgttgtcgagtggagaaatcacagaaaaatgagatacctttaacaagtggcaaggcactcttggcaggcatccttcattcccatgagactggagctagagatgatgccatatggcctaagggatgtaataaaaatcacttggccactggaggatgaataggcatggcctacagggctgattattttcttgcttacaccagaaaacccacgtatgcacacaagaattaattgtgcttcatgtattgtaagccaaatcattgtcttttaatttcctgataaagtcttgtcaactagacagaaccaatctgtaatcacagctgatgagtatctcacacactgcaattagggaggaggtaaatgaattaattggttacaaccaaaaggagtctgctaatattttttgattgccaactctcttctagggctagcaccaagcctagccagagatatggagataaaactgtaggaagctcttgccctcaaggatcttccagattaccaaagggcaggttaggtcaggagaaaattttcaaggtgtggaagctggccttctgcagtctgctgcagtttgattggcatccctgctggttattatcaagccaccaaccttgtcaaagccttgtgcattccctttaggaaggagatccattgttgccttagatggtgttcttgagcccctaaacactaccctgccatctagaaacatttctggaccctgtcctggaatcaaggtagcacaaggccatctctgcttagaagcattctagatatccacaaggaaggaaggatggggtgtttaaaatgcttttggatctttttgtacaaaagatgctcatctacatactggctacacgtcatttatgacatttatgaaaaccaaaattgacattctgaagtccttggatcaaatttctgtgctgttcttttctcctccatggtgttttatttgatgcgatcttgggatgtgtgatgacttcgtagtggaatagcaggtgttgatccgtaggaacttcaaatctcaagagttatttgataaaagttatagacagatcaatgatagcaaatttcaaacttatgtttccccagtcattgaagaaagaacactagtaacagctcttgactacatttaggtgttcttgactatctttaatgggtgcataaggatttgcctgggccccattcattcattttccttgaccctcttcagagcttgagtgtttcctaagctttgacacacagggtcttctggcatctgctgtctggatttttgctgatggatttaattactgacttcaagattctactcaattccattttgacaccttttttagctcaagacacagactctttgactccctgttatgtcctgtgctgctaagctgtagaataacttcgaacatttactttggataccatcatttgaaggaatccactctctttcccaaggacctggaactggattctatattagttgtaaaaagcaatccagctttcctacttacagatgtgtgaccttaagaaatgttcttactctctgagcttcaggttttctcccctaccttcatgatactgttggagaattgaaagaaataatgtttatcaagtatttagtccacggactgacatatagaaaatgcttcataaatggtaggtattatatatgatagacatcaaacatgaaatactattagggctctgtactattagcactattagggttttgtagagtgacttgaatatatagggaaacaattcatgtaatccccaaggtgtgttcatatgaaccaacacgctttgatgccacagccatttataccagctggaagagtgcagaactaacataaatgatgtcctgctagcatctgcagctgggtcataaaccaaagcttaatgttttacaaagttttgatatgcagtagtcaatttatccatttttgtgaatcaagtaggttgggaaacaagcccagcaaaacacagtttggtaaattttatgtgaaaaaactctcttctttttcactcagtaatttttgcattttaaaaaaatacagtaatcaaaagaaatatgatgggccagtgaaaagcctggcctttggagtgtggtgaacctgagttcaaaccccagttctacaagtaaacctttgcactatgggtggctcagtctctcccagcttatctcattttgcctctgtaaaatggttgaaatatcggattatggggattggagtgaaatggaacactgacccttcaacatgacagccctgccaataattatggggtctaagcttctagacgctaagtatcatgaaaatagatgctattccacattcacctttagttgccgtttatcccttactgcctactgtcttgtacattgtaagtgaaaaaatgatgtttttaatgggttaatggatgagtatgttgaactttagaataacagaatttcccagttgtaagagacatcattcaatgctggaattgcttccacaatattcctgatgaagtcatataggttccacttgaaagtacccagtgacaagcacattatttcacccagaaggaactagatcttccaaatggtaacctgaattgctttaggcccctccagtatggtcatgcattgtttaaccatagggatatgctctgagaatgcaccactgggtaatttaatcattgttggaacatcacagagtagacttacacaaacctagagggtatagcctattacacacctaggtgatctcttacaacctatggctcctcggctactaacatatatagcacggtgctgtactgagtgctataggcaattgtaacacaatggcaagtggttgtgtatctaaacatatctaaacacagaaaaggtataataaaaatatagtctaaaaggtaaaattggcacacctgtatagggcacttactacgaatagaggtggtaggattggaagatgctctgggtgagtcagtgagtgagtggtgagtgaatgtgaaggcctaggacattactgtgcaggactatagactttataaacactgtacacttaggctatactaagtttataagaaaaagctttctttcttcaatcataaattaactttagcttactgtaacttttttactttataaactttaattttttaactttttggctcttgtggtaacacttagcttacaacacaaacacattgtacagctatagaaaatattttctttatatccttattttatagacctttctatttttaaatgttttctctttttctttttcacttgttgaacttctttgttaaaagctgagacatgaacacatacatttgcctaggcctacacaaggtcagaatcatgaatatcactgtattctgcctccacattttgtctcactgaaaggtctttaggggttataacacgcatggagccatctcctatgatatcaatgccttcttctggatacctcctgaaggacttgcctgaggctgttttacagttaacattttcttttttttttttttttttgagacagggtctcgctctgtcacccaggctagagtaccgtggcccgatctcagctcactacagcctctgcctcctgggttcaagtgatcctcctgcccaagcatcccggttagttgggaccacaggcaccagccaccccacccagctaatttttgcatgttttgtagatatggagtcttgccatgttgcccagtatggtctcaaactcctgggctcaagcgatctgcctacctgggcctcccaaagtgctgggattacaagcgtgagccaccatgcccggccagtaaaccttttcttaatgggtagaaggaggagtacactctaaaaaaaaaaaaaaaaaacaataaaaacgatagtatattaaatatataaaccagtagcatagttgtttattatcattaccaaatattacatatggcacataattttatgtgcttgacttttatgactgaaagtgctataggtttgtttacaccagcatcaccacaaacacatgagtaatgcattgcactctgacgttatgacagctacctcactaggcaataggactttttcagctccgttatcatcttacgggattgctatcatatatgtgttcctctgtagatcagaacatcgctatgtggcacatgaccgaatttggacaaatgtgacgtcatgcaaatatgaatatttgcattgttctggcttgtagccccacacctgcatagctgtaggacctcaatgtattctccttcctggccttttattctggttatttctggaagacctcagggcatctgtcacatgaattcacaaattcttcttccatgtcctctcattctggcctctttaattattaacattcctgggaaactcttggaggaagggcctccccactgccctctgtgggaaaagtccatctccaggatccccaaagccatgtacccctcaaggtgccaacagaccctatgactgctctagtgttctctctaccagaacaaagccaagctgtactccactcaaaaatggggccaccctgctgctcagcataacagtttgctattaggaaacaaaataacagtgcttgaaaatacctaagttgtctgtggtttgtgaatctttgagttgtgtatgtagctttcttttctctgaactatggatccatggggctggcctaggaaaccaatattgtgttcctctctctctttctcctggttctgcctccctctctaggtgctcatgcagaagtagtcctcctcagaggcccccttcctccccaggtatatctgctcttgcaatagagaggtaactgggaaatcacgagactgtcaaggcatcaaaacacaatcagggtctgaatcccaatttaggcttagccaggacactttgtcacatgtccctagacaaccccaactgcaaggccaaacaccctgaaagttgcagtggagtaaagctctcttcacattaatttacccttgagatgcacattcagaaggagacttttacacataattgctataaagtttaaaaactaagggccttgtcagagacgtgtgccagtcatgaaaataccaagaagggatctctgtaaatccgagatttggtgattctcaaacttgctgaatccatgatttttctttcgcttaatgggtgactttcaaatccacttactcaaatcttcacttgagttgatgccatcattctcagttgtgtttggggagtttcaaatctgcttagctgccaagttgcagttctgctatttattcattcaacaaacagggttgagtatgtactgtgtcaagcactgtgctatatataaagtaattccaatttgaaacacaaattcgtagtgattataaccaccatgggatagatgatgcatagcattctatcaggaaacaacctgccatgttttaaggaatccacggcaagaggagaacgtaagactgacacacatacaaaacaaagattcaaagctaacggctcagtttttaatggtaggtggagaaaatcccctgaaagcagatgtggcctctgtctttttccaagaggaagcccttaagggttacatggcaaaaataggtttctgctgaagattgttggactgtatcattcattatgatatcttctgctgacatgatagaattgaaactctattttatcaaagttggaactgaagcatggaatggaattaagactgttttatgtttgttctgcacttaccaaattctataaagcctttggaagtgaaattcactcctgggtcaaccagtcatggctagaatactcccagaaccttatagaagctctgcaatgtcagtgctgactctaggccaaacatggaacacggaagcccaatacgcatgttcaggaagcagaagagtagaaataatcaagtctgtagggtgtgcttcttgattcactcatggatctgacccaatgtgggtggaattgaacgtatgttaatgaaggcttgagtgactagaatgctggtgaaatgagagtattcaggaaagtcaaaagaaatgcttcctgtttcttccatttggaccagtctaaagagactctggactaagccctgtgagtgctttaaaaggaaggtggtgcctctggatgccagtggcatactgagggatatgaaaagcaattaagtgatggcctgtatcctggaaagagtctgtctgatatttctgaattaaatgctactttagttgtcagaaagacattgtcatgccccagcaaaggctttgcagattaaccaatatgcaggaccttcatgctgaggaagaattgaattctgtttttccaagtaggcaaggaataccaggatagctgggtctctccatctcaggcaaaacagacaatctacattcttatgctctggggcagttcctatctgtgtcatgtccttgagacagctagtataggtacttctgagagctggtaaaaattttagaaaagttgcaagccaactgaaggcacattggtaccttgaaataaacaacgtgtagagcatttaaaccacagaaatcggcagatgctacaactcgagactttttccaagactagcacatcactgcaagtccttctcttctgtgtgtgcgtatgaagatcctggaggtggatctgtgcatatctgtctgggggagggctacaacttccagggtgactgattcagagcctgtaattctgattcatatgcatccttgcacacatgtacaagtggaatctgaccatccactctgaaagggccccacaacttatgtgcagacacatttgcaaagcctctacaaatacatgcaaactctaggacaatttacccatataagatgtgagtgtataaatcacagattggcccaagcacgcttataagaatagcacaaaattcatatattagttcatacctagctctgcaagcaggactgttctatatttggcagataagtttaaatccatctgcatttcattttttctgggatcataacagagcttaattttctcccttatccatttttagatggtaggaaatctatgccttttggattttcatccccaagaaccaccttcaaaagaaagaaatggaaaagcataaaatcaaggtcgggaagattaagccccttaattcacatgtcaaacttgccatttcaattgtggttttgtctcccagctgaagtttgtctttttgtgacatttgcattaagcccaggggacattttgagtggaaaagcgctgaaagcataattgaaactctgagtgttgccttttgtctaatttgcaatttcccccaggtggggtgttttcactaccccccgactccaccccgccctcccagggtgttctaagattatctcaaagaatgatgttatgcaatttattccaataaatctccatgtacagtatcttatatgtgtatattttttgccttccagaagttatttcaaatccgtgagaaactatgtagggaagtcattcataggttcagaagagtacagatagttcatttcccctttcagatagaggttttgagtatttgttcacaagtttaattgtttagtcacatctttcagttatccacatggtgtcattctgagccacccaggaagttgtctctatagaaacaagcattttttaaatggacataaactgttcagttttgtccttaaatatgtctttgaactctgtgctcaattcacatatggtcttgatatctacttaaaagtttgagaatcactgacactttggtggcatcaacaaagtcaataacatgaaacacaatgcagggctgatgtcatcacatgcaccctttaataggaaatttaggatatgattataattggtgagaatgtagagtctgttttctccaggagaaagaagaaaacgtaaaagaaaatgttgtggcttgtttttcttttgagtcaatgtcttcctgtttatcagagctgtcctttagatattgccaaagctatggcaacaggagcaatttagattttgccctttctagaatttctgtttttatcaagacttcattatttatattaaataaattatttcttatctgatatttggatatcatagccttcctggattatatacctgagtagagtggatgcaggcatgaatttgtctaactgagggttggatggcaaggaatgtagtaccagccagcatttccagagggtacaacaaacgtcactgtggaggttttagtggatacaaggacaaacttttttagtggatacaaggacacacttacttcttttgaatttggctctttagatttattttaatatttatttgaaaaaatacctggcatattcaacaggtattataaatactacattcaaataattttataatttaaagggtcagtcagttaaaaaatattaagtaaataatcgatgtggtatgagaggtggcaatgaaattgtgagtctggaagctgaatgactaaaggaaagaacacattcatctagaaagactggcatagccctcaggagtgtgggctctagaaccagaaaccacactcccgagtttggatttgacctcggttcatataatgacttcgtggcctcggataactcatgcaacctcactaagtctcagtttccacagaacaccaaaagttcctacctcaaattgatgatgtgaagaagacgacatgaagatttattgcaatcattagtgtaaagctcacagtgtaatgtaatgtcattactttaggaaaactcttgccttacatttgtacgaagttgtcttcaccaacaatccgtttggagaatatcgaacaaaactttgttgattctattttgagcagggctctgtaatttcactcctttaatatcgtttttccttcacaactgttcacatgaagtacgtagggcttcaccaaaacaagtgaagggattcaacaatgggcaagcctgaatcagaatcatcagccccacccctttaaccctagcagtgatgcctgtagtaaccatttccatggcaacagcctgagactagcaaggtacctgactagaaggaatgacagaggaggaggtagaaaaatcagctggaagaaggaagctgtgtaggaaaaggaaaaggtagcttccttagtgcccagaattatggcaataatggtgatcattctcattcatggagcaacaagctctgtcctaagtgctttctgtgtgtaggcatgcattatcttgtttacacatgccataaggattatagtacctttcaggaggatgcccactctatggataaagatgtcgaggattaaagaatataggtggtatattagtccattctcatgctactaataaagacatacctgggacagggtaatttataaagaaaagaggtgtaattgactcacagttcagcatggctggggaggcctcaggaaacttacaatcttggcagaagggaaagcaaacacatccttcttcacatggcagcagcaaggagaaatgcagagagaaggggaagaatgcccatcagatctcgccagaactcactgtcacaagaatagcatggaggtaaccactcctgtgattaaattacctcccatcggcttcctcccatgacacacgggagttataggaactacaattcaagatgagattttggtggggacacagccaaaccatatcaggtggtttgcccaacgtcacagggctcctacacacaagccaggattagaaaagggcttagaaacctacccttaaaacttccctttcttggggcacggaaataacagttgctggcatgccagtccccaacctctactcttttccaggaatggctgggaaatgtggagacctggcaccttgacaaagagtttataatgtaaggtcctggttcctggctctgtctgcattagattaatcagggggagcttttaagagatactagtgcacacagaccgcaactcagcacagttgtatcataatcttgggagagagtgggggcaggtattgctattctttttaatgctccttcagcatttcttagatggccagccttgagaaagaaccatggcctaaagcacctactcctgagttggtaagtggtatcaaaaatatacaaagacccaattatgcaactgttagctatttgatttagaaagtattgagtgccggtgatgtgccaggtcctgaaactgcagttgttctcagtgtgacctcacttggtacctctgatgatcccaaaggggtttgtgagatgcccaagggggccatgttggggcaactgtcctttctccacttgcccatctattcctaggaagcagatgtgcccagagcttgggctgtagaggcagaatgaacagatcagagaaggttctcgctctaggcctttctggatatgggaccacgagctagtcagtcaatctctctgagactcagtctcttctcctgtaaaatataatatgatgcttatatatttatagactgtgcattctcattggggctatatttcccccacaggggtgaaataggttcgagggtggggggacaaaaattgcacttacaaatgtaaagtatagatatacttgtagtacctaaacagatataagtatatctgtgatattaaaattttacaggaatagtggcaattagaaaaaaatacttaaaagagcccttaggggagtagataatgaaaaaaacaaaagttaagcaaccctgctatagaattgctatgaggctgaaaggaggtatggacttgtacagtcctttgcatagagcgtagcactcagggaccactcaataaatagtagtgccatgactgttgtctgtccaagcatcacttcattcaaaatgcacacactgattccaaccattctttggggctatgcaagttttactggcatctttgggacagataaggcaccacctctgacttcaccaatgagctaggtcagagctaagcagagcggctgagtgccattctaaatggatacacacggggtccaggggccaaggggagagcatagctgagttcttcatttccttgtactccctgctgctgggttcaatgaaatcaagaggtcactacgggcctcttatcccaattcacagccttgtcggcagcctcttgctcacagcacagaagggagaccccccccccccaccgccccgcctccaatcctctaccattactaaatcatcattttgctctggagagtaactgagcaaagtggaattattactgatggcctcccatgtggaaaaacatgctgttcattgctgaagatgtaaagatgaatgaaagaacaagactcaatttctgctcttggttctggtgcaaaaaacaaatacataatatggacagattgatataatataaaaggttctatgggaaggaaattctggaacacaaagagaatgcttgaagaagttgcttgagttgaatcttgaagagtaagcaagagttaacagggtgaagaaggtgagaaatgccttctgcagagagggagcactatacacaaagggtgggacagtagagtagggagatgcaagagtgggtgaggtgtgagctatgcagtgaagacaaaggcagaggggaggctgatggacagcctagtcatggaggaccttgagtgctaagtattgttttgcaatgaagatccataattatatgagactcaggtggagaaaagctggtcttatagttgcaacaggagaatccaaggcttcctccagggagcagagctgtgtggcccccagtaccccacattgcctgggcttagcttatctccattctaacttccttcaattctcccttgctgtctgtgccaatctaactgcttacatccagttcggtagatgccgcaggactttgcatatgttatggttttctctgcctaagtaataggtccccaattatttataagagtagtaaattgatgtctgtcttccacattagacttcaaactagggactgtgcctgtctttgttcaacattataacctcagcatctagcataatgtaggttctcagtaaatatttatggtaggaagaaagggtgggaagaagaaacttagctgggaatccagaacccccacaaactttcatatgccttttcctctaccccattcactccccagctgagactgtcttctgtgatcctgttcgagggttaagtctggaacctcatgctggcgattgaagcagtcatttcctgtgaggccttgtcatttgagtaatttgcctccagtggatgaatactaattgatgataacagtgaaagcaaccttggtgtcacttcttcatagttcacttccaaaaactgaaactaagcatgttcaattcatctgggctaccaacatggttagagaaagtgagcaagtgtctgagaaccgcagggtcctgagagtccacttgtgtgtccatgcaaagatggctctaaagctgacttaaccacggaaagccttagaacctttgcagagcgatcaaaaggcaccgcagcgtgcagtgctcttcaggactgggcaggaacatgaaaacaggactgagcagggcaatcacagctctctacagtagtccctgcttgtcctcaggggatgtgtcacaagacctacgtagatacctcagtccgtggatactacccaaccctatatatgctaatttgtcctatacatacatagctatgttaaagtttaatttacaaattgggcacagtaaaatattaacaacaataactaatgataaaatagaacaattataacaataatgaaaatggcacacaatttgaaacttatgaattgtttatttctggaatttcccatttaatattttcagacctgtgttgaccatgggtatctggaattgaagaaagccaagccatggagatgggggaactactgtattcaggttttgataggatttcagaagggttgtattctccatggggtattgtctttattgaaaatgtgcagtggtgacaggcaaatggtccagggttcaaatcctggctcatcatttacaacctgtgtgtactgggcaccaactttgcactccatgagcctcagtttccttatctagaaactgtaggagaaggggatcaaaatagtactttatttgttgtcattgtaaagattaactaaggtgatgtgtgcaaagtgtgtagcacctacccttgaatgtggaaagtgctcaatctgcattatccactattattatcagttaatatgattattatcaccctaagtatcatcttcccagagtagaaatatcagtttagattttcagatatttatatggctttcacagtgtgctaggacctatgtagatgagcttagattctcagatatttatttggctttaacagtgtgctaggatctatgtagctgttgttaccaaaagatgtacacaagaaagttcctagcaacaatatttggagccccaaagtggaaatagtccagataccagtcgagagtaggatagataaagagactcaatacagccacataatggaatactctatgatgattaagataaagataaatatagtaacctggatactatacagtgatcagtgattattgttatagtgattagaataaactaccacaactcacagccacatgatgaatctcgtggcatgtaatgtcgaatgaagaagccaaataggagagagtgcatactgtatgaccacattagatgccatgcaaatgcaggtaaaaccaatctgtggtattagaggctagaataatgtagcctctggggaagaggttaggaattttactcaggaagggaggggactggtaatgtgtcatgttatggcctggttgctggacagttggttgtgcttactttgtaaaaattcattgggttgtatgttctgatttatgtgcttatatgtgtctacattatgcttcaattaaaggtttactaaacaaataagcctgttcagcagagaccaaaaagcacgtagtacaattctatgcttacccacaaggggcctcaaagtttacaggaggaggcagacaggcaaatgcatgcacagataatgagttgtgatacccataataatagaattgtgtaccacatgcagaatcaccattgaggggagcatgatcagccgtcacagcctctgcttgtgtcaatgccctgtgctccatttgttcatgcagggggcccatcttccctattccttcccacacatgaataaggtattccatggcaggaactttgctcacatctgtccactctccatatcagcaccactgccttcattttgtacagccatctttgatgcaacactgaactcgttggaactgggtctcttggcctctcttcctgcccttctttaaatcacttgctataacccagatctgccaaattataatcattgtattgggtcctctggattcttaaaaagtaccctgtgggccgggtacagtggctcacgcctgtaatcccagttctttgggaggcctgaggtcgggagttcgagaccagtctggccaacatggtgaaacccccatctctactaaaaatacaaaaattagccaggcatgatggcatgcatctgtaatcccagctacccaggaggctgagacaggagaatcactggaacccgggaggcagaggctgcagtcagccaagatcgcgccactgcactccagtctggatgacagagcaagactctgttaaaaaaaaaaaaaaaaaaaaaaagcaccctgtgtgattctgatgcaccccaatccttgagaagcactcctcttcactggaagcagagcacacacctgatcttgactctctccacacaacaaatcgtccagggctaccagaaagcaccataacttactggcttttcccaacttgtttcccagagacattttcagcctcatttccacccttcccttctagatccccaccattctagattcccaccatccctgccccgttttaagtttgcctctattcacctaaaaacatatggactattccatatggactgagcatgaaagaaatatagttcctcaaagtaaattaaggagctgttttcagaggaaaggaaatggatggtggataggcaagaaaatgtggcccactagaattctatatggtgctgcatattgtgctgtatacatatatggtgcatgcgtatgtgtacatatgtgtacatgtatacattacatgcacatataccatatgtgtgtatatggtgctgtaggtatatacatgcgcatgtatacaccatatacatgcgcatgtatacaccatatacatgcgcatgtatacaccatatacatgcgcatgtatacaccatatacatgcgcatgtatacaccatatacatgcgcatgtatccatgcgcatgcataggcatgtatatatatgtatatgtatacacgtatatggtatatacatgtacatgtatatgtatacacgtatatgtatatacatatacatgtatatgtatacacgtatatggtatatacatgtacatgtatatgcatacacgtatatggtatatacatgtacatgtatatgcacatcgttaattctcattccctgaatctgttttgctatttagccctcatccctgtgcctttgaatagcctataatgtcttccacattcttaagggccttctcatctcctacttatcttcaatacccagctcaaatattgactctgtgcagctctcctcaatggtcctgagcaccctgtggttctgctcagtcacccacacatgccaggattagatcacttccctcaaatgtcactctgccagatctgactcttcactccactgagaaggcactcaagtgtgcacactcagagcttagcacctgcctggaacatgcgagttcgtcaaggacatgtcttgattgagtgaagtccatcagcacaaagtcacttgggcacaggcatcttgctgtgggataaaacgtaacatttgtgaactctgggttgggaaactatgtggtaattcacacttaataggtcagagatatctcagagataagctgcccaacctactcatgctccttctgttgtttcgtttgtttcccagtgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggtaacacatctgtttgagataacttgggttcaaggaggacattaggttctgtctgtcttatgtggaaaatgggtctttaatttattatgttggctaagattccttttgttattgttgttgcaaatgacagaaatccaactctaaaaatgtagatgaggggcagcgggaattaattgattcatgtaactaattgaggcatagttcgtggattaattcatggaactattttagggatacttctgccttcaggcgtggctgaagctgtccaaatcagctttaatccctgtgcatctcgtggctccattttccttttattagatgtattgagacagtcacatctctccctgcctcccaaggtggaggtctcagcaactaccctctttctgctggtctgaagtcgcctgagaaagcatctcttcaagacgatgctagcaaaaccttggaattcagtctcgtaggttagatcatgtgtccacccctgaactaaacatggtgtccattgggttgtgatgttctggttggccacgtctcggtcacatttcttttcctgaagccagggcagagtcagccctattcacctgaaaactcatggactgagagtgaaagaaatgtagttcctcaaagtaaattaaggagctgttttcagaggaaaggaaatggatggtggatagaccagaaaaggtgacccactagaattgtatatggtgctgcatattgtgctgtatacatatacggtgtatgtgtatgtgtacatatgtgtacatgtatatattacatgcacatataccacatgtatgtatatggtgctgtatgtgtatatgttgtacatgtatgtgtataccatatacaggcatatgtaccatatacttatgtgtatatgtacacatacatatggtatatgtgcatgtaatgtatacacatatgtatacatccacatttaatatatcaaagatatctcaaagctaacctgcccaacctactcatgctcctcctgttgttttgttttgtttcccattgaccttcagtgacttcagtatatctatgtgtgtatatgtatatatgtatatgtaattgtttacggttctgtatatatatacggtgtatatgtatgtctatatgtatacatttgcatttaacaggtcataggtatctcagagataagctgcccaacctactcatggtccttctgttgttttgttttgtttcccaatgacttttggtgacttcagtatatatatgtgtgtatatgtgtatacgtatgtacaggcatacacatactatatatgcgcatatactgtgtatatgtatgtgtgtatatacatacacatggtatatctgtattatatgtgtgtgtaattgcatatcgtgcttctcgtttgccaggcagcagtgcttgttcccttccacaggcacatgcatgcagatccctgcactcccacacatatgcatacactttataagtgtcacaaactgccattcaggcttcccgattgtgccattcggagactttttgctactactgactcctgccttcttcaccaggagctcagggactccaccttcgtgagaaaaggagggcaagacacacagcaggattccagccaaacaatgacttaatgatggcatgcccctgcttggcatgcctagccttctctcctacctgcgagcttggtcttcctcgatttttcacagcccctaattcacatcccttttctccacctgccatattagccacatccctgcttgatctactcattttgttcagtggtggagcgagtgtgggtcacacagctgggagcagagacagtacaactggcaatgtgagagttaccttcccgccagtgctgtctgtgtgatcttgagagcatcatatagcttctttatctgcagaatagcgaggttaaacagcctgcagtggcaaataagtggctcatgtgccaccctactgtcaccgtgctcgtggcagatattgctaataacccctggcttagcctgagtatccttctcactgcaatgcttctggaacctactatcaattgatcatttagtggtgtttctgagggtggaacctatctgccattcctgggctggatgaacttcacaattccccttcagcatctgtgaagctgtgagttaaggatagatggcaacctaaaaacgaatgtacggcacgtcagtcatgtttcagaggaaactggatattggtgaattcataccagtgtggaaatccattgacaccacaaaggcaagcttttctcttacttagccatgaccaatggtcacagcatctcactaatctgtgatataaattatgtggcaaatatctaaagcaacaaagttgccaggatatacagcaaaaacaatgttccatagaaacatggaaatggtatggtgagggggtttgcccatgggcttgaatgcatttagatggcgattgttcttcgtgaatggtggctcatctttctatctggaaaagatactgtcatcgtattttgcttcaaagagagcagaagatcttctgggcaggttctcgggaccaaccccaccttgagggcctgggagagctgggttcattatgaaaactcagccacgcattgtttgtacctcaagtttctgtgagatgccatccagagacaaagctcccctgagtcctggctgtttctcgcttgctgctgtctgtacgcattttcgacaaaacttgcctgtgattgtttttgcttcttataaagggggcggaggctgccgtgtccttcagtttgccagacttcagcagaatggggcattcatctcccacgtccagtaattttatgagatttgaaaaaaggctttgtgaagatgtgtagctgtgtccttcataaaaacgcctcaaaaaaggaaaaaaaaataaaaagaaaatgaaggaaaacaaaatagatagcaaaagaatccctctgaagagagcacatacctcaatggatatgcacgtggtatgtttgcaggtcctactgtgtgcagccaagtgggccagctgctagagaagaaaatcagtgagtgcctgagtcagctcagctcctgttggggagggaatacgaatgtgtgcattgatgcttgggtaccaggcggggagctaacagtgatggatgatctctgcatttggagaggggagaggtcaaggggagctgggctggtcctcaaagcaccaaccatgtgccaggtgttgctccatgggctacaaatgctgactcacgtaacctccttagcaactggaggcagatgctactgtgttctgcctcatagtgagtttttactgattttactgatggaggaactgaggcacaaagagccaagtgacatttccaaggtctaaaaatgaataacaagctggatggaagtgagacttgagcctgggcagcctggcccctgagtccgtgcctccaacccctgcatgagctggactttgaaggacgggtcattgtgcatagttgggagggtctacgagggaaatgttggcctgtcttcatggtgtttctcttctaagctgtgttaccttcagtcaattgctttacctcctgagcctctatgtagttttgattttttcgtctgtaacatagggataatagacttgtttggatcttcctgtggattcaatgagacgatacatgtagcagtaatgtatagcactcagctgatgctacagcaatgaccaacactgatgcttacgtaatacttactatgtgctaaaccctgggtttattcaagtctttcatcctcacaacagtatgctaagggaagctgttactgttactggtgctgttatcatttgcatctactgggtgaggagactgagacacaatggggctgtttcttgctctggacacttagctagtaggtggcggaagagggcctcagaccttagcagcatggctctggctctggagctctcctctttttttttttttttttttttttgagatagggtctcagtcctgtctcacaggctggagtgcaatggtacaatctcagctcactgcaacctccacctcctgggttcaagtgattctcctgcctcagccttctgagtggctgagattacaggcacccaccaccacacctggctactttttgtatctttagtagagatgggatttcaccgtgttggccaggctggtgttgaattcctgaccttaagtgatcctcctgcctcagcctcccaaagtgctgggattataggtgtgagccgcagtgcccaacctggagctctctgctttaacagtaggttctattggctcaccatctggaacagagtaaacctgcacaatgttcactcccacaaatgcagttacaacagaggcaagcaaggcctgcaacccagaatgccagattgtcaggaccagctcagtgcccttcccactttccctcttcccgtggctgaacctgatagaacactcctgtggctgcctgtaaattctgacccttgatatctggctcccactctgcatccctctcccttgcaccctgtgttctgcttcttcccagccctttggttggtgatcttgtcgtgcagcctagatgcaattcatcttctcattctcaggcaggaaatctgcagttcccggagatgatttggctccacctcaaggattagcctgcacacccatacaccccacacaagccagggtccagcatcccagggtccacttttcttggccagaggaagctggaacagaaagggaatgctaaataaaagcatgggaacatgtgggcagacaggatggagacagcatctgaagaccaggaggagggattctagattgatatgacaggagctatggagccactgtaggttcttaagcagagaaacaggcaggataaaaatagtccttggtggtgttcatccaggagccttgactggagtagggagagactagagctactagttgaaataatagctactactattttttgagaattgatttcatggagctttcttacggtcatgcatcttagtctatgtttagcctatgttatttctaattctcacaacctccctgtggggttaccgagattaccccttcctgcagatatgggaaccttgccaagagactctaacttgaaactgacaaaaatgagattgaaattctggcctctgcctaaatacccattctccttcctgccactttgctgctagaaggctgtgccactggggaggctgctgccattgcccatgggtctaggagatgagagcatcagttagagcaacatgggagcaatggagggaaaccagaagcaagatttgccagaaaggaagaaagagccaggatcccgtatctggatgattccagattgtctagcctggaggatggagatgaattggaccagtcaggaaagaaatgttagggaaagacgtctagtcaggcttgagtgtgttgatttatatgctcctagggacatctttatagagatgtccaggagtcaatggacaatgtgggactggctgctagagtacaaatttgaaggaagaacagcatagtggtgggagttttggcttatgttggacatgagtgggttcaaatttctgctatgccacttactcattgtgtgacttgggcaagtgactcaattatctgaatcccaatatcctcatctatcaaatagggataagaacagtctgtgtcacagagttgttctcctgggcatagcaccagacatcaagggacagttcccatcaatggtataattttggaacctcaggaggaaggataaggaactgagggctaagtgtattcactgaggccctgagacagaagccagagatggggaacaggaagagaaagtaaagccaatgaaaagaaagggaaggcatgctcagagaggtaggtgggaccgccagcctaaccaaaacaggggcgatttcacacttgctcatttcatgtcactgtgttttggaaggaaagattctctaaggcaaatataatcacagttaagcctattttagctgtggtaactggagcctggctcttctttaataaaaggagcctggcctctcttatttttacctgctacttatgaccctgtctcacctgcaaaacatataccccaaatctgtgaggtctgattgttaatgacttaattatagactcacaagctatttctgcatttttaatgggcttcccagaatctagtacctgcctggcttatgtaagatcaccttagatctgagtaggcagaagagcagtttaattccaagtcttttgacaggctctgacaaattgttatggaagatagtgaggttaaccttccgtgcacaaaagggctctcctgtctgtggaaggtcatgatgaacttgacacaccaagttatgtctggacagaatcatgacttttccccaccaaatctgctgtttctcatggcccaacaaggatgaaacgaaaaacagtggatgaggggtctgcgtgtgtgtgtttgtgtgcacacatgcgtgttcgccttgtatgtagtttcaaaagtttacacagaaaagctccatgcttcgttcctcacgcagaaatgtctttatctgccatataaatgggattcaacaacttcattttctggcctggccaacgaaaacactcacaaagtaaaaacaccatacttactctttctttctgagttaagaacttgtagcttgcctgattatagatcatggcaagtaattctgacatcagttaacgaacttgatgaagtcaggttgggaagtgacatcaaggggcttagaggaatttattctgacattgggtttgggaactaaagatactgtacctccaggcttcgtcttgaaacatggaagcccacacactaaacagtggtagaatttagatgcctacggccaggcagctggtccttatgaacaaagcaaaagtctcccatggcccaggttcccacggagagttatgagggccacaggctatatacgcttggatccagcttcactgctcccagtctggagttattcctcaaatgcacctgatcacttcgctcctctgcttaataggctctcacttcctgatcagctcacctggccttggggataaattctaaagacagcatatgtctgaaaaggtcctttgtggtttagcctgactgatctctgcagccttctttcaagtctcattcctgctcatctctaagtggcttgacctgcggaattgtcaccttctccaagagccttcccttcctgtcaccctcgcctcttgtccccatcccaagaaaggatctcccctactggtctcactcttggcatcagtgcttttccttcctaggcttcttctcaatttgtaattatgtatttactttcttgttcaggtgtttaatgtccgccttggatgaatataggaacagtctcttccctgcctccctcccttccttgtttctttcccttcttccttcctgtgtgttcaccactctatcctcagcaccctgcccagtgcctggcgcagagtattcagtggatgccttttgaatacatggatgagtggagcgagttacccctctcacaccctacattgaactctccctccttcaataccaaatcacttgtggtttcttgaattggccaagctttcccatcccttcacactggctactcctctgtctggacattgttccttccactgaggttccacctaccctatggtcagcaccattgatgcttcagaaccagccaagattttccttctttgggaacagctctctgaatatcccccagctggctaggtgttctttctccaggctcctgtagacacctgcctggctctctctactcatagtactaaacaaaacagtctgctttcttctgcttgtgcctgtcttaatgctgagctcctgagctgaaggccctcgctcccatgcagcacactaagatcactctggggccagaccaccttggcatgaatcccagtgctgcatttactacctctgctccaggttcctcagctggaaaaggggttcataattgtgtgaacctcatggggatgctgtgaggattcaatgaatcaacacgtgtgtattagtcaaggttctttaaagacacagaactaatgtgatagatgaatatatgaaggggagtttattaggagaattgactcacatcatcacaaggtaaagtcccatcgtaggccatctgcaggctgagaagccaggaagtcagtctgagtcacaaaacctcaaaagtagggaaggtgatggtgcagccttcagtctgtggccgaaggccccagagcttctggcaaatctctggtgtaagtccaacagtccaaaagctgaagaacttggagtgtgatgttcgaggccaggaagcatccaacatgggagaaagatggaggccagagactcagccagtctgctctttccatgcctggttttatgctggcagctgattagttgatgcccacccagactgagggtgggtctgcctctcccagtctactgactcacatgttaatatcctttggcaacaccctcacagaaacaccggggaacaatattttgcatccttcaatccaatcgagttgacaatcaatattagccatcacagcatccaaagtacttgggacagtcagtgtctcacaacaaactggagttattcatagtgattgcattgttaaatccagacctatgataaatgttcagctaatgaacgaggcaaactgaggtgacccagtcctccatccatgcccaacatgaccaaattctatgatttctgtaacctgtatatattcaggattatgggcgaacttacaccatcaccactcttattcctcaggtgctcactgtataggaagcactgactaaacttcctagagaagaaattatttctacaggtccacttaacaaactccaaaagacctggcagtatttaaaagttcattatgaacaatttacccttcttaactggaagtcaatacaagttgcctcaataaagggaaactggtctcttaatcaagttgcttcaattaaatgcaaaaaaatatttttcccttttttgtcattacaagaatttcttaaaaataaaacaaagaagaaaagttatgacagaagctgaaaaggctaaatttaaggctcgtttatcatgcttgttcatcatcgttgcaaacatgcaatttaaaagacgtaattttggctcctaatccagtttcaagaatcaggatggaaatggttccaaaaaaaaaataaaaggagcaatcagtagaaggagccacttgggagaaacagttgtttttgtttttaatttttttaataaaaatataaaatatatcgtcaattgcccaaaagccaacgaccctgctaatacgtctcttactgcattgggtggttacaacttttaaatccactacctatcagaatctcaggaattatttggtaagtaccttgaggaaaacctggagctaattgccccctgtttctacacacatacattcatggggatatttagcgaaaatttttgtggatgatactaagaggtacctgaaatgaccaaaaatcagaaacgaatcacacatttttcagccacatgatactgaaaagttacgtaacttctctgaggttcagttttctcatctgtacaatggacataatactctggccttgtgtggatgccatcatgagacacatttaataaaacaaatgtcatgcttcattcagtgccttgctaatggatgattcttaatcactgatcaattattcttaagtgaagtagccagtaagttgctatcacttctatacatttttcccctctttcctgatctcacacgttctagacaaaaatacttttgcacatttgttactgatgtaaactgcaatttttttctactctgagccaactgtttgaatcctctgtttgttttggccatgatgccatctaaccttcaagacacccgacacgctgcagacatgtgactttactttatttctttaaaacaagagtgtcccccacccacctgtctgagtaccagtccgtggcctgttagaaaccgggctgcactgcaagaagtgagtggcaggtgagcaagcaaagcttcatctgtatttatagccactccccattccccacattactgcctgagcactgcctgctgtcagatcagtagcagcatcagattctcataggagtgtgaaccctattgtaaattgcacatgcaagagatctaggttgcaccctccttatgagaatctaatgcctgatgatctgtcactgtctcccatcaccccgagacaggaccatgtagtcgcaggaaaacaagctgagggctcccatggattctacattatggtgcgttgtatacttatctcattgtatattacaattaactaataatagaaataaagtgcatgataaatgtaatgcacttgaatcatcccaaaaccgccaccatgaacaccctcagtccatggaaaaattgtcttccatgaaacgggtctgtggtgccgaaaaaggctggggactgctgctctaaataattcctgaaaatgagagcaacaagctcgtggtaaattaattaccttgtctctaaaccgtctcacattgactgggagtgacatggaatctgttgacttgggtgattatatcgatcctgcttacatgaaatatgttttacaacaatcccagtggagaatgaatctgcacatttgctgtgaccataaagaaatgatgagttaaagatgtggacacttaatatgccctgatttaacaagtgtgataacttcaaaaaacctgtgaagtaccatgctccatggcaaaagcctccccaggtactgttaaggaaagttagtatccatttaactgtcacctaaagtggagaaaatatatagcttgaaaattattgtacggatccaagaattgggcctagaattcaataataggctgttacatcttgacacatgcctaaattgttatgtttatgtggctcttagctccaggatactattcatatatagataaaaagacatccttcaattcattaatttaaatagataacagattactttaaggatcagaatctaagaaaactatattctggagattaattttaattgaaattcttgggggaaaaactgatcccatagaaagtatagataactaaaaatggcttctttttggcttttgaaaattctaaattttattttatacaggagcatggtccaatagaaatgtaatgaaagccacgtatgtcatttaaagttttcttatagtcatgttaaaaaacgaaaccagtgaaattaactttaataatttatataataactgtatatatgagtgtgtgtgtgtgtgtgtgtgtgtgtgtgtgtgtgtgtatgtataacagatatatctaacatattatcatttcaacaagtaatcaaggccaggcacaatggctcacacctgtaatcccagcactttaagaggccaaggcaggcggatcacttgaggcccggagtttgagaccagcctggccaggatggtgaaaccacatctctactaaaaatacaaaaattagctgggcatggtggtgcatgcctgtaatcccagctactcaggaggctgaggcaggggaactgctaggtcatgccattgcactctagtctgggcaacggagcaagtgtgactctatctcaaaaaaaaaaaaaaatcaatatgaacattattcataagatacctttttacattcttcttttcatattaagtcattgaaatgtagtatatattttatgcttaaggcacatctcaatttagagtatttaatttttaagtacttaataagcacaagcagtgaatagctaaggattagataggatgctctacagttctacaggaatattgcattttttgaaaggatggaaaggatcattcactgagttcctaccacatgttagaacattgcctttggccttagagcccctcacacatccatctgtttttctcctatagctagcctgttcctatattccagatgcagaagtagctcaggctcagaaaagttaagtaacttaaccagtgccatcatccatcagtaagtggcaggactggaagttgagctgggccttctgattttgtggagtcattgctattttgctaatactgacatttatggcagaactattgtgcttttctatttttcagtaaatttcctgaaatagcataggaaattaaaaagttgttagtaataaaaaataaatccagagctgagcaaaactcctaaagaaattttaggaaggtgggcaagccctgtattgtcatgacacattttaaaaacttttcctgtgaatagaacctttacaaaaagaaccttgtggaaacagcacgaggtgtctaaatgtaaatttctcccaggccagggacctgatctcattcatcttcatagtcccataggctagagaaaacgtcttgcgtttatatttttaaaactataatttacaactttgtttatatatgcattacccgatttaagctcacaacaatgcctggatgcagatggtgtgtttttcgttttctgagtgaggacagtgagactcagaggtgggtcttaggtcgcggtcgtggagttggttgagtggcagccagtgcggccatccacaggctttcccaagtgcatcgctgcagccatagttagctccccagcagctgctcggggctttcacatagatggaatatagtgttgtcagaggtaaatttccagctagtatataggatagaacaagataatgtaataaaatgtacattttctaggctctctgatatgcttctaccctcctatctcttgttattaccataaatcaaatactagtcaattctaaatgtaaatatagggatgataacctctttttacaattcctctcttatctgcaactcccagagagattcacatggagatacttggtcactgccggctttgcggtcggcatgactcctattagagattaaatgacatagagtaatctcaaagtagttagcaataaaaattaatacaaaactatgcaaaactcccagagaaattttaggcaagtagacaagtcctgtgtcatcatgacccattaataaaactttcctcgtgaacagaacctttggaagtagaatctcatggaaatagcatgagatttccaaatgtaaatgtctgccaagtctctctgtaagagatgggttggctgggggcgatggctcaaacctgtaatcctagcactttgggagactgaggcaggtggatcacgatatcaggagttcaagaccagcctggccaagatggtgaaaccctatctctactaaaaatacaaaaattatccaggcgtggtggcaggtgcctgtaatcccagctacttgggaggctgaggcaggagaatcgctcgaactcaggaggcagaggtcacagtgatccaagatcacgccactgcagtgtagtctgggcgacagatcaagattcctttaaaaaaaaaaaaaaaaaaaaaaaaagatgggtctgcatttctcaagggaaaaaaacatctccaatgatgagaaaatacagtgtttgataaagaccatggattttctctatttgattctctgttctcaacacccaaaacttaggcagtaaagaaacaggggaagaggtaccatttattcagtctttttccacccagcacatgggatgatcaaattacatggtctcatccaaagttttcaggcagaagcctgaatgtttgtagaaaaattagcctatttggccctagccaaatacatcctccagtctacccatgttgggcagatgcctgtggacttttggaccctttggcctgggagtgatgtgtgatagttgccagggtggcatctgctgttgggccagactgttggtgctgtttgattctcagcccaattgcttgtttaagcaaagccaagtctagtctcaaggcctaatctcatcatagttgatgttgtctttttttgatggcttctaataaataaatagaaacctcttttcctctggtccataccccttagaagtgccacatttaaaaaataagaggaaagccttcatctcactggggcccatagcagtggcagatattgttatttgctgaattgcttctatctttcttaattaggtaggaagtagcaaccatcaaaaaacaaatattgtatgtaggcggccatcaaaacataagacaactgtttttcttccagcagaaaaccaatttggcaaacacttatttttctttctctatcacacaaagaaagtcaattctctaagaaaaaggatagaaaaagaaaagaaaagaaaacttttaaataatatcccatatatgttttgagaattttatacatcaatacattaaaacataggcaggaaaatttcaaatgcaaacaaaaatcacatcttatagctcttagcaattccttgtcttcaaagactggaggaaatagcccactgggaaggcctttaacagagcaggtgcttccctaggggaaggagtaactacagatatttgagggctactcagaggcaaaagggctcaaaaaacttcagactgtcttccaagcaacagccccagaatgcctcctagatagtgaggctgccttcagttggcctgagattgttgctctgaccctggtgccacccttcctctccaaccttgttacaaacaattcagaagggaggattgtgaaatccttcctgctgctctttctgtcttctgccaatcagagaagactggacatgagatccaagagagggctttccctttccccgatggctacactgtgtctcctgcctcccagctgtttatggaaatcagatggtttcctcaactgtctatctttctgcagcaaatcctttgacagagaatgtgcactgtcaaccaaccccttcatcgagtcaggcaaattaggattcctttgacagcaactttttacaacttccttcctttgaagatataaagctttaaacagtagtagttctccgtgagacccaaggaaaggtctgcagactataagcagactttatctgaagaccacctcctgcccctcactcttactccagaggcctgtgtatttatttatttatttatttttttggtaaaggcctctgctgtgaatttaagtcatctaatcaaaatgcattatttctgtccttgcattgtccattctcgtaaaccgtggttaacacagataattgagacttgagtgcttttttattccaagtcccttattcgatttggcccttgttaacaaagcctagtctgtaagagcgtgaccaccagtcttatttaccttgttatctgtaatttcctctttccctcaggcctttgcgtaatattttctctgcatggaaggggaggataagaaagaagacctaaaaactgaatttttaaaatacaaacagaaaaaaagctccctgtattttcccaaattctgcataaataaaataatatgctccataatggcagagatttgactgacttgttcgttgctataaatctagcacttacaatatctggctgtgaataaataatttcttaatgacttagcaaatgctggagacagaatgaatattgatattaataatgcagatcgtagtcaatttatttagctcaaacgttgtgcggggcaccactttaagtgcatttcttacattaagtcatataatctttataataactctataatataggtcctattttatcttcattttacaggtgaataaaggaagacggggagactatgtgtgaccagcacagggtcatacatctagaatattttggagacatatttttgcactcagactcctcaaaaaaacatttaacaaaatatgttatcttttttgtcacaatagaaaaatatgaactgaatattattacagtaaagtagattcaggttggttgaatagctgtatccaaaagggttaaaatataatctgtgtcgtcctggagaatgatttccgcatgcagaaatctaattgaatttaattgctttcatctcagtgatggagaccaagatatgaacacaagttggttactttgaaactttcataactcaggtattcccattgtacaatagccttgagttttgaaaagaactcaagcatgtataaggattgactgaaattaataaattgatactcagcaggtataaatatgaagcccaatagatgggcaaaagaatttctgaaacacaggatgggggtgatacgaaaatgacttggttgatgaggtattcacgctcctggacctgtgccaactccctctctgcaggttcctgcccttattgctaccctgtaattattcatctttaatttattgctcttcaccttgagcaccactctaaggcttttccatttacctaaagcagtaagttgtactctagtgcctacagttttctgtagctggccttgcgggttcctctgctgagaaaagttcataccatccatttcagttcccttttccatctctgagtacccctaactcctttcctccctctcagagaaagaccgattcttcctccttttcatgacatatcccttcacttgtacccttgaactcactcttttctgcctctttcttcatttcgcatttcccctcacactcttacatcttaaattttccctcctctgtgaatcctcccccagcctccaaacgtggtcaaatcttcccaggcgaaaccaaattatttctccttcaaatcgctgcctcccttccccagtcttgttgaaagccatcttcactcaacatctctatttccttgcaagttcataccttaatactccgaaatggagctcctgtcctcaacattttggtgaaaattctctcttttgaaggtcgtggaaactgaacagctgatttccctcaactgtttcttagtcctgaggctgcttgaagtctctgaagcaattaatttttaattttaattttattgaggtaaaatttacataacataaaattaagcaagcgatacttaattactttctaatgttgtgcaaccactacctttatctagttccaaaatggttctgttaacccaaaaggaaactgtatacctgttaagcatgttctcccttccccagctcctggctttatgtatcacctatttttatatataatataaatgaaatcatacaatacttgggcatttatgactggcctctttttttttttttttttttttgagacagagtctcactctgtcgcccaggttggggttggagtgcagtggtgcgatctctattcactgcaagctccacctcctgggttcaggccattctcctgcctcatcctcccgagtagctgggactacaggtgcccaccaccacacccagctaattttttgtattttttagtagagaccgggtttcaccgtgttagccaggatggtgtcaatctcctgacctcgtgatccgcctgcctcagcctcccagagtgctgggattacaggcgtgaatgactggcctcttttactttgcataatgttgcaaggttcatccacattatagcatgtatcactacttcattcctttttagggataagcaatattcctttatgtggatggaccacaaattgtttacccattcatctgttgatggccatttgggcttttttgactgttatgaacaacactgctaccaacctgtgtgcaaatgtatttgagtactaattttttatttgtaaatacagtgacaataatgccacaaaaacattgcatacttacaagatttatgagttacataatttacaatgattgagtgtgggcagctctattatctggatttcattaagatgatgctacaaaaatagtaattgttagtaataataatgctacaaaaacgttgtatacttgcaagatttacaaattacataatttatgatgattgaatgggggtggctctcttatctggatttcattaagatactcaggattctttacaaacatgctaggtttccacttagagcaagatctcttaaaaaaaaccctgcttattgaccacagcagccagacccgggcctccttctgcctactgtcgccataactctagttataacttgcttttgggtttatacctaggagtggaattgctggctcaaatgataattctatgttcaactctttgagaaaccacccaactgtcccctaggagtggaattgctggctcatatgataattctatattcaactctttgagaagtcacccaactgtcttctacagcagctgaaccactttaattcccagcagagcattggcagtccttgaaatgctcttccgtttgctgtttaagacaccatactgtccttgttctcccactctttctgtatagaaacccatatattttcttcctctagttcttcttcttattcctcctgccattggaagtgcctgtccatttcctgtcttgattttcctttgctgttttctaccatcctcaacaattttatccaacctagcagctttaaagatctcttcttcagcatgtctccaaatttatagcttcatttctgacctcaggtccatcgtgtctacagcgcatctccacccgtacatttcacttgcctctcggggttaactgtgtgtttctgaacgctcatactggggttaactgtgtgagtctgaacacctgtacctcattacctcattacttccttacctcatcttcctaagtgcacggtttcttgcagtgccatcctcgtcttcccatgcacctgaacccaccaccttgtatttgtctttagttcctcaccacctgggaggtcagtggtacttcttatcctttctctctctcccatgtggtttctacctgcaaactcttcattacagtggtcacaactggtttgaacatcatttcctcttatccagccaagacagggccactttcttttaagtttatctttctcccttttcctgtgatccaatctgcgtgcctgttactatctaattgacttcccaaagaataactgtgatcatatcatgccctcttcaaaggctgtcagtcttcccatgcttactgagccacaacgaaatgagtcccaacctgctttgtcactttcagccctcacaattccctgtcattcatgtgattctcctaccaaagtaagctgcttatcttctatgttcactgaaaatggtatgtttccttccacatctatctctaagggatggcataagtgggttgcaataggtttacaggaatgaggatcagattaagagctgtggcatcagtaaaaccaataactcttgatttattatgtaacaatgtatatttttagccaaacaaatgctagataccaataggtaaacctggtactaggaatttcttttcatttttgctttctttgagatctgtaattaatcatggtgaaaataatgctacagaaacatcatatacttacaagatttgcaaattccataatttacaatgattgcatgtgggtggctctgttatctggatttcattaagacactccggattcttcacaaacatgccaagttcccacttagagcaagatctcttaagtaaacctctgcttatggaccacagcagccagatctgaacctcctgctaccatccctgtaactctagttatgacttgtattatccatcacattatttgttgtcttatgaaggatgaagtgttcaaatccctgtaggaaacagaccgaaaactttgagtctgttacccctaagagacacagccctcttttctgaggcgtctttctttccttgatttatttggactatggtttctttggccaaccatttaattttttttttgttgttaactttgtccttgttaacattaattctctcatgtcatgtggaaatgagaataattcagatattgtaagagaaggaaaatggttagataaattagaagcatgaataattgatagagaaataattcaagcagctaactatatcatgcattctctgcttacttcatgaatgatccgtatgccatgtccatacgacttaatatttatttttagaaacctttaccaaaatgagcaagaagtagtaaatgcctcattatcctttcagagcacctaatgatacattattttctgttataaaacttcaaggtttttgaatgcattgttataaatccagactgtcaacatttctttggcaagaagcagcacaccatcctatagaaataagatgtaagattaacaattcaggttcatatattttcatctgtccctgaattccaccatacatggcagaaaaccacaatcatgttttcatagcaaatatgttatgacaaactatacaacatttaagaacatttagaaaagccaaaatggaactttcagaaataaaaccttggctgttgtggtggctcacgcctgtaatcccaacagtttgggaggccaaggcgggcagatcacctggggtcacgagttgaagaccagccaggccaacatggcgaaaccctgtctctactaaaaatacaaaaattagccaggcatggtggtgcgcgcctttaatcccagctactcgggaggctgaggcagaattgcttgaacccagaagacagagactgcagtgagccaagatcgcaccattgcactccagcctgggtgacagggcgagactttatctcaaaaaaaaaaaaaaaaaaaaaaaaaaaagaaagaaattaaaccttaaatagcaaaatagaaaagacagatcatcagcaatgattaataaaaaagctattttataaagcggtgattgggaaagtaaaataggttgtacagattgggccaaagcctaaagatattctggtgattctttccacgatagaagaccgtgaaagaggcaatgcagtgagaccataagccttgtggtttgggacacattcttttcgaaggcctaactttttctgttggtgaaatgggaataaaaatagtacgaatttccaggagttaaattagagttgaatgagataattcatgtgaggctcttagaaagatgcctggaacatagtaagaattaaataatatcatctaataaagtgagaatgaccacagaatatgtctttatatggtattcattgttaaaatgcctagggatggagagttctggctttagctgtaacttaatataggagttaaaaaggtatcataaccttaatattaggtctcgggaggtgtcactaggactctgttatcctttcttcccttctttcttttttggctttctatatgtcttcattttcagacaacctctctcctggggtatcagaagacacactcacattaggataatgcagataagatcaattcacagtaagaagatttatcaaggtaaagtgaagtataggagaagcacatgagaacccaggagcataaattgataaacacaccaattgaaaacagattggctgaattttaaagcaatagatatatgtttcttaaattagatagaccttgaatggaagggtacagaaaaatagaaaatgaaaaaaagtaagaaaatatatcctgtaaatattaaccaagagaaagttgatagagctatgctattatcagaggaaatagactttaaggagagaagtatcgctacagataaagaacgctatatcatatttatagaactatacagcaggcagatataataattccaaattaggatgcatccagtaacatatacagcagccccccttatctatgggaaacacatttcgagaccccgaccgggtacctgaaacctctgatagtagcaaagtctgtgtatgtatatagtcacgtgtgacataacaacgttttggtcaatgacggaccacatatgtgatggtgatctcataaaattataataccatatttttactgtactttttgtgtttagatatgtttaaatacacaaataccattgtgttacaactgcatacagtattcagcacagtaacatactgtacgggtttatagcctaggaacaataggctataccgtatttcctaggtgtgtagtaagctataccatctaggtttatataagtgcactgtgtattgtttgcacaatgccagaatcaactaacaatgcatttctcagaacatatccttgttaagtaacgcatgactatagtatgcttttcctatacatatgcaaatatgacaaagtttaatttataaattggacacaatcagagattaaaaacaataacgaatagtaaaatagaacaattacagtaatatgccagcatcactaatcttgaactttggggccattaagtaaaataaagcttacttgcatacaagcactgatatctcagcagttgacataactacacagctactgagtaactaatgggatagtatgtacagtgtggatacaccggacaaagccatgattcatgtccagaacaggacagcaggatatttagtcacactactcagaatggctcagaatttaaaacttacaaattatttctttctgaagttttccatgtaatattttcagactgcaattgactataggtaactaaaactacagaaagcaaaactacagataagagggtgactggtgtataaaataaaactaatatatataatagaagtagtcaaaatagaaaaacccatcatcatagctgaaaactttaacacatttctacatagctgatataacaagtagtctaaatataaaaaagagtaataaaaatttcactaaaatctgtaatatagattttactaaacaaaatttggttctaacaaaatttacaaaaactaagggtatgcattctgcagtgttcacgtggaatacttatcaatatattgtaggctggtcatagagtacatccaaacaagtttcaaaagatagaaatcatacagattgtatattctgaccattttaaatttaaaacagaaattaataacaaaaaaactaaaggatccccacatatttagaaactatgcaatatatgttgaaatattccatgggtaaaataagaaataatagtaagaagtagaaaatagtttgaatggaatataatggaaatacaacataacaaaacttgagaatccagataaagtagaggaaagatttacaaccttgaatgcatatataaatcagagaacaccaaatttaactctaataaaatggagggaaggaaataacaaaaatacaatttataacatagaaagtagacatgcaagaggataagtcaataaagtttgttctttgaaagttctgtaacttgatatcaatagtccctagtaagggtaattaagaaaaaaaaaagaaaagacactatggctaattaaacaaatggagacagcactagagatctttcaagaataagaaaaaagaagaaggcattgttaatacatttataaaaattaatttgaaaattaaaactggcaaattctgtaaaataaataaaaaatcagtgtaccaaagcataccaaaaaaaaagaaatataaaatctggtaagttctacatttattaaatgaaaactctgtagcctaagataattccaagtccagatggcttcatggtaaattccaccaaacttttaaagaagaaaatacactaatcttatgcaaactcttctgtaaaatagaaaaaaaatgaaacgctttccagcttctttctgaaggccaacataatcttctttgcaataactgacataaacattgaaagaaggaaaaattataagccagtctctctaatgaatgtatatgagaaggtagataaatttgacttcaataaaagtaaaaacctgtgctcatcaaaatacatcattgagaaagtgaaaaggcaggctatacagtggaaaaaaaatctttgtaatatatgggtctattacaggacatttatctaggacatgttaacaactcctacaaaaatataacaaaagggcagagaacccaactaacaatggaggaaatatttaacaggcttttaacaaaagaggatatctacatgaccactaaacatattaaaaggtttttagcatcactagtcatcaaggaaatgcaaaggaaaactacacggaaattattcagatactattatacacacatgtgaaaattaattagaatttaaaaagtaagtataataacaatagcaaggacgtgtggcaatcagaattctcacacactgtaaagctgaacattcttgacctagaaatcctacttccagatctataactaaaacaaatgtatacacatgtacactaaaggctcttacaagaaagtccagaataacactttgtaatagctaaaaactggaaacaactcaaaagtccatcaagggacaaatggataaattttggcacatatatcatatgtatataccaaatacatagcaaaaaaaaaagcaactgttattatgctcaaaaatatggataaacttaataggcataacattgcatgaaagaagccagatagggaagggaatatcctatggaaatgaagttcaacagcaggcagaactaactaatctctgttgagctatagatggtgatgtgaactaatctatattgagccaggatggtggtgatatggtttggccgtgtcaccatccaagtctcatcttgaagtgcagctcccataatccccacatgtcacgggagggatccagtggcaggtaattgaatcacgggggtgggtttttcccatgctgttctcgtgatagtgaataagtctcacgagatttgatggttttatagaagagagttccctacacacgctctcttgcctgctgccgtgtaggatgtgcctttgctcatccttcaccttctgccatgattgtgagtcctccccggctatgtggaactgtgagtccattaaaccttttttactcttttttgtttgtttgtttgttttttgagatggagtctcactctgtcgccagtctggagtgcagtggtgcattctcagctcactgcaacctctgactccctggttcaagtgattctcctgcctcagcctcctaagtagctgggattacaggcacgtgccaccacacccagctaatttttatatttttaggagaaatggggtttcaccatgttggccaggatggtcttgatctcctgacctcgtgatccacctgcctgggcctcccaaagtactggcattacaggtgtaagccactgcaccccagtctcaggtatgtctttattagcaacctgagaacagactaatacttgtggttacctttgaaaaggtgatgactggaaggggcctgagggaggtttctgagatcatgacagagttgtatgtcttcatctttatggtggtgacataggtgtgttcactcaaaaaaaattcaccaaactgtacacttacacttttgcagtttaatatatgaatgatacatgttatgctttaattagaaagttaaaagtaagtttttttcaaaagtagtaattggatgactcccgcttttattgagttagcaagtatcttttactgccactttctattgttaaaaaaaaaaaaaggctcaccactgaggctgtaaggctaaatccttagcatgacacacaaaaccatctataaaccagtttctagcctttcttcctggccattccctttgacctgagctgtcttgaatattcttaagacttgacaatactaattttaaaccgtctaagataagatcacctcccactccagaaaaggggtgagggtagatgttaagaccagagtgtgcttccagcacacttgtattttttatggtactaagaaagaaaaatgctgacgcttaaacctgcacacagtaattccttaacatcaatggtaaggttcctccctaattttgaaggcattaaaatggggtcggggaaatgtcttacaaatgatattttttaaaaaaataaaataaaacaaagataatcatgtcttggattatcatgactcacagcaactttactttcaaaagtaagaatatttacttctaaaactatgaaatcttcactatattcttaaaaatataaatcgttaaatgtcattctttagctctaaatacaaagttagtttgttgaacttcatgagttacgtcttttatcgggcttggggtgtgaccttagcccctctcctttgtgaggggagatggcagaactctcagaagctttttctattctcatctttgttggttactggggaaaaactggatttcgctgcactcatcaaataaagaggcccaggtagcagcgcctccacgttttgttcaagtggggttttctgcgtgtgccgctggccaattcttcaagaaaagtgtttgttcttctctggcggtttggtgttcctatgtttcaacatgggggtaccaaataattcatttccccttttcccaacagatgcattcttgtgacctcactgatgacaggggcgtcgtttattctaacaaatgctcttgtccaaattccaaccatgttgccaagagatggcatagctggtgagggctggactttaggggccaatctccactcctgagctcccctgaccacacaggaagaaaacattaatgatgttcccatactgatgttgtggtgtaagtgtctcctgtgtaaatagaactaaatatttaggaaagaaaacagaagagtcttatgtagtgcattacaaactagaaagcttttgaagtcagcatctgggatggtcttaaaaacaaacgtgcagtctgagagaaagaattactgctgacacacgctgacctcacagaaactatctggtgatgagattatctctcttccaggactctaacaaggctttgcaaggatattttcttgctttgctttgctttttttaatcttcttaactggtggaacctcttgttatgtgcaaatctaatccattctcattcaaagatggatgtcccggttttactgtatctgccttagttggagattcccgggaagaaaagcccaggacaagtggtcaggtgcaggaacttgatctgagaggtggtcccaggaagcagaagtgagttcatggggacattgagaagaggaaggaggccaatcaaaaaagagcatttctgaggttgcttctgtacacaggggcttcatttcttcaattctcccagatcctctgggaaccctatgaaatgcttttcagaattctcagagtcatccacctgaaaaatagagggactggagccttttttcctagtctccctactgtccatggattgagagttgcctgggagcagggagagcgggtgttaactgccttctgtttagaacaagttcctgtatgtgtcagagatctggggcaggatgatttgcagtcatgtaagcttaggttgaactctgggagagccaggtgagtgtgtgctcaaaaagaactgtccagtgcagctgctgctgaaatcagaggtgactgcaaggatgtaacactggcgctcgggtgtctgccatggcctaggtttcttatgagagattgaactcttcggagattccatcattcagagcaggcacaagacggtttggccaccaatctgggtagagccaggctgttgcatgacaagtcagtcaggagaaaactgaggctagcaggctgactttctggttccatgacacacatcacatctgcaatagagcttaaagacagggtgcttatccctcaaacctccctgtatcactaactttcttaatccagacttttgcctttgtttttttttttgtttgttttttttttttttttttttagaaggagtctcgctctgtcacccaggctggagtgcagtggcaggatcttggctcactgcaaactccacctcctggttctcgccattctcctgcctcagcctcccgagtagctgggactacaggtgcccgccagcacacccagctaatatttttgtatttagagtagagacggggtttcaccgtgttagccagggtggtcttgatctcctgaccttgtgatccgcaagcctcggcctcccaaattgctgggattacaaacgtgagccaccgcacccggcctacttttacgtctcataacccaaaagctctatggcttcaaaaattcccaactcctcaaaaagctgattttctgttttatcagtgcccctttgattgataaacaatatattaatataagatggatataaagcagatgtattttgttgccacaacttctttggttcaaattaaagaatataggtcatttgtcccagagagtcagtccagctgaaaaattgtggatgttgataaatgcgtaggtctccattcttaaaaatccagcatttttgtataggaacaaaactttacttggattataaattgcaggccttctttgaaaagacaaagtgtgaaagggaagagaactgtagagtcttcctgatgtttactgagcccttactccaaaccaggacttaggcttgttgcatcccctccattaactcatgtcatattgcctaattcataaagaggcccagagaggcagtcgaggtgtagaaaggttaagtaacattcccactgcctcataacttgtaagtaatgaaactctccggaaaagttgagctcagatctgaatccagagcctgcatgcctaaccgcagtgcaatgctatcctcacctcactgtgcaaatacatctcagatctctgcattaggatgcacaggtttacattttttaaaagcaggtaataactgtcttattctgtacctattgtctgttttcacagtctgctgtgaacccttgctttcagctgggacactgttgccttccactgccttccacagcctctttacttccccttaaacaacctattccaactggtactacttgataatagtcattttctctcacctgaaagcatgcctctgtcaaccaggctcttcccctcaatggctaatgactctcactcctacactcctgcagagggcctggcacatagtgggtgcttaatacaagttccttggcacaaagaatataggaataaatacggggactaaggtattgcgctctccattttacaaaggagaaatctagccttggtctctctgataccacagtctttcccaaagttgcacagcacagtggaggagagttggacctagggcccaggtttccaggatcctggtctagtgtaatgtcagtttctaattatgtggtccacacacatgaatatttaaatcagcatctcctggagataactcaagaggtgactctaatggtagacaattgaggctgtacatcagggttgcaaaggggctttgtccggatgagtggattttttgtgtcccttacaccatgtgaattcccagcatcatggtttatgctaatcctctttccaaaatagtttcctggtgaccttctccctgtgccaaccccggaatacaatgggatgagtaactggcaggtccagatacagaaaatgagtgagcaatgcctttcccagctaaaaattcttccagctcacccatggtgtgctagggaagatgttctcctatgtcctgaatgaccagcagcagaggattcagggcacccaatgcaaaattgtcaccaaatgactgtgacactgaagtggctcatgctgctctttgcactgcattaagtgaaaccagacgcctccagttaaactccagtgagctaaaaagtatagtgataaatatatgaaatgagtagaaagaacaaaaataaagaagcctcaccccagatacggcacttatgaagaatctgtgtctcagtctcccagcaaaattgaaacgtaattcaacttcagatggtcaatgcctgccttaatgccccatgctaatgtcagccctgagatgtcacaatagtccaggagatgcttacctgaaggagaggccctctagagaggctgtgagaactgtgatttggagctcgaaactgagatagtgagctgggcagggtgacaatttatggagaatgggaaaaggaagagggaagtattttagcaaaacggatgctatcaggatggctgaggctttagaaccagatggagtgctgtggcctctcttggatggatgctgtttctgagctttgcatctggaaagacagagcctgctctaggaataatgatgtcaaagatctttctcattttactgtctggttaaatatcacctcttcagagaagccttcccttatcaacttacttaaattgagtaccccctgtcagttttctatcacagtacctcacttgtgtgtgttttccattcatagcatttgttacactttcacatttttaaaagcgttgtttctttttttgttttttgtccatctccagttcctatcagtgccctaccatgtccttaacatttagcttagtgcctgacacgtagtgcttcagtaagaagtatcaatgtggtaagtgaatttctaatcgaatagcagttacatcataaatagtcaatgattcttgtgatgtctcatggtcccagggatcatgagatacagagtgacagaggatggaagttcagttttcttctctatgtaacaggaagcaaggaagtgatcgtcagaataactgcaagatgaccctgctggctgctgtgtgacaggggattagaacagtcataaaagcaggtagagaggtgtttcagttagctatggctgtgtaacaaactactccaaacttagagacttgaaataatcattctatgtggtcatgtttctgtgggtcaagaattccagcaggattcagctggttgtcaactgggtctttcacatagcttttttcacctggtaacttagctaggctggaaaatccaagaaagcttcactcatacacctggcaccttggtgattctttgcatgcaccttggtgattctatgtgctgttttgtctccctcatagctaatcagatgtcttatgtggtggttggcattttttttttttttttttgagtcagagtattgctctattacccaggctggagttcagggtgcgatctcggctcactgcaacctctgacttccaggttcaagtgagtctcctgcatcagcctccctaatagctgagactacaggcacgtgccagcacgtctggctaatttttgtatttttagtagagacagggtttcaccatgttggccaggctggccttgaactcttgaactcaggtgatccacccacctcagcctcccaaagtgctggaattacaggtgtgagctatcacgcccagcctggtggttggcttttaaagggagcaggtcaaccatatgaaaacagaagctatggctctcttgaggcccagccccagaagttacacaccatcagttcccctgtgttctgttcgtcaaagcagcccaagattatctcaaaatcaagaggaagggaaatagattcagctcttcatgaagattggcaaggaatgtgcagccattttcaaaccaccccgcagagagaatggttaggacattgttatgataaacccagcctaaggttatagcaatagagatggacagagatgatttagctgaagatatagctgtagttagcatgaccagacttgccaatggttgtaatagggtgtctggattagggagatgttgtttatctctactagtttcctgttaattactctatgaacaaattagcacaaactttgtggcttaaaacaacacaaatttattctgttttagttttggaggccaaaagttcaaaatgagtttcacaaggccaaaatcaaggtgtcagcagaactggttccttctggaggctccaaggagcatttgttccttgtctcttcagtctctggaggcagtcgtgaccccttcttacaacttcaaaggcaattgtgtaacatttttgcagggagagtcctgggaacagtgagacaagttggggagaggcaagtggaagggacagaatcaagattgaagcaggctaagtatgaaaaatttgtaagatgtccaagcggagatgccagaaaaagtcagatgagtgtatgagtctcacatttcagagctaaaaatatacactctggatttatcaatataaagttagatgagggccaggtgcggtggctcatgcctgtaatcccagcactttgggaggccgaggtgggcagaccatgaggtcaggagctcaagaacagtctggcccacatgatgaaaccccatctgtatcaaaaatacaaaaattagctgggtgtggtggcatgcacctgtgatcccagctattcaagaggctgagataggaaaatcgcttgaacccgggaggtggaggtcgcagtgagctgagatggtgccattgcactccagcctgggtgacaaagtgagactgtctcaaaaaaaagaaagttatatgagtattgttgaagtcatttaggaacagattttttagcaacatcatccagtagaaatgtaatgtgagccagaaatgtaaatgtaaatgttctgctagccatatttaaaaagtaaaaagaaaaaggaaaattaatattagcaatatcttctttaacctgattattatataatgatcattccatcatttaagcaacataaaaagcaatgagatattttagataactttttccatactaagttttagaaatccagtatgttagctcactttccaattcagactagccaatttctttttgatggagaaaatgtatttaattaaaagaattattcttactattatttttgattggcaagtcataattgtatgcatttatgaggtacaatattatgttttgatacatgtataaaatggtataattaaatcaagctaattaacatgtccatcacctcagttacctatcctttttttgctgagacatttgaaattgactctcttagttattttgaaatatataatacattattattgactgtagtcatcatgctgtgcaatagtctcaaaacctctttctcttgtctatctgaaactttgcactcttagctaaaaaaaatctccccagtccctcccctgcacccccagccccaggtaatcaccatcctactgcttctaggagtttagctttatttgatttcccatacaagtgagatcatgtggtatttgtcttctgtgccttagccatatttgtattatccactggccacctttgtctcctggtgatatactggacagcacagctttagaaagaagagattctagaagttatccctgaggaatcccagcatttaatggtcggatatagaaaaagcttgaaggtagaagaaaaaccaggacagtgtagtattgcacaggtaggaaaagccttaagaagtgagttgatcagctatgttgaatgctggtacaaagatgggtaagatgggatggagaagtttctacaaaactgctgctaattcaaagaaacagatatagaccacttccaggctgggcgtggtggctcgtgcctgtaatcccaacactttggaaggccaaggtggacagatcacttgagatcaggagttcaaaaccagcctggccaacatgctgaaaccccgtctctactaaaaatatgaaaattagccaggtgtggtggtgcacgcctgtaattccagctagtcgggaggctaaggcaagagaatcagttaagcccagggggcagaggttgcagtgagccaagatcgtgccactgcattctagcctgggtgacagaacgagatttgtctcaaaaaaaaacaaaaaaacaaaaaaacaaaaaaaaaaaaacaagactacttttaggttctcgctctttggatgtgttgctgtttcctgcactctcttcctactgtctttgggtggtagatggaagggtgccacaggacacacagctggggaaacttcctcttgcaaagcctctactaaaccatgccacaccactgtataataactggaaaatggctttgggacttaaaagcaacttcatccaagaagaattgcagtttggatgcagtccaggtataaaacaaccaccttcactcctgtgtgttactgtaaagcttgccttctgtaaaatgtcttaagcataagagctgtaaaggaaaatactcatggattatattgtgatttgaaatcaggatgtaatacgatagtgacagcttaaagattcttctaaaactagatatgaaatttgaatgtggcacctgtctataatttgtaaagcactttggctttttctcagctacatggtgatgatgagttcttctcaacaagtgactaagctctaggggaatcagtttctcaatttgcatgagatacgggagcttcctaagacatgagactttcagttttaaaaccaggatagtcttgagagagctgcccttgtttttcggagacatgcaggcttcccaagatgtgagactttcagtgctaatcccaggaaaagtcctaaacaaaaggcaacgagttggttgcccaaccaagctgggaggccttctgaccgaggacctcctgaagtcatcaacccaaagagaagaactgcctcttagggctgactgatgcttacaaaagggattataaagcctgaataccaatttcttaatttgcaaagagaaatgatgtgacaaggaccaggaaactcaaagtccatatggtcagcattttctgtctctgtataaagccaatctattaatttaaagaacagaatgattatcacatgcattgaaatacacaaagtccaaacgatcagcaaattctcgcccggtgtgaagtcagtcttttaatttacaaagaaaaattactgtcacagagactggaatgctcaaagtccacatggtcagcacattttctgcttctactctacccttcatggaagaccaattcataatcagaaggctgcttagtgagcatgaagtgttggttagagtgagtgcttaaaggcactggactaagaaagcctaactttaccaaggggttcagactgtctttgtcaccaaatgctgaagtctttgcttcagcaatttttcctgcctctaggatgagtactgcaaagttgcctccaggaggcatcttattttccaagctgccatggatgactgaccgttttaagcgtccttcattcttcagatgtgctaataccatcaattaggtagtagagtttcacttccctaggagccattttgtctttgctacatttatctttgctcttattccaaagagcagccttcattctcttcctatcaaatctttcagcagcagaaggcaactgactgtatctctgagtaatgttgataagtattgtgttgtggaggctctgcatagtacagtggttaacggcacgggctgagaactgaggaatacctactgtctacttgtctactaccatgcagaactatagtaagtcactatatccctttgagccatagtttccagttctataaaatgggaaccatccatagttggttgtatcaaggactcaatgacagcaaacaagtaaaagaacccatatagtgtttgagacatgattgtgctcaagaaatgataggaaacaaacgtacaaacgacaagcattttttgctgcagtttggaagtattaatgttttacaacctccacaaactaaggttcatgatcgaagaacctcactgaatatttaactttagggataaaatgcacaacctataataattttagtgcaattgatttattatagtcaagggaaacatgactgaataacaaaagtaggttaggaaaatactgaaacagaataggatgaagaaaagcattttaatgaaaaaggaaaagcagagagcagagtagtaatctctcttggttcctctccttccgtcagcctgctgttcctgcccctctcttcttctctctggcctctagataccggaatgtctcaggcctcccatcccctctatcctccatttcgccacctgctctggccaaaaagtttgaaggaggacctatgaaaaatatccctggcctgggcttaagaagccttcaccctcattctcaactctgaggctaccagagcatgatcagttcatcatctcagtcaatcctcccagctcctctattagatccatatgactgccactttgtgaaagatacaaggaggacttggcaaaacaagggccccacctgaaatggatagctgagagcattaccacagtcggatctgctgggttgaattgtacacagcagatgccaacttccaatgaaattagaatcatatttctatacattttcttaagtgccagacatcattctaatcattttataggcattatctcacttagtgtctaaaaaaccctaaggttttgccatataactttcatccccactttattatctatctagaataactgaggcttatggaggaaaactgactgactcattgctgcttggctattaagtggaacttcccaagactctgtaactttggagactagtcacatatgaaatatgctaccctctcacttgtgtgatgacgttcagggtttggcgaatgttgagcaagccaataaggtaaggctgtatgcggtacaattctcacactcgttgctctttttgttgtaaccagcctctttaaacactatggcctgaccctctgaaccagccacctgaccattcttctgacttcccaataagcctttgccatcaccaaacatactggcctccatggtcttcatctttaatgccattaattaaaaaaatatgccccacagctctgcaagaagaattcagcaggcagttggcataaaaaggttgggaatggtttacatctttgagcttcagtattttaagtctgcaagttcatggagtgcaagggctgtggacaccctgcttgccaatttttctgccttaaccgttccctgcccccttgttgttcaatttctggccaatgtctaaattttccaaaaggaagtatggtcttttgcattatgacacatgattgccacccactggttaagaatgttttcactatgaaggtttagaaggtttgctgttgaggcaaaagttacccatttcccatgcccccagttcagttgtctggatatcccagaacaagaagcattaactgcttcaatttaagtcagattctcaaaatcccaaaggcatgtctttcacttatcccataaaacatctaattaaattatttcatttaattgtacatcttgaattatttgtttgcatcttgaattatttttgtcaatgcgcattttccaataaaggagtaatcagtggtctcaatgtcattcagatgaggccacccttatttatcagagttctaacaccaatcagtattcatccacagggctctttagtggaactgtggcactctttagtggaaatgtgagtttcagatttctgattaataaaaataatttgtaaatatgatcacataatttttgcaataccgttttcttttctaagaatcacctatagaaacacctactacgtgccaggcattgttttatgtgaacatttcatgtatgtaacagccccccctaaggtagaaattgttattgtcattcttattttgaagatgaaaagctgaggcatgaagagggtaagtcaccatccaaagtcacctatctaaaaaatgcaaagccaagattcaaactcaggaaatgtgttactagaatcttatctactatgccatgctgcctctcagaaagactatcactgcttcctccagcctcatcctcttgtcttttcctgggctggggccatcctcaccctgattggctctccccaaaggctcactctgacacccattccagtgctaaccctgttcagagtggacaggaactggtccatgcatctccttagatttaacacgataggctctgtctctcacaagggcaggcagcaagcaattgtcttttagaggaaaacaaaccatttgaactaaatgttgattcttgctctctctagaaatgcagacagaaatcggcaatcagtgtagttgatggataccagaaaaagaaataaaagtaaggaaatgaagaaaaattgggccaatggcactttaaaaatttcccaaaattttgaggacaacttccctttttttcaaggcacttgatgcttctctagatagaaaaattgttttcacctaaaatatcacactagctgttctgaaatcctcttgcttcttggcatgcttattaagaaattctgctcttgcagcaacaaatctcagctttctttgcttctagagaactttaaaatcattaactatcctttaaaaactcactcttggaaatacatgtggtctctttccctataactaaatatttgatacaagccactatcaacttgatactgacagtttaagggtgttgggtacgatgacctttgaggtgccttctggccataagtaccaaggaattcataaagttggattaaatgataacaaaaattggaactttccctttatcttcttttcttcttaaagaataagttaagatacattgatttcatttcacaacttgcacggaaatgagtgttttactgttgatgtttttatgatctgtagtttccattctttttaatagccttggtgcagtattaaaaaaactatcttggtgataaaagttattttagaagtaaaagttgctttagaaaagcaaacatgactaatataatccaagttttctcaggaaggaaagcgctagtgtgactggacaatgctgagacgcccaagaagatgattgaccttcaattacattgaagggaatgactgaactatttatctgtgagggattgtaaatcaggagccaagggaaagccttggaaattcaaatgtaaaaacctagttcagcaaaggagttgtcttaagcaatagtatataaatcaggcagggttaggttatactacagtaataaacagcccccccccccccaaatatcaatgacctaaacaacaggagtttatttattgctcatgatatacaaccaatttaagttaggaggggagttatgcttcacgcagtcatgccacatgaggtcatgatagcaccgtcttaacatgatgcacctgagttctcctggcaaaggaaaagaacattccagattctgcattcacaactgaaggctctcctaggcatgagacaccatgcctcttactgtgatttattgatcataataatgtatagcctcatttaattgcaaagggatcaggaaagtgtcattctgaacattctcagaaaagcagagacctgattatacatgagtgttagaagcctctacaacacagcaattgtggactgaatgcttcattcaggcaataagcaaaagcctccttcagcagcgtattatttaatcctcacataaccctgcaaggtgtgggctttcatgatccccctttctcggataaggagactgggaatcaaggaggttaaatagtctgcccagagatgctccccttcctattaagagcccagttgtaaacctgtgctcctgactaccatgtagctcttccctgagagctcctccaagccttggttaaagggccagaccctttgctctctgagcaggaggagagcaacgtctgccctcactgacccattaatagacacctgtcagtgaggaagggaggcttgttcacttcagggagctgtggtcgcttcccctgtgccactggaaaactaataattcatgaagttggctttcaggtacgagcaagctggactgaatagttgtttcaagtcataaacatagaaaagtaagttgataggagaagactatgtggagaaaatttaaccatgttaaatatttgaataaacatttaaaaatacatagcatatataggtgcatatataataaatttgagacagtaggcatgacagagttctgaaatagtttataagtatgtgagttgtaaatatcccatttatattatgcatagattataagtaaaatacacagaattgattctatgctccatcatctatgtggtcatctaatcatccatctctctaaactaacgtcaaagagacatataatttaaagcacatatgcaattctaaattttcttggataagcttttaaaaactaaaaataaatatataaaattaatttaatagtatattttatttaacccagtgcatgcaaatatgattatttcaacatttagtcaagtcgaaaattgttccatctttttggtacttagtttctgaaattgtgcatgtattttacccttaaagctaatctcaatttgggtgctaaaccttcagtggaaatccttgctctgtattcagtttataaaagatgcggttaaagaaaccaaactcacttgtccaaggtgttccaaagatacttcaaagtttgcaatcgtttagttaatctgttgacaatggttagattgctgttgtgtttatatataatgctagaaataatgcatatgttgggcatgtacattacaatatgatcctgtcttccagaccataaacacaattagtttttcctggaggattctaactcaccattgggtacctcttatatggaaaatcattagaaatgcctgtcctctctgcaaccagctgggaagaattttctgtcaaaagctagagatgtttgtgtgtttttgtcaatgggatcacaaacttgaagtcagaacagttggattctggatatgagtcttcttttaccagctgtgtgatcttaggtgttctgggtcccatttgggaaatgaggggtttaattgcctccaagcttgatctgtgcatggagcaatgtcgttatgagaattccccacattttgctcccttttggacctccctaaaattcccctaagaacacccctcactagtagaaatgtagaatcccagaccttaccccagatctactgaatcagagtctgtatttttaacaagatcccctacattggaggaaagttgtagaaagactgccctggaggatttctaacatttctgtgggctctcatattccttttaaatatacattagaatgaaatgcagatattttaagatgatgtggcctttcagagagtagttgcatttactaggatgtgaaagaaacacttttcaaatggtaacgatgtgaaggtgtcctaagtgcttgtgttgagtccagcactgtgctggtagctcacgaactcctcgtgacaacctggaaccccatgaaccccattttacaggtaaggaagcacaacctgagagacatgaaattatccaggcaggcttgcgtggctagtgattgtgaagcttggatttgagtacaggtcgtctggttccagagcttgcacgaaatcactgtgctagtaagaaacagagttcgaggttgaacccgggtgactcagcatcaaggaatgggctctctctttggggtgtgtgtctgtgtgtgtgtgtgtgtgtgtgtgtgtgtgtgtgagagagagagagagagagagagctttcttaattaccacaccatactacctccattttatattaaacagaatattggaatcttgacctttttctgtatttaattagatgctgctgtttaataacctatcacaaaagttaggcaggcattcacacacatggcgatgagaattccccacattttgttccctgtgagccctccctaaaactctcctgagaatacaacagctgcatttaaagaagctgaatcccctattgcagattttattcctgtaaaaatatattgaacttgacgaaacagagaaaatgtggcctgcttagtcagttaccctgacactatagctcttcacaaaagttttaagatatgatcatatatttaatataatatacttagtataacatgatatatgtgctatactatagcatagtatgtatatgtaatatatataatatacagtacagcatagcaattgtctaccagtgacagatttatttttaagttttttattgacacataatatttttacatatttttaggatatatgtggtattttgttacatgtacagaatgtgtaatggtcaagtcagggaatttagaatatccatcatcacaatcatttatcatttctatgtgttgagaacatttctagtcctcccctctagctattttgagatgtacaatacattggtgtgagctgtagtcaccgtactttactattaacattaaaacttcttccttctgtctactgcctgtttgtacttaactaatttctcttcacttaccctcccagaccgacaaacatctgcatccttcccagcctctggtaaccaccattgcgctctttttctccatattttaggtcccatctgtgagtgagcatgtgcgatatttctctttctgtgtctggcatatttcatttgacataactatctccagttccattaaggttgcagcaaataatatgatttcgttcttttttatagccaaatagtatttcattgtgtaaatataccacaattttttaatccgttatccatttatccactgatgggcacaaggtccgttccatatctttgctatcgtagatagtgctacaataaacattagggtgcatgtatccctttgatagactgattttctttccttggtataaataccaagtagtgggattgctggatcatacggtagttctatttttagtgattttttaagaaatatccatactgttttccataatggctatactaatttacttttacaccaacagtgtatgagtttccttttctccacatccttgctagcatctgttattttttgcaatgactgatttctatgaacaggagtctttggagccttccttcatagccatcgtctcacacagtcctcactggtgctattaccagctccatttgcagaaaaggaagctaaagccaaagcttaagtgagttcctgataaatagtccatattttacctcaggtcttctgattccagacatcacgtggactgtctgaaagacgcaaaattagacaaacagcaaaaaagagaccctgttggtgtccaacacttataatgaggctcacttctgaggacacgtgcagcctaagcaaggcagccactgcctctcaccttacagcttgctgggctgataatggccataggggatcctcagccaatgaggggtaagatctgtagataaacatccttgggtccagcatccttgacccttaatggacaattctgggggatgtttctcactgtctcttagagagtccccagtaggattgagctccagttgcccacagtggaagtctttccatgaatgcaccctttattggcttgtgtccacaccctgtcttacttcccaactccctcacttgtgattcctggcataacctcccaaataaaagagtttcaccccagttcttgtctcaggggaccacaaagagagtgactatgtggccccgtgaagatgaacttgtgacaatggcatgaccaaggtttaccacctgagctctccctgttagcgctagttacatgtagcatgtgagctgggttcttctttcccagtcattttcctgtcttaaccttggggtgaaggacaatgttcttgacctagaatggcctaggcagagtctgataagattgttgtggatgcaaagggaacagggttgtggttgctgagcattgcatccagtgcgtaccttgttcccttgctgcactctcatcatgtttggattcagatgaactttgatgttctgtgtgaggtggacgttagcactgtatctgtactgagttaggcgaggcggtcccggcaaagtaattacaaggaaatgctgtattttagattgtttgagttttccaatagagacatatcaatcttgcttgggaatactttgacttgtgctttgtgatcagatttccctgtgcttctggtgaagcttatggattcatgagttagctctgcaaatggagagtttgtgttagaagtcaaatcagttaaagctctttgatactgcacatattcatgggcagaattgctgcaaaaatcctctaaacacatacgaggagctacattatacctttaagtggcaggatcagcttcgtgacaaaaaccaaaccaggaatgagaggggaaaataatctaaatgtgttaagggaagtatgcaaaatggctgaaagctgacaaatggcagagccagaacgtgagttctgctgattccagacatcctgcctgatgaacataaaattggaaggaaaaaaaagtaaatgagctatgatgagaccaagtggcccatatgggtatcaaactcaacaggatggcatgaccaggcttttttactcaggcacaaagagcttttgagcattgtttgataatattccaaaaagaaaatgatagagccaaatttcccaaatgttccatgtaaaactaggaaatgactgaagcattcaccctcatttctaagtattgtaagtgtctggatcagaatccattgccatggcttattcattcagagcttgttgctggggattgggatgcttagactggcaggactggtgtctccttggctagacaaagatccttgcatggcattaagggagcctgtcctgacatttcataaaatcatttctgaaccgtgacgtttccagtattttattgtgaacattttcaaacataaagttgaaagaattttacactaaaccaccatgtgcccataacctcgattctacagtttacatttgacatttccatatacttgctttatatatataaatatacacatcacacacacacacacacagtccctgcctctatacatccaccttactttttatgcatttcaaagtaagcaacagatatgtaacactccaccccctaaatagatctgcatgcatattgttaattagaattcaatatttgcttttggttattttcttcttcagaggaaaatttacatactatgaaacccacaaagcttatgcgtcatgtttacattttgacaaacatatattactttggtgcaaaagtaattgctgtttttgacattaaaagtaatggcaaaaaccgcaattacttttgtgccaactgaatacaactgtgcaacccaaacccccatcaagatagaaaccatcattatgacctcagaaagtttcttcatgaccttcctagaggccaccaatattctgatttttcccatcatagacttgtttcaagtttcattggttctagaattttatatgaatgaaatcgtatggtatatatatttttgtttgatttctttcactcagcataagattttctttttctttcttttcttttcttttttttcttttcttttttttttttttttttttttttgagacagagtctcactctgtcacctaggctggagaacagtgatgcagtcttggctcactggacctctgcttcctgagttcgagcgattcttgtgtctcagccttctgagtagttggaattacaggtgcacaccaccatgcctggctaatttattgtatttttactagatctatggttttgccatgttggccaggctggtctcgaactcctgacctcaagtgatctgcccactttggcctcccaaagtgctgggattacaggtgtgagccatcacacctggccagcataagattttttagattcattcatgctcatacatcagcattcatttctctttgttgctaggtaatattctgtcacctggtcacttgtatagaccatatttattatctactctcctattgatggatgtctgagttggttccagcttttgattacaatgaataaaattgctataaaaacgttcatgcacaattctgtgtatagacctgtttttctttcgcttgggtagactcctagcagtaaaagggtatgtcatggggtagactcatattgagtgttatcagaagtgttcacttatttttctgaattggtcgatcctcttccggataacgcgtgagagcagtgacggctttgcatcctcacaaacatttgctgttactgatctttttaattttagcgattctggtgagtgtgtagtggcatcccattgtggatttaatttgcgttaccctaactacccatatgtatgcttattgaccattctgttctgttctgttccttaaaggaacattttgttcgtttattggctttgtttgtttttggcttggctaaagtcaaacttgcatcctccatctgacctgagatgagagtcagctcaaatagggatacctggagactgctcacgcgtgcatggttcgggggtcaacatcggcagagttttgggcagaattcatacacagaagttggggcttcctgtcactgagtctcttctatctggattttcctcccttaatttccaacagctactgttgtcatgaactctgttctctgttctgtaaacaagcagtccccaaccttttggcaccagggactggtttcatggaaggcaatttttccacatattggggacggggatgatggtttgggggtgaaagtgttccagctcacataatcaggcgtttgttagattctcataaggaacgtgcgacctagatccctcgcatgtgaggatcacaattgggtttgtaggtttgtactttgtactcctataagagtctaatgccactgctgatctcacaagaggtggagctcaggcagtaatgctcacttgtcagaggcacatctcctgctgtccggccaggttcctaacaggccacagaccagtaccggtccatggccgaggagttggggacccctgctataagccaccaagactatgggttttcagtcagaatgtagtttcccatctggcactggttggtcctcttatcaggctgaaagccagaaaaatgggaaatttacccagtgtcaaattcttccaagtgtttagcctccagttttttgtttgtttgtttgttttggttttttggttttttttgagacagagtcttgctgttgtcagcccgggctggagtgcaatggcgagatcttggctcactgcaacctccgcctcccaggttccagcaattctcctgcctcagcctcccaagtagctgggattacacgtgtgcaccaccacagcaagctaatttttgtatatttagtagagacggggtttcaccatgttggccaggctggtcttgaactcctgacctcaggtgatctgcctacctcagcctacgaaagtgctgggattacaggtgtgagccattgtgcccggcccaggtttttcatgcattgaagttcacactccacattccccaggtagttgtttattatatgtggccaaaagtttatagcagttttctacaggagaattggtcaaacaggggctactcagctataccagaagtagtgtcttctgcactataaatttgaatggctttagaatattccattgtatgaacgaacacaccttcttttattaaccttgccttctatggatggttattcatattcttcttattgttctctgttatgataactttgcctctgacacaaaatcaacctcactgtgatgcatactggatgtggaactgaagcaagggacaatttatctgagctcaagcttgctcatctgtaaaatgggataattataataacagaaaatatgtgctttaatgagacttaaatggaaataatatttccaccaaatgcaagtagtaatttagtgaaacaatgtgtgcaaagtacctagcactctctggcatgtaattaactcaaattaggtgctacttggttctctttgtagttgtcattgttaccattatccttgctgcctacactcataaatgtataaataaaagattggagaacaaatggcatgtacgcaaatgtgtttcttcctttttataaataaacataccatgaggattttttatgtcagtcaagttgtttttgagaacatgattttaatgactgcataatatttatttggatgatccatggtgttggaaaataataagttacatatctaccttatataaatttctctggggaaacaagtcattaaaaacaagcttatttctaatttcagcctaatgctgatagacaatgtcaactggataaagttgagtcgcacatttcagtagctagaatgctttttaaaagtactttcacgtttggactaataaaaatgacatatctgtctcatcccttttcaaggaagctgaagtgcctcatcaaatttattttattaggatcccgacagcaatcttgtggcctgggtgaaggtcaaggaggttttgccttttgcagaagggagtaacaagtgatgtgatgataaagtgttctttctctctcggttcatccatggtgggaaagagcccttcagctcattcttcagttggaggtggttcagggccccatgttgctcaaattggtgatgacagccagctgtttggtcccaattcgctgagactaggaattcaaacccaggaaaattgagacacctgtgtatgaaaagcataaagagaaaatttggttgccctcatgctcactcttatgccaagtatttattcaagaattaaatgaataagaatagggatttcaactacgttctatcctcctcctcctcctgcatctgcctgaccttcttgggagccagatgttccactgaacactttgcatgcactgtgactatctaatgcaatccttgggacagatctgtgaaatagagtctgttattagtcccgttttaaagatgaggacactaagattcagatggtttaagtaacctgtccagtgtccacagctcctgtattagctgagagtcttgtgccattatatcagaaaagtctgcttgtgtcttacagtcttgatcagaaacaagtatatccctcagaacatagaggcggcaatggggggtgactttgttctaacccacaaggaagattattacatgaatagtatgggaatcttggcagaaaattagtgggttattttttagtccttattagtaaggactccaggcaagatagagttttgttttgtttttgtgtttttttttttttttttttttttttttgagacagagttttgctgttgttgcccaggcgggagtgcaatggtgcaatcttggctcaccgcaacctctgcctcccaggttcaaacgattcccctgcctcagcctcccgagtaactgggactacaggcatgcgccaccaggcccggctaattttttatttttagtacagacggggtttctccatgttggtcaggctggtctcgaactcccgacgtcaggtgatctgcccacctcagcctcccaaaatgctgggattataagcatgagccaccgcacctggcaagatagagtcttttaactttgaaaagttaggattcaaatcagtctagccattgaatcgtatttattgagcacctgctgtgtatcaacctcagtagaagacccaagagatatactggtgaatgggatagacatggtctatatttcagaggcctactagtatacagttgaagacgggcattgaacacaggatcacagctatgctaataggggtgttactgcagggccatccaacctagaacaaggatcatattaccagcgtttagagaatagggtatacacatgcttttaaatgcacagagtgtaccacttcagagaatactgatttctccttagtttgggctgctataacaataccagtgactgggtagtatagaaaacaaacatttatttctcccagttctggagaccagaagttacagatcaggtaccagcagggtagggtttttggggagacctgtcctcttggttcacagacagctgccttttcattgtaaactcacacagtaaagagagagagagagagagaaagagagagagagaaagagctcgcaaggatcatctccttagaatggtactaattccatcatcgggttccaccctcatgacctcatctaaacctaattacctttttttttttgagacagagtttggctcttgttgtccaggctggagtacagtggtgtgatctcggctcaccataacctccgcctcccaggttcaagcaatcctcctgcctcaggctcccaaattgctgggattacaggcatgcgccaccacgcccagctaattttctatttttagtagagacggggtttcttcatgttggtcaggctggtctcgaactcccaacctcaggtgatctgcccgcctcggcctcccaaagtgctgggattacaggcctgagccactgtgcccggccacctaattacttcttaatggcccaatctccaaatgttatcacattggggtttagggcttcaacatagtaatttggaggaggacacagaagttcagctcgtaacattccactctgccctctccccacacatttatgtctttctcacatgcaaaatgtattcattgcatctcaacagcccaaaaagtcttaactcgttccagcatcaattgtcaaacaagctagtacaggagttgaacattttccagattcagaaagatctccctgcccttaatcccagcattttggaaggctgaggcaggtggatcacttgaggtcaggagtttgagaccagcctggccaacatggtgaaaccctgtatctactaaaaataaaaataaaaaaaaaatagccaggtgtggtggtgggtacctgtaatccaaactatttggaaggctgaggcaggagaataggaggattgactgaacccgggaggcagaggttgcagtgagccaagaccatcgtgccactgcattccagcctgggcaacaagacaagactgtctcaacaacaacagaaaagaaataaaaacaccagaaagatctcactaaactggagcaatggactaaagcctcaaagaggaaatttcatttataaggttaggctgtagaagtaagtacagaatcaagagatttggcataagaaaaacctacgtggaaaagatcagaaaaagtccctcaagcacagagtcaatattaattagcaaagcattcggtgctgctgttttaacagcaacagtgaattcgcacgtttgtttttcaggccatgcaaagggaaaaatgatttatgtctattcccagacagtgtgttttaaacggtgtcttccctttcaagagacttttctagtaagaattttttttaatagggaaataagtaataactttgagagcaatttaacttgatcatgaatcagaatgattcagaaccacaaaagaagctgatattctttcatgttctctaaatatcttcactaaatgtaaagtaattggacatttataagaattcagactctcccataacaaaagtaataccaatcatgggttggtataggatgcacagttttaaatacagcatcttacttgattctcaaaatactcttgggagaagagcccaactggtgtttttatgtgtagtcactgtgtgtccacctgtttcagtaaagcattaggacaatttacataactctataccgtacagtataaacaaggctgtgatgaaatttgaaaggaagacaataaggataggagagctataaagaaggcaaaacaagtgaacacaattccaatctgtgtagtcctgcacatttgctggaggtggaacaaaatccttgcccccatgttatgcatatggaaattgagatttggagagattactgacatgcccagtatcacagagctagtgagtaacagagcccaaaacacatcagccccaccgaaattctgttgttttctctagtactctatgctgccttccaataacatgaaatatggaatttgtattggaaaagatgccaactcgcagagaaactcgatagaactatagttggaagtgtcttttcaatatgagcctctagctataaatggatgaaatttccactccctcaaagcttagaactttcttactcttagcagctcactagttgtttaacatacctaatattaaccatctggtcagggagctaaatacaatgaagggcatccagctattatcccacccatttgcctatcccaagttatgttttattaggttgagttgtcaattttaaataatcaagaaagatagctccaggtaagtctcactatctcgttaataaccctttaccaattgcagctgtttcgagaccagacctttgcaatgagtttagaaagctgctgtggacctatcataatttttactacactttgtggccacatgaactggcagaagaggctgtcctaaaatcctaatgtggcaaaaaccaattttcagaagtcaatttggatgttataggtagcgctcttcacacccaataaattgcttatctttggctttgaactgatgggcacgtacacaaaagattggagccaactgattgcattattagctgaggaaaaagtgtgtgactgtggcgaatttagcaaggggtagtctggagaaggatctgtgacctgggaaaagtttgttttgacgtggaaggtcaggagtttttgtttgtctcttgtgtccctttttacgttcatgtctgtccagaagtattcatcttctctttgtggtttaaatgccctgggcagctgaattactgtgtgacctcctattgtcagagcatctttgtggaggagaacccatcacctgtctctcgaaaacagttgtcctttgaactttcaagattatggggaaaaaatgtacttattttctcaatcatggagagcatgtcctttagagatacctttggctgcagatatgtgacacagctgatttaaaatagcttaagtacccaggtgcagtggctcatgcctgtaatcccaacacatccggaggctgaggtgggtggatcacctgaggttaggagtttgagaccggcctggccaacatggtgaaaccccgcctctactaaaaatataaaaattagccaggtgtggtggcagcacctgtaatcccagctactcaggaggctgaggcaggagaatcccttgaacccaggaggcagaggttgcagtgagccgagatcgcaccattgcactccagcctgggcaataagcacaaaacttcatctcaaaaaataaaataggttgagtaagtagaggtgtttttcttgcctaacgagaagtctcagtgtaggtgatgctgggtttggttcaactattcaacagtgctatgagaaattcaggctattcctctacttcatctcagcatccttaattgtctggctttaatcttcatagttttccccttatattggtctgttttcatgctgttgatagagacatagctgagactgggaagaaaaagaggtttaattggacttacagttccacatggctggggaggccctagaatcatgacagggggcaaaaggcacttctttcttggtggcggcaagggaacatgagaaagaagcaaaagcagaaacccctgataaacccatcagatgtcttgagatttattcactatcatgagaatagcacaggaaagaccagcccccaggattcaattacctcccctaggtccctcccacaacacgtgggaattctgggagatacagttcaagttgagatttgggtggggacacagtcaaaccatatcactcctcatggtgtgcaagatggctgatacatgtctagctatcatgtcagcaagactgggagaatgtggaaagggtgagccagccagccatgcttgtcctctttggaataagaaagtcttatcaaaaaccactagaagtctactgtttgtctctcataggccaggactgtgttatgacacagctatgcttagctgcaaaggaggctgacacagcaagcatttggctgttttatttgtgccttaaacaaaatacaagctctacagcaagaagaaggagagaaataaatgttagggagatgagcaaccatgtcactatgggttgtatagtcaaatacatatatttgggaaacgttattttcttgctgacagaacttctcagaggtctcaatatgctaagacacattgaagctcttgatggggaatagtcattatatttggcattttgccagagtaaacaaagaacccttaatttattctttagaatacctattaattcagaagtgttctgaatggcgtcatgaaatactatgttagtgccagctcacatcctttgctgagagagttaaacgtatttgtctcaaatcagcacagccttctacagctaaggcaggtgtactggctgctccaattgagaacaaacaaggcaccagggcctttgcatgtaccccatgatgaaaagatggtggcctaagtgcaaaatggttaatgaaataccaaactcagataccaggccactggtgtcttccagttcactacatgtttaaggcaaaaataagagagcggttttctcagacagagtcttgagactacaaaacagtcaagacatttccccaagcaaactcagaaaaatattaagcctagacaatgtagagcgttagtagttagggaatgcagtatttcaattccagatctaccatttataagctgtgtgtttttgggtaaggtactctgagacttagtgttctaatctgtaaaaggggataattccttccactggagttctaattaagactcattagggtgacgatggttgtaaagtgcttattgcagtacagtggagctgtttctgtcccagatcctttatcaaggattgagccaagcggaatccttgtctttgttagtccaaattggattccccattcctcaaggtcttgtatagcttaacttataactttcaaagcaagatatcctgacattgctgttttgaccttgacatttaaaccatgctttgaaattaagttttgtgtctttaccttgccagtagtatttgctccaagaagtaagtgcacaccaccagtctcaaattcagttcataatattgctgctaagaatgatgcacacaaaataaaacaagcaatggcaaaaactgggcacagtaaaatttgctggagataggaaattggctaaaagatcaaatattgctggcatcatgaaaaaccacaaaaaaatcctatgaagaattagacttggcagaaagaacgagagcaaaataaaattataatggccaaaactacatagaagaggttttattattgactagaaatcaatgcaaatataaaaaaagacttcctgtcaaaaatacacaaccgcaaaactggctttggcggactaaggctaccaaagaaaatccacaagtcagcagttgccattggtaaaatttaacttggcaaaaaacaatcaatgaaccaaatagttgacataaaatgtacacacagcacaattaatcctgatgaaaataattccagcaaagtaaaattgatttttttaattcagttgtttatgccatgtaggaaactgatcaatgacttaatttgacgtgataaagtttgctttgagaaacattggatgaacaatgttggaaaaagtctgactcattttattgctttgaaatatatataaaaagctagcaaggtccaaatgataggattaaaatatcctatactcattttaaatatacaatgcttagcaccagctggacacggtggctcacgcctgtaatcccagcactttgagaggccgaggcgggcagatcacgaggtcaggagttcgagaccagcctacccaacatgtcgaaaccctgtgtctactaaaaatacagagattagccaggtgcggtggcatgtgcctatagtcccagctactcaggaggctgatgcagcagactcacttgaacgcgggagccggaggtcacagcgagccaaaaccgtgtcattgcactccagcccgggcgacgaagcaagactccctccgtctcaaaaaaaaaaaaaaaaaaaaaaaaaagcctagcaccaaagtattagcaagttcctgttatttattaatgttctcatactttcattgaatttttaaacctaatgatgtttattttcaaacacttcagtccatttattattgaatataaaatgggtgctaattacaaatgggtcttatgtatgcccttgggttgtctagcaagatggtttcataggtagtaataagagcagcaagagaagaaaatagtgtggcctttacctttactgaacactcactttggaataggcctcatgcttgggactgcctccgtcagtgtgcagccttcagcggctacatttggaaatggtacaagtattaggttggcgcaaaaagtagttgcggttttgccactgaaagtaatggcaaatacttagaaatatttagaatatttagaaagtacctgctgttctgactatcttaattcagatgtgcactcaccttttggctcacgacaacaaaagccttcgaaattcctgcctgtttagtttgtgttgacacattgcagattcaactctgacatgttatttccttatgctgagggtgtcttgttgagtttcatgggttttgtgcttccctggtgccttattaggcttataactcacagagctatgagtttaaatgtcagggttgtcaccaaaacaatggagcaaaaagcaagttgttgacattctttggacgcaatttgcaatcccctttattttcctgtaacgtttttgtgtttccaggtgacagttgcccaccgaaccacagaaccacaaagcccagagttttagttacatactgctgctctaggatcagtagcccttaggtccaaaagccgtttctgatacagccttgggcaagctggttccttctctgagcctgggcccctgtcctataaagtaaaggtgttattacccttcataggattgttgtgagaacaaagtatttacattcttcatataatcagaacttttccaaaaacatgggatcttttacatggctcaacatgtttaaagctgtttatgttcatctgatattttaacattttgtagagtagaaaatgcttcaagcaaataaatgagctttatggtaattttttttgccagcatttagaagctggtggttaataaatactaatatgtatttagaagtttagaacagagatttttcagcaacaaccacaggctagatatagcccactacctgtttttgtcaataaagctttaatggaacataagcatggccattcattaatatatgatcaatagattttttttggtacaagggcagaattgagtagttgcaatacaaacagtgtggattacaatgcctaaaatatttactacctggttctttatagacaaaatttacagactcctgaggcagggttttatcaattcctttccatgtctatggatttagatataagcgtatattttgttaaatattacagcagactttgaggtggctatcatctccattttacagatgtagaggatcaggctcacaggtagtgaatggcagaaccaaggatgaattccagcccactaacgtcacatctctatttgatcattagcgtatagacttttggtccttcataaattttactttataaagatattttacgttgtataattgatgtcatggccatattgtttaatcatcactcaccatgcacctattgtgtggcaggcactattctatccattagggcacaatagtgaacgaaaaacttgctgccatcagagaacttgtgttctgggctttcatgcacctgccttgcaggcgtcaggaatctgaatcacactcattccctccatcacttggctcaccagtgggaccagacaggagtcctgcagtttcagcaatgaaccccagggcttggtgcctgctctggaggtggggaatggggttcacagtttagtggaagattgcctttagggagcactcttggtttctagaacctgatatagatgagggatgtaatgaattcgagtctgaatgtttatttgccatggacttctatctcacgactttgctataagggctacacgtcggaaatgggatctaagtaaacgtagagtccacaagtttcaggacttatatagatgagtgaatctcagattttcacgtgcatacagattacctgaggatcttgtaaaaaatgtagtttctgatttcaagtctctgggatagggcctaggactcagcatttataacgacatcctaagagatgctctgaggaccatactttgcatagcaagaaatgagaacagtccaggagcctctaagatccctcacatttgaggctagaagcatgtaacatgaatgggttctcaaacctaaaagtcagggcttgggcataaactaaaactgtgatcacctcgcgtagatttgaggctttgactggtcgtcaaccccacccacaaaagcctacagcttcctcctaccccaggtcccagcttctccacttctctccaactacctcccacttttcctcaatttcaggctctttcgtgcctccagcccagtctacagcatgttccctggttcagaccatcccaatcagacccctatagagatgccaagccattcgtttgtgggccgggcacggtggctcatgcctgtaatcccagcactttgggaggccgaggcgggcagatcatgaggtcaggagttggagaccagcccgaccaatatggtgagaccctgtctctactaaaaatacaaaaatgagttgggcatggtggtgcacccctgtaatcccagccacttgggaggctgaggcgggagaatcgcttgaacccaggaggcagaggttgcagtgagtcgagatcgcgtcattgcactccagactgggcgacaaagcgaaactgcatctcaaaaaaaaaaaaaaaaataagtgcttgtctctgctcaaagagaagtcagaaatggcagcaacattcctagcccaggctctgcactctcggtaatccctctgactgactctcaagtcttccccgtctgtctgctccgactgcacgagttggtgattaaactttaaaacaacaattagacccttgattttcaaagcaaacttggtttatagaccagacttcagcattcattacaatacagactaataaaaacaaatccggaaacatacgctttttaagctgtggtggtgtgaaatctgtaacagcattaaaaccattttgaaaaaaaaaaagtcatttgggaacccccagcaaaatactgtgtggatattcttttctattcctcattcaagtatattgcatatatataaacataatatatatgtttgttactgtaatttttctacttattatataacattttctatgttgctacatgatctttgtaaatattatttttaaagactgtacaatatttcatgtagttgacaagccacaatatttgtaaacataaaacatttctcccctgggaaatattttagtgatctccttcttcctttctctctcttcttctttcttccttctttccttcctttcttttctccttctcctcctctttgcttttccccctactccctttttctccatcttctgctatcagaaaaaaaaaaattccatgagcacttggtaaccatctactttatgttgaattatttcctagggtaaattctcagtcagtagtaggaggcatatttttcccattcaatgtagtttgagaagcccaatgaccaaatcatgagatgttgccattctctatgaaaatcacaaaggatgactccctaaatacattttatgtctacagagaaactgtataattctgacattaatttcagttccttacaactgccttcattccttggggagggtactgaaatgagctccagctggagactaagtcagctcaagccactaagtcatgggctggtcttgcacaaattattttctgtttctctgtttctgtaagcttacaatttatatattgtatattttataaacatacctcatcagataaggttatagtgaaaaatatatctgctagggtattcacttcataagggaaggcttttttgtctgttttgttcactacatactatatccccagcatctatagcagtgcctggcacatggtgggtgtataataactgtttgtttcatgattcattttttaaaagatctagaaaaagaaatctttactccaaagggtttgaagcagtgattcataagtattttaagaataaatgtatctttcacacctgtgtgcctataaatataatttcacaaataattctagtaagttcagagaatctagaaatttttttctgtgcataccaggcaatgctggcattaaaaatttattttgaaaatcctctaagttctaattcacttgacattatcctaccaagttaaagaaccatgaaataataagtaattcatatcactgcattcatttctcattatggactgtcaaaattgacattcttgttcccgttttatagaagcaaatcttagactcagaaaatttcaaagaacttatccaaagtgacacaattcttcaatagagagcagggactacaacctaaattttctaattcaagtccagtagggtctgccttaaatgcctcccactgtcaccgtgttgatttgtataacctttgtcttcctagcatttgattgacggctactgttagtacagatcatctgggctccttgtagtgatggacacattttcatgaggcaaggtcttagatgattaaaacaaggcagatgctaatgccatcctcaccttcatctggaactgtctaactagagttcgttaacttgtcagccctagttccttttgagcaccaggctgatataataaaatattgcaaatcaatagaagctttaaagaagcttcatctgtctttctttgttacttttttcctttcttcttcttttattactacttctttctttgccgctttaaagggaaaactgctatccctcttattggctgtacaattctgttttctctgtttattttgagttgttggaaattcaggtacatccaggttttcccaaatacacctattattaccccaaagagtaggaagccgatcttatctagattcactcaccaaatctagaatctcccaagagactccaaatttagtacattaatttttcttaagtataacattgctcagtaactatgtgggtgaagatctgaaagttctgcagcactgtttcatttataaaaataaaggtaacggtacttttgcgcaagatttgtgtggaatctaaaaacttccccaagttagtaaggaaggcactgtgatagtatctactaatgaaaatgtgagcacagagatggttataaaataccttatttttctcttcttcattattattgctcatttcatttgattagcaatttctagactcactcaacctccatctataaaagaaaccattagtctttgcctatgtctgctaaagcgaacttcttgttctgtctcatcttcattccctactcagtttctgtcttctccagcccttcttacattattgaaataattgactctatcaggtggatttctccagttgaacacatttggatttgtcctgtggaaacaccataagtacttttttttttttttttttttttttttttttttttttttgaggtggagtcttcgtcttttgccccggctggagtgccgtgagtggcacagtctaggctgactgcaacctccacctcccgggttcaagcgattctcctgcctcagcctactgagtagctgggattataggcacccaccaccatgcctggctaattttttgtatttttagtagagatgggatttcaccgtgttggccagcctggtctcgaactcctgacctcaggtgatccacctacctcggcctcccaaagtgctgggattacaggcatgaaccactgctcccagcccaccataagtactttaatatgctaatttatttcaaacaatatgggaatcagttcaaagcacatagtctcttccatgcacatcttcatgccggaatttgctaggcgcttgtacctccactcccttcttctcagtcctttgtccaaggaattcttccctcaaagagttctcagtcggaaagcatgtataagacaagaaaataaatggataccaaaatcaacaagtgaagtaaattcccagaaagcacttgcaatagtatatgataagaagtgggaactccgtaaaagaggcagaaaggaaatacctgaaaaggttaagcaagcgagtaatagcctggagagaagagttacagaaatgtttcatagaaaaggtgatctttgaggtgagcttttatgaataggcaaaatttgggtaaagaggtagacccatttttaagagcagggtgacatgaaaatctcaggatatattactcagcaattaatcctcattgttgtaacaaatagttacaaaattctcgttgcatggctctggcttaactgcaaagcaaagtagaaaatggagaagctcccaggcaaggccaacaacgcctggtctgtgctgcacgtgaagatatctgagcacttgtgacccctgctttgccctctttgtcattgcaatggggttactgggaaagcctctcccatggtggttgacaagagggaaactttgggaaatgttctcaggagtaacccacattattttcacgcctgaaagatgcaaggttggatagagagagaagttgggctgtggtacgcttacaacagagatctcaactgaccctgcagagagctttaagatgaggagaacccttctgtgttgtccttactcaggacaaggagctgaggtcttatgcctccacattgactagtcattgaatgtaggctcatttcaggaagggagtataatcttgggagaggtgctgtcttcagcagaaggcaaggcctcttagtttatagctgtcagcctccaacttcccagtggctgaaagaatgaatgcttcagttccaaataaagggatctgagcagcaaatcccatcgtcctgtattttcattgaagtagcatttcataaccagtaacaactgtcttcccctgaaagtgtggtttaaatttaaagttggtgacttccttctgacttgtcaaggcgtgggcatacgcaattttttcctctatggttatagcttccaaactgttagctatatagatacctactttttaagataagtgagacctcaatcacaattaactctgtaagttattgaaaaccggtttgatgatgatcatcatcatcctgtgtacaccttgtgtgagcttgaggtcctattgtaggattaatcatcagagcagtatctgcagtctgcagtgcatttcttcttctttatttgtttagaaaaatcccactcttcctcccaaaattaactttattgtcaacttgataagaagatttctgaacagaaataaaataaccctgatttgtggtgtttgccaattactgtggtataaatactcacactgtggctgatgccaagctacaaacatgacatcatggaattggaagaaatagtaaaaatcatttataccttctccaaaacactcactgttcccaaaactttcacctcaataattctgtccactggtatatcaacatggtactggtgtagtaatgatccattccaggtacggacaaaaaaagataaataaaacaacaaaaaacttactaaatgccatatggttttatcatcttgtgctggcaatttgtaaacatcatcagtgataaagtacttctcccaaatgggatgaatcatacctatcctcaccctgcttttggacactggtatatcctctcaaaggcattaataactatgttataatgcaaatatcacgttatctttctatgatttttctaacccaatagactgtgagttcttcaagcttatgtatttgggtacagaacacctcgccaaaatccttggcatatggtagatgctcaacacaggtgcactaacttgttagttgaagtgaccggtacaacctagttaactgaatcagaaccatgaattcagaggatagtagtaaaaaatcaagttcatgaagtttttaatgagcagtatgttttgcctaagactctatgattctcactgtggaatgaaccacatagactccagaatgtgtcttttcttaaaggcaatagaggcatgcagtgaataaaatgcactgagagaagcccataaaacaatattcgtaagtacagagaaaggcaatattaatgccaatttcaggggatctgttcaagttcaccggaaggcagagtttttagcaattttttaaaggttgaacatgtctttaggaggtagcaacaagacaaaggtccaggaagagggtgtgatgcagtggggaagcatgcagtcaccttgtgccgaacttaacaggtcaagaactccgtatgtgaataatggtggaaatatgtggagttacaggtacaactctgtaagggcattagcctgtaccagctatcattgcgtaccaggctatgtgtggactttgtccttgtgaatctggtaaaagttaatcatcaggtctcaggagttcagcaaccgaccatcatgagctatatagtattagtctgcagctctacctgagagcagcccagaaaccaaataggaatatatcagacattatcccagagagaaggctcagtcaaggatctgcagctgggacctgcatatcttaattcccctgttcctgggaaagttatccaatagctactgaaatacaagatggaaggtatcctctctgtaccatagctaaaggattgctcacaaaaatgaaagtgcaattacagaaaaattatccttgggctatgaccacatctcctgagtattttattgccaccacgactcatgatttcaattctcaggactgagtatctctgctgaacgcaaatttaaattcttaatatgagaagctgcgctttccagtcgtgtgtcaatgcaaagtgagcggatttgggtttaactcccttggactgagtgcaattatatgttgggaggggactaacaaggtagcccatgtaacaatactgtcgtaattatgtgcaatattttcatttttacttctgatcaaccgcaagagtagattgaatgctattgttcagtttgcacttaaaaatgatgatttttttatacctggagtttaacatctgagtttttgtttaaaggaaaaattgtccttgcctttgaaagttagggtcatgttaaaatatttactaattctcataaaatattttttttctgagcacggttgaaaataaaaatatcttggtcctgtcctttgaataatgtcaagattgagtgtacctctggagaaatattgatagagactcaaagcaataccactctcccttgtcacttttctctgtgtactgtggacaagttgctcaacctcattcaaactcagtttttctcaacaaaatttgatatcaccataaaggaggagactcggttgcctttgtttttattattaaaaggaagcattgagtctaactgatatgaaacatttctgtatatgcctaagaacttatgaagctcataggataagaattcttggcaatccaaataatctcacattgtctctaatctgttataatgctgctcttgcctcataacttttgttctttgtattccttaaaaagacctaagagagctcaagattatggggtgctgccaaatataacactagtcttctatttttatttttaaataaaactttgtaattggtaaagtcacagaatcagtgtgcatatgatcaaagtctataaaataatgaaccatgcataattgcagcagagttaccaaggaaggctgtaaggatgatctcactggtgcagccaataccccagtaatcaatatggatgcctgggtgacaactccttccttcctaactttcacagcttgcctgactgggatagccaaggaaggcatctgtgaagaggcagcatctttagagtttatgtgggaagtgcactctaggtaagacagatgctatatacaaaagcaggaaaatgtaaaatttgttcgtaaagagcaactagttgcatttgatctaaagtagatgattccagtacaaaaaggaaattacagaagttttctcagctccaattttagagagcctttaatatcatgctaagagggtagagtagaccacattccacaaagaagaaacagtattttatttgttcattccttcttacaaaaaatatccacctagtacctactctgtactagcttaaaggtaacttttgaaaaaaaaaattttataatgcctagtcaagaagcatatctggatggaatgaaggagaatgagacttcagggcaggaaagaaggcaagttaggatactattgggatggtccagataagagagagcaccgtctgaagggtctggcttataacaaagaggaaataatctttgagaccaaacagaaaagtgtagcctcaagaaatattctttgtcatcctagtggttgctttagaatttgtagtatacatctttaacttatcacagttcgtgttaaataatattatagcatttcatatatggtataagaaccttacagtaaaacactttcattttctcctttcccagcctttgcactactgctcctctggtttttagttgctcataggttgtaaactctacattacattgctattattttttactttaaacaatcaattttccttctaaacatagaaaaaggcatatttttccacatatacaccactttctgtgctcttcattcctttgtgtagattcatatatccatccaacattatttttggtttggatgaaggactattgaacatttcttacaatgaggttctgctggtgatgaattccttcgccttttgtatgtgcatctgaaaaagtcttacttttgctttcaataatgggagatatcttcactggatacagaattctgagttgacaaattttatttttctttgagcatttcaacggttcactccattatcttctgacttgcattgttgctaacaagacatctgctgtcattcttctctttttcctctgtgtgccatgtgtcttcttccctctagctgctctcaagaatttatttttattagtggttttgagcaatttgattatgataagaaacatttttgagtggagaatcaagggaaggttgaaacagataagacgtcaatgctgggaaaaaaggttaattgtgagactggttgttccttatttgagcctgataataacaatctcttcaggtacaggacaaatgtcatgacagaatgcactttaaaagaaaaataatagctaacacttgaagattgctatatatacctatgtgtgtgggtgtgtatgtatacatacacatatacatatatatgcacatacacacccacacacacatacataaagatagtgttcatacatataagatctaacttctaagatatataagatcctattctaacatatttaatatgttgcatatattagaatatatatttgaacagtatctcatacaaagtatgtttacacaaagtaggtgctctttaaatgttaactattacataaatgtacacacacacattttacactaaaaacaattctatgatgtaggtagtatgataatcttcattttacacattttttttaagatggagtttcactcttgtcacccaggctggagtgcaacggtgcaatctcagctcattgcagcctccgcctcctgggttcaagtgattctcctgcctcagcctccagagtagctgggattacaggcacctggcaccatgcctggctaatttttgcatttttagtagagacagggttttgccatgttggccaggctggtctcgaagtcctaacctcatgtgatctacctaactcagcctcccaaagtgctgggattataggtgtgagccaccgtgccgggcctctacatattacttctaatccttaacataacagcccatgattccactctttcaatctcgtttcttttaactttgaaccattctttgccaattactttacctacctgtgtctcagtttcttcatttgcatcatgaagctaataataaaaccaaaaggctgttttgagtattaaatgagataattcatttgaaaagtgctcagcatagcgccagacgcgggagagcactcagtaagagtgaggaggtggtactgttatcgctgctgttttatgctttcttctgcctgcgagttcccacttggttcattcaaagcacccacactgtcctacaaagccaagttagcatgcagcctactgccctgatcatgcagtcacaatctctgtttctgctaacagtcagtaaacacaatttagcatctcgatgggtttcattgctccacataggctcatttagacttttcaactagattaactcatcactcattcaattcgtgtgctgtctgaggacacaccaggtgccaaggactgttctggtttactagggttagaaaggtaaataagaaagataaaaattaaatccctgcctcatggatcttatgtatgggggtgggggagacaaacaaaaataatataaataagtaaaatatgtggtatgatagatgaaaacaagggacatagatacaaataaagcacagaagggaaataggaagtgttggggataccatatattttggataccgaggtcaaatttcactgtgtgggcaggattatctcacccatttcagaagagaggaaactgatgctcagagaagggtggtgaattttttcatttcatgcagcattggtttagagacaagatagaaatcaagattctccaacttacagtccaagacatatttctgtagcgggcagaagctgaactctatttgtgctcctaggtggaaaacaatggtcctgtagtcctcatcaccatttcccatgtctgaaactgtctttgtctacctcttttcagttcttctcaacttcataacctattcttgctgtatctaaaaagcattaatgatccactggcataagaattttgggttagctcaagccaggtaggatagacttgaccatatgttcgtgcaagttacaaacagccatccccttagggtatacacttgcagcacccatgggtgtgtggttgcagaacacagggtaaatttcagccctcagccacttcctgcagggacttttgtacagcgtacaacctttaccaccataaatggaggctttttgtatttcacacatcatttaactagtgaaagttgcataatagatactcagtgaatcatggatgattgaattctttctcatttttcatttcctatatgattcagatcctttatatttcagttcatggtaaaggacaaaaattatttgtcaaatattgattgagcacctactatatgccagacactggtctaggcacaggggtacagctgtggaaaactgacaaaaatccctgcatttatggggcttacatttataatatatatttatatatcatttgtctcttcttaatagaaaagtatatagaggtatgtatatatacatacatgcacatatactatatactataagtatatatacttatgtatacatatacatatacagatatatactttatgtgtattatatatagtgtattgtatacatgtttatatactatatatgtgtagtatatatagaacaccatatatatgcttatatactctatgtctattatatatagtaatgtatatatttagtatgttagattgtgatattgccaaaaaaaaaaagagtaaaataaagcacaggaggggaaatgaagtttgaaggatgttttagaaatactgggtagaggctgggcgtggtggctaatgcctctaagcccagcactttgggagaccgaggtgggtggaatcacatgaggtcaggagttcgagaccagcctggctaacatggccaaaccccatctctactaaaaatacaaaaattagctgggtgtcgttttgcatgcatgtcatcccagctactgaggaggctgaggaaggataatcaattgaacctgggaggcagaggttgcagtaagccgagatcgtgcccctgcactccagcctgggagagagagtgagatttcatctcaataaggaaatagtgggtagagtggccaggacagggctcatggagtaggtgacttgtgaggaaaggtctgaggaaagtgaaagaactgctgtggaagacagaaccaaggccccaggattgttcacattctactccttggaacctgtgaatgtgttaccttatatggccaaatagactttgcaaatgtgattcaagttaaggattttggattatgttgatgggtccaatgttatcaccagggtccttatgagagggaggtaatgtgtcagagccagaaagggatttgaagatgctacgctcctggctttgaagatgaaggaagggtccatgagccaaggaatgcaggcagcctttaacagttggagaaggcaaggataccttctggtgtacatcttccagaaggaacacagttctgatgacaccttgattttagcacaggaaggtctgtttgggacattcgaccccagaaatgtaagataataaatgtgtgttgttttaagtcgctgagtttgttatgacttgttatagcagccattggaaactaatacagcaattctgtggctatctggcggaagagatacccaggcagggagaccagcaaatctgcaggctctgaagtgggggtgggtctggtgtgctccaggatgccagtgtgcctggactgagctggagtgagtcaggggagcttgcagtaacaggggcagagtgcagatgacatgagattacatgacacactgtaacccggaacaaggacactggcttcactccaggtgctaggagatcgcactggaagctacgaagcagaggagggacatcacccagttcacgtttcaacaggaccgctctggccaccctgggggagggtggtgaggaagaggatgtagaggtatagtcaggagatgtggagcagttaggaggattgtgttttgatccaggaaaagatgattttggcttggagcaaggtggtgggaattggataagggtaagagggtaagaaatagttatattgtgaatgtattttgaagatggaggtcattaaccagaaaagggtaaatgtgatacatgtaggctgaactggaagagacagtgaataaaattcctttgctaattaaactttcttttttttttttctttttctttttttttttctttttcttttttttttttttttttttttgaggtggagtcctgctctgtcacccaggttggagtgcagtggcacaatctcagctcactgcagcctctgcctccctggttcaaacaattttcctgcctcagcttccgaagtagctgggattacaggagtgtgccaccacgcccagctaatttttgtatctttagtagagatggggttccaccatgttggctaggctggtctcaaactcctgatctcaagtgatccacccacctcaacctcccaaagtactgagattacaggcgttaactgaactttttttttttttttttttttgagacagtctggctctgttgcccgggatgaagtgctgtggcgtgaactcagctctcactgcaaccagtgcctccaggttcaagcaattctcctgcctcagcctactgagtagctgggactacaggcacgtgccaccacgcccggctgatttttatatttttagtagagatggggtttcaccatgttggccaggctggtgtcgaactcctgacctcaagtgatccacccacctcggcctcccaaagtactgagattacaggcatgagccaccgtgcccggctaattaaacttttaatgtggaaagacagcacatgcaggagataagaggtagagtgggtgatggtccaggctctgagcggaatggcctgtgttcaaatgctggcttctctaacttaccagaattacgtatgtccttgagcagagtgtttaaccttcctgtgcctcactttcctcatctgtagtatgggatacatcacagaaattgtgtatcaaagggggaaaatgtttgcaagacttagtgcctaattcacagtaagtgctcaaaaaatgcacacagtaagtgctctgtcattttctagaacacattgatgtttaaaaaaattttcctacttgtaaaacagtcaaagagttcagtgtgaagtatttgcaaaaaatttgaaataaaaaattactcctttcctgtggggcaagttcacagaatagctggtatgctgacaattttctcttggtcccataatagtttttcagagtttcattataaaatagttgctgtatttgccaatgcagactttgaagaaggagactgatccttctggcttttaaagaagaatgagtattacacgaccattgaatatttataacactctcttctctttttaaagctgttgttgttttaccatcctaacatcaaaaccactgggcccagggaaacctcagatgtgggagaatatcaaatgtggaacttttccttgtttttcctggtggatctgacacaccttggaaccttcaaagaacacagtaatcaatgacgtggggagacgtgagacatcgcatacattattgtgaagaatttattaatgtaaactgcatggtgtggaatagaggttggggctgaatgaaaatgtgaggctctgtaatgcgacaaaaaacacagagcagagagaagagagaggccaatgaaagacactttgctgatttgggacttcactaaagagagccacataaaagagaaattattgtttaagtaggttaaggcaaccctagtgttttaattaaaatgtctttagcaaaaaaggaagaagaatagtacttgaggtttggggaaggcttcagtgaaagaagaaatgtaccaggcggtggcgggggtgggcgggggaaatagtgtaatttaggttaaatattgtgaataactccccaagccgaataatgttgaatttcagtcgtaggagatatttaagaattggttgaacaaagggggcaattgactttggtggttagtgtgggagacagctttctaattttagagtttgcagccataacattatgaagctaacgaacaaaaacaagccatgtagataaaaccaggagaaataaggatctgaaaaatggaccaaatcgatcgagttctggcaatgagtgcttccttttcgtaaatacaagggcagtgctctgcatcttctccctctctcattttctctgagaaaggaacgtgccattcttttttctctctctcttttggcattcctttttttaacttttaagttccggggtacacgcacaggatgtgcaggtttgttacataggtaaacgtgtgccatggcggtttgctgcacccgtcaacccatcacctagatatgaagcccagcatgcattagctattttaagaggaggatcgatttcaccctttttggaaaactcaatctggggcctgctttccccaggatcaccgtaagattctacctgaggagctgagttttcctaagaatgaaaaagcaaagagacccctggttttgtatttgatacaaagtcaaacgctgtttttctctgagtctgtcctggaataatccagtgacatccaccatcatctgcatctcccatggaaccaccacatgtgaagtcgaggctgagcgcagggtggctgcaccatccacatcaacagccagcactgccttctgccagtttatgaggcaattcggctgccagggagaggagaacagtgtcccttccaatccgatgagtaaatgcctcaggtgttaggtaaaaccccaaggtttttctcttctctggggccaccctcaggaaaggaaaactccaaaaacttctttgggaaaaagaaaaaagaggttgccatgtgatattagatggcatgaattaaatagatactacttattaaagttaaaaaaaaaataaagcctgcatttgcatggtaatgggacctggcagatgaaaccagaaattgatagaaaccacccccaaatcatcatctaacctgtactgaagaatgacgcacataatgtacaacaggcagccattgtcatgtgtgtgtatgtctgtgtgtatctgtgttatcaggcaggtagtgaagaccaggagggagaaagtagtgagtcagcgaagatggtatcccagttagagaaacgacacaatgaaggcatgaagtcatgagacagtgtggcatgtttgggcaacacagatgtggttgggaccacaaaagttgtgatcaaggaaatgtgttggaacaatgtccgccttcacaagattaaatttgtttccagtgatgattttattccactggtgggttatttgtcaatatgttacaggacttttaaaatgttcataacctttgatccagtaacacctcttttgctaatctattctaaggaattctcattacagaaaaacaagcaaaagcaaatgaaactctacctacaacgtcactttatttgcctttcatttatagtaagaaacaattggaagcacttaacatacaagcaggccaggcaccatggctcatgcctgtaatcccagcactttgggaggccaaggcaagtggatcatgaggtcaggagttcgagacgagcctggccaacgttgtgaaaccctgtctctactaaagatacaaaaaaaattagctgggcatggtggcatgtgcctgtaatcccagctacctgggaggctgaggcaggagaataactagaatccaggaagcagaggttgcggtgggccgagatcacgccattgcactccagcctgggcgacaaggcgagactccacctcaaacaaaacaaaacaaaacaatacaaaacaaaaaaacaagcatatcaagggaatgatttaatacatgttgatacatccacaagatgtattgtgccgcaactaaaattatgtttacagaatctttgacgtgggaggaaagaaaacttgggaagtatcattaggttcaaaaaccaaaatacaaaactgctcacacccttccacttcaacttaaacaaaaagtatattacaacctggaaggaagtccactaaaatgctattctgtttgtctgatacaggatggtaaataaatttacttttcttctgtgttttaatatattttttggagtttctctgatgaacctattctatgtggatgattttttttttaaaaaagtataatctggtgtggcagtatgagcccaacatatagtgcatccctcctaccgaatgctaagctaaaactctgggcagacacacactcaagtgcatgcacaccccacacacagacagacagacacacacacacatttgaaaaatgtgaagagcaaaccaaagcagttgggtaggtggattgaagagagtcaaaacttggagaggtgatttcactgagaagagtttcctacattaggttatttttttcttcttaggctttgccttgggactgggttctagtcatactgcagggggttggccaggcaggtagctaagagtcccgttgaatttccaaccttctggccagagaaaccaggaaaagggacccctatggggaaattttgaaaaagagttcgttggggttggtggtggttgtggtggtggtggtggtggtgattctctcctcagctagtataaatagtttggtacataataggtgctcaataaatacttgttgactaaatgaattaaatttttgagaaaaaaatccaccttggagattgacacactatcttccaggtagaccaatgcagccttctttccagtacaggacaagttctgtttctccactggacaccagaggaagtagtttgcatttaggagggtttcatctgaaaaatagggaaactcctatgtttacacactagagtcctcttcagtgcaatgagcattcacagtatgagaggctgaggaactgaaaacaggtgaagagacagctgaattctctttctctctgtgtattgattctggagcatttgcgtagtgagtggaattttaggtgggttttttttttttttttacaatcacataattcattcctctgactctttgtccctcctcttttcttttcttttttcttttcttttccttttgcttttcttttcttgagacggcatctcgctctgttgcccaggctggagtgcattggtgtgatctcggctcactgcaacatccgcctgctggattcaagcaattccctgcctcagcctcccgattagcaggaattacaggtgcctgccaccacagccacccagctaatttttgtatttttagtagagacggggtttcaccatcttggacaggctggtcttgactccctgacctcgtgatccacccaccttggcctcccaaagtgctgggattacagacatgagccaccgcgcccagcccctctttttctttttatctctttctcttccttcattccccgggtatgtagttaaggccatggttgtgaagtatccgcatgatgcatctccactatacaccgtgcttgtggcaatggaggaggcaaaggaccacagaggaaggacccttaggtggaaaagccaactctgtccatgccccacctgtaaatgtttgtgttgcagaactttccccttagttcagctaaaactgagttcttgtcaaacaaccaggaaagactgggctcacagccacataaaagggtgagaaacagaagttattggacaaaaaggaataataactctcagcaaagcgagaaagggtcctgcttgcaggtctcccgcctcatagattgaatcccaggttaccacagaaacaagagaggccaggctcctccccactgcaaagggcacaaacttccttaggctccaccccatcctcccagtgcacaggtgggcattatatagaaagagttggtcgggaaagggtgggcttcatccaggaccagcagtccagtttttcagccttcaggctattttaggctcgaaggcagggttttgctggggacccttggctgtctcttgtctgtatcacttaggctttgcagttagaacacatcaggccagtctctgcatttatttgccttatcacaagcctagagaatgtgtacccatccctaggagagtcctcagtaaatgactgatgggagctgggatataaatcccccagctcccttgcccttccgagtcacaggttctgccctgcctcctggaattctccagtgggaatgtacttgttaatgcttccctcatcagctcccttcccctccctgcctcacttcctcattctcctgcccacatttcctgggatgacccaccaataaagtacttgctgttaaatcctcaatcttagggtctgctcctggggagcacagactaagagtattgaggtcctggttgtcctgattctactatccagtgggctcatgtacaaaaaggaaaccagaagtcacgaggatccctcaggtggcctacagtaaagcagggaaaagatgaggatcatagcagggaatgtggtcataaagagggaagggatggattcctgggaaattttcccaggtggaatctgtaggacttggcaaccgctcgtgagtgcagtatggtgggaaccaaagaagcctttcatacgatgtgagtgtctaacccctcaactgctgagaaaagggatgcaggaaaccccatggctttggaaggagtaagtgggaagggccggattttcagttaagtttaggatatgttgagttttaggtgcctgtggatagtcatgtatcatttatggtgacagtgccacagggaaggtatgtgtcaaacccctaataaatacccactgaattgaaaataattctttttccaagtgcgggttttctaacaggggccagccagacatttatgagctcaggcagatgaggaaagcatgatacctggatcacgtgtgctcacatctggaatacatgcgcaaattaacacagctgtggaggcaggagtacatatgtgtattagaaaaacaagccccacctgtagagcgctgcaagatgcctccagctggtcacaagtagctattgaacatgaatattttatcagtgccagagcagatagagggaaactgtatccattatattctcatcaccatcacatgtggttgaacgggcttccgactaaagaatctaaacatgtttaaaacatttttcacctccagtaaaactagcaagtcttgatttgtgttgttattgctcctgctagattcgtgaaatatttcagaggcaattgcatcttggaagtgtggtttggcaaattttcatccaaagcgtatgtttttgttttattttttaactagcggttcaaacgtggggaagttgacattttagagcaaatggtagaatatgtggggttattttctgttgctgtttcatttttaggttcaacttttcaaatatagagctggattaagtctcactagtagcagaaaacaaagtctgtttaagtaaatgtgttttcaggatggcccaactgtacagaaacttgcagatctcacgttctgatcactccatcaactgctgcttctttaaaatactcaagagtcacttacgatgtttaattggcatgtctgtctttcaaaatgaaaagctacagggtagcttgtgttaaccacacaacagctggttttggtcacttggtaggtgacaatccagtgaccacaaccaaggaggatttaacaagggattttatgccttgcaatgcggaagagcactggggaaagttcccgaaggggtgcctcccagaacacaaatgaaaacagggcttttactgggctggcgagctgagtcactgtatgtagaggtgtagtgaaggcagcacatgctcagtcaccgatcatgctgctacatacttgtacatacttactgtctatacattactcactcatgtataggcagtggtgaataagctcctccctgggcctggttagtagtatggtaatacagatagataaccgaagtacatttccaactcagacatctctggatccaaccagcttttgttttgccagggtcgggcttctttctgaaatttttgaaacaaaaaaaaccaaggtgtgacagttacaaggggctacttcttcacagtgcataccccaaaaccttgggaccctggagcatacccccaaaaccctgggaccttgggttagacttggacttttcctgttttcttgttactcagcaaccaccacaatgcctggtccgtggaaaatggtcaataaatatctgttggctggataaattaatccctaaatgtatgtattaggttgttgcaaaaaaaaaaaaaaaaaaaattagccgggcgtggtgtcgggtgcctgtagtcccagctactcgggaggctgaggcaggagaatggcgtgaacccgggaggcggagcttgcagtgagccgagatgacgccactgcactccagcctgggcgacagagcgggactccgtctcaaaaaaaaaagaaaaaaatagaaatggcaaggaataaaatttgccttcaatgtgcttatggtcttgggaggagtagagtaaaaaaaatccctaatttctattgatataatatcattggatagtgccatgatagaagaatgtcccatgtgcagtgagaatctagagagaaaataagtgattacacttaaagtagagagtcagggaagacttcctgggagaggtgacatttagactaaagcataaataatattgatttgtttgccaaatggaggaagcaaagaaggatcctgagtgaaagcatgatgtgtctgaggatttgcaagtcgatcatgaggttgcagcatacatcacatgggagagagttgctgactcttcaggagagcagatcatggtatgctaggacaatcagagtctccactagagcatatgaagggcttaacataagggagtgtcataattacatttatgtttggtcagagcactcaggcattggattggagaatggagttgagatgagaagcagtgaagcacttgctgtagccatcataaaaacctggatcatatcaatagatcgtcataacttggcttcaacaagaattcataaaaccaactcctctctatttcatagtttcatcattttatggaatatcaaaaacctaaagagaaagagaaataaaaataaactatatgaacttctccctgatgaagcattcagtcttgttttcctggatctcatgcatgttaaatacatatttagatctaagccactatatcaaggaagtgaaaaactcttattccttaaatatcaatatgtgcacaaattttcttatacccacataattttagtaaaactttggagaaaaaagtttccagagttctagggctttgttccatttttggaaacagtaattttagaactctctgctttgctttacttattcattttatctcccgctgggtttccttcttgatttctatacctttgtgtctgcattaattaatttttctttcatttattcacacatgcaaccattgtgtatttggtctatgtatcagttagggcaggctaattactctagcaaaccagcagttaacaagaaaccaatcccgttggcagggaactgcactgtgtgaagacattcagagatccaggctccatctatcctaaagcaagcaaacaggctttgagagggagacagagacagagacacagaaagacagagagaaaaagagagaggaagttcttggtgattagaaatttgtgtttctgtgcggtatgtgtatacacaggtggtatttttctatttggagggcttaatgtgtttttaggtgtttgtgggttaggagttagaagaaatagccaaaaaggaggtgtaattaaccctttatctctttctcttgatgggtaatgtggttacttcctttttgttagtttccccataatattatagtaaatacctgagtgtattatgtgtgtgtattttgattatttctctgcactgtgttcctagtagttaaattacttagtcaaaaagcatgaacactttaaaggctatcaaacatagttacattgtttttcagtaaaatatctgtacctttttctttagcatcgaggtatctatttaccagaccttcgtgagcaccgtgcagtttattttttaaaaatatttctcaactttatagtcagtatatttggctattaggataatttcaggatatttgaggaggaactttaagaccggcttataaattacagcacttataaaggaggaaaacatgtggaactcatgtctggtacacatgattctaggaactggtggtgtttggatggcagaagttacaaggaacgcaaaagcagggagcgtgagccaacaccagattgacctcaggcagctgatgctatcgaaggaaaaagggaggacttccatgcaactccagaaaacaaaaccaagacacctgcggtagattctggtttaacaaaagggagaattttctaaaaattttctatagatttggttacttcacaaagcattgagcaccccaggataaaagaatccaactgagagtggcagctttactcttattagagagaagatttctctattaaagacaaaatcaaagcgaaatcaccaacatcttactcatttacttattagacacaatcgtggagcaaatactctgcaccagctactgtgctaactccgttacctggattactcaaattcttacaataactctatatttatttcataattgctttatttagtaatattttaagtgctttttagacacctgctctatgcctgtcttgtgctaggcaccagggggcgtagcagcagaccaggaaaatgtagagtctgcccttacggagctgggagccttgcatgaaagactggcactgacgacacagtggcactgaatgaacgtgtgatcagaagctgagacagggctctaggggaaaaaggcaaagtgcagccaatcctcatagcaaaagagaccgaggaagcctagaagtggtgcttgagtggagagtagaaggatgggtggggggttaaccaggcacaagaggggagggacgggaagggaagtcacaaggtgagaagccctcagacaagcacctgcaattggagggtgcgtgcagctgagaagcagagccaggaggacagtgatagcacttgaggtcagagtggtcatcgggatccaagcctgctggatcttcctggccttaggaaacccagaggcttcatcctttggcaaggggaagcctatataccctgtaggcttaatgacggggagaagaatgtttgtaaaagatctcgctggctgctgaagagagaacatctggagttaactctccaatttcagactcccctgatgaaaactgttacttctgttctccactcccttatttgggcaaagcagtttattttctacccgaagcatatctactaatagaaatgactgagatattcattacgttaggaatgtaatgtaatgattcttagatggtgattcagatgattagttattggaccttcgatgcattttttattttaattttgagattggccgtccccaacgcctctgatgtgtgactttcattactggagatgttgtttctgatgttgctggcggtccctactgaaaaggatgcatgcatgaagactcaaggcaacagtgacttgcacccatttctaacaatgacttgcacccatttctcccgtatgggggtgcttgataagcactgagtggtgtaatttacaacagcttattggcttgatgccatcctatgaatccaccaaccatcatcttctctgaccctttaaaatgacttccctcacaccccctgccatgagatgatatgaagaactaacaacagataatttctatatcaccacattttattatcagcataattctatacagtaaatctgcagtgggtgacttagttttgctgatatgtggcctctagaatattgggaaaatagatacatggaaatttagggagcttgtatcttgcctctccaaccttttaaatttgctgcagaaagttggatatttgttgggtttttcttccttaagtaggcaaacttcagccccaggaggcaatgaagcaaactttaaatgtagccccaggtacttcaaagctggctgaaccatgtgtttgattgcatacaaaatgtgaattgagtagcacagaactgtcctcctagcaactttgtagcacaatgagatcagctgcaagaacggaataaattggagattggcttctgcagttccattcatttgcaaaaatttgcagacaattaagctgtccccctgcagtataggtagctccttttagccaggggctggagatttgttctctctgggaaaatgttaaagctgtgattatctagttatacctgaataaatggatcaaaggacctctccagccaagcacagacctccttgaaaaggtagtctccagcagcaaccctggggaggtttatagcaaagtgtttttagagcagatggttctggagttacagaggccaaagagctgaatgacttgggatgagtcttttacatcttttaacttcaggaaaacagccatggtggttctgccagcaagtcgttgaatggattaagtgagataatcatacaatgtgtttagcactgtgcctggcatgtaataaatactcaataaatggcagtattttctatggcagacttggtgaatccaggactaggatcccaggcaaatcttagggttataaaggttagaaggaaccaggttatgtcatcttgagtctagaatataagcttcaaactctccaaaggaataaccctcaggtccttgaactcaaacccgaagcatcacatctttgcgtgaagcctgcaaaggctcgctattgccttggaagcaaatccagtcttcttaccttgacttacaagactgtccataattgggctgggctgactgcatgagtctcacctttcactgttctcccttaattccctgcctgcctggaagacgtatttcagcttctgcaatgctttgccttgctaaaaatatctcctcttagcaaacaagtttgcccagaagttatgaaagtaggagagggaacaaagatgatagaggtttgtggtttgtttatgaggttttcactatttctccctatcactttttctattatgcaaagccagggtccaggagggcagaaagagggaatgaggacaaattatctggacactgtttgtctgtttgaatgtcagcgtatttaggagatcctccaacaggtggccagcccgggtcaagctgcgtctggccttgtgttcaggtgtgcaggaagtaggatcattcctctcaaatctcaccacttccttcagttggctgttagggaaggcttttatgcccttggctgggtgtgacggaaaggggcagggacagacaaaacttggagtgcggtcccagctgtagaatgccagtctggcagacataacaaaagtgagcacttcttcgcttttgggacaccttccccatttggtcttgacattgagcaccatgctttggcaggtgtcagaggttggctcccgggaaatagaccacgcaaccggggaggtgttatcagcatccatacctcacggggagggaggtcagggggatggggcggggaaggaggctgatggaggagttgctgactgcaggtagctggaggcctcagccttcctgggcagcagggatacgggcagggatgtcccctgagcatggtcccacctggaagccagggggctgaccttgacacactcctgaccagtcagtggatggcgctgcagccccttctgtttagtcttcacatcagcaatgaaagagggtgaagttcatggaaatattgtggggacatatcgcatggtttctgttcatgaaatgtccagaaaagacaaacatatacagccagtggctgtggtaaagtgggaatgactgctaatgggcatgaggtttcatttaagggtgatggagatgttctaaaattatatgtggtgaggattgcacaactctgtaaatttcctaacaatcactgtgttacacacttaaaacgggtgaatttcatggtacgtaaattatacctcaataatacttttaaaatactgcaggcgagaggggctccagccagagaaattgactccaactctccctttccacaaatcaaatgctcagatttgcattgtgggaggagcctgagtgttcactgcaggacaatgtaggttcttcagggagtgcagaccactttcacatgcagcttctcatttcgttctgataacctagaggacgggcaaatcatcgtaggacgatgagcgctgagctacagtgaatgtagcttgttatcttacgacagacctgggagaaggaggaaatccaactaatttatttacttttatccctttgagtctattctccacaaagcagctatgatctgttttattgcaactggactcctcagctcaaaacccttccagggctcactcctcatgcggagtaaaagccagggccctctccatggcctacgtgcctctccagggtctgacttcccttcaccaggtccagactgtctccttcacctcacagcgctcaccttgcccacgccagcagctgccacactgaagctccgccatgcccggtaggcttctgctgctggcagtgcctcctcctcctgcccccttggcccattcttcctccatcttccactgccatctcctcggtggaccgcttcttgcctccctgtctaaaacatcagcaccctctccccctgagcacttccagccctcctccctgctgatcttttttctcttgagccatatgtgttctctttccctttctgtggtttgccccctctctctacaattgaagcttcatgagggcacttgcttcttttaggcactgcaccatccgagatgcctagaattatacctggcagagagaaagggcttggttgatacgttttgaagaaatgaatgaaagaatgaatgaatgacttagttaatatgaatctattctctcgctccttctcacgttctttttctcttcctgccttcctgtttccctgggcctccaccctcccttcccaccctcaacccctcccctgcccctcactgtttcaggggtctcccctttatttctgatatgtgttctttggggcgagtgttgtggtgcttccagacagcgtgatacttgcttcccctgagattgggaaacagggaggaaagcaaatgaggttttaacctcaaatgccctaagacaggaagatgaagaccttgcttagctgcatgaaaccggagatctttgtgtagggatgacagtcctcctctaatagaatccagcatgcgtgaggctccctgaagacacaacactgcccctgtgatggaagcaaggctggatgaggctgcagcaggcctcggatgacctaggctaaagatgctgcggatcactgtccggagactgctgtggggggaatcccacaagtcacacatggtctggtgttggtggcggccccagaacctcactctcctctgcacacctctgcgtgcctacgtctgttcctgtgactgaggggattgtgttcagcacactggaagtgcgaagacgtgtggcatatgtccgtgggtctaggcagctgatgcatgtctgttgcatgtacatctgctcgtgagtgtgtgtgtatgtgtgtctatcagatggattctggtgtgtgtgtaaacccgcatgtgcataagtgtgtgcatttgatgtcacagagaacatttgacatctgcacgcgtctagtaaatctggaaagctggaaggggctgcgtgtctacatgtgtctgtgtttcagatctggccttaggccatccacagccgaattactcactcctgatacagactgagtggctcaccctcattttctcacttcctccgtcctggtgttaataagactcatccttcatttttctaccgtttctgcagttctttagagagtgcagaccactttcacatgcagcttctcatttcattctcataacctagaggacgggcacattatcctcctttacagatgagaaaatttccttcaacccctctgtgtcctgtctcgaggggagcagtattgggcctcttctctgaggctgatgtaactgctgattcctctcacacctcctgtgggcatctcctctgctctcttgcatcttcattcattctgtgtttctttcttcaccactgtgctttctttcctctgaccccttcttcctcaaggtcagccccattccttgtctcccatttaactgaagaacttctttccatagctctccttttcttctatgccagagtcctcactgtccatgtaatcgcctagcacacaccaaaagctgctctttctaaattcagccgtcatctgttcatggtcaagcctagcagcctccgtgattttggaggagacctctgccttgtgtaacgtggctgtgcactgttcctttttggaattctcctctctgtgcttctggtttttctgctacgctgactaaactttctgtggcctttgctgaaactcatcagatggttacgttcctcccttttcccttttccctcttcccataatctgggttgtgccattgtctccatgtcttgcagctactcttgtatatgagtgattgtgacatttgtctccctcctgaatgcaattcctcatgtcccctagaaatctctgcttcacgtccagcaggctcctcaacgtcaacaggtctactctagcactggtaccccaaaatgcctttttaaaagcctttgcccacttggtaatggcaacaccagaagtcaagagatcttattacctccctcctttacgctgatcttcagttctttcccatacactgctcttctgccttttgtaactgtctcttgaattgattacattatttttgtcaccaccatttttgtgttgtccttctctgagtttctggccacggattggcaccctcacaggcttcatgcatgaaatgacagatgcaagtacaccacacgcacaaacacagagagttgtcccgaagcagggtatatggatgtcagtcaaatcatgtatgatggttcttacacggtcccagtcatacagaaacatatggcagaacacacaaactcattagcacagactcgatcaaaggtgggtacagccacaaatatagaagtagacacttggccacaaacacatacttatagatatacacataaatcacaggcaaagatagaagcagagccacaggcccagaaacgcagagccatggataaatattcactgaagtttctcctaatgtcagacaaaaacttaagcatcagaagaagcaggatgtcctgacttcagtcgttccttaagatgcccaccgtgacgggcccagagagtcgacatgcacatggtgacttctctacaatcaatacctccagcagcccccgaaccctgtcccttccaggtactgtttttcccgaatcagagcttcctgcttcttttcttgggcactttagatccacggattaacacaattgtgccacttgccatacttctgggatgcgccgtaataatcaaggaaatggatgggcagctgtggagttgatgagctggtgagctgggaggacaccagaggtaggatggggatgggattcagggagctgaccactctggacacccgtgaggacagaaatatcacccatttgtgggtatgaaaacacaagaaagcaattcatgacactctatgcaaggttcattattgatgacacggtgtgctttgtcattactttggacacatttagacatacattgtcatcatgaactgaggcctatgtttgctctaggatgaagcccattcaccagtcctttacatctgcacaaagtttacgtctttttaaagtgtttctctagaccagctctcatctgaggctcaagatatttttttaataatgaatgatattcagatattacaaatatattttacgtatttcctatttttgccacccttaacaaaccaacagaatcttcatagatgttaaatatcagttttgtgtaaatacaacgcgctctaattttctttcttttttttttttttttctgagatggagtctcaccgtgtcacccaggctggagtacagtggcgcgatctcagctcactgcaacttccatctcccaggttcaagtgattctcctgcctcatcctcccgagtagctgggattacaggcaggtgccaccacacctagctaatttttgtatttttggtagagacggggtttcaccttgttggtcagcctggtctcgaactcctgacctcgtgatcctcccgcctcggcctcccaaagtgctgggattacaggcgtgatccgctgcgcccagccaatgctgtttctttgtttagtgttgggttcgttttgggtggttggcttttttgttcgttttgttatattattcttgctttttcttctgtcttatacagaatctagttttctttgcctgcatattgagtccttttcacttcctagagactaaagtgtctcttacttagtctctttcattgagattttaatattcttctgtgatcactatagtgtatacaaaatagaatgcattgaatatgatattctatattttcctacatagcttgtcttaaatattctctctgctagctaggtaaattggagcagtttgcatgcaacctctctgaactttcttcattgattaaggagggataagatttactttggaggtctgttggaaatatttgagggggctcatgccaagtgcccagcacattggccagcatacgcttgctgtatcattattatagtagtttagagtagtgatggtgagggcattggagtgatgatgatagtggtcggaacatggtcttcacagttgccttattggtcatagcctaggagtattgcctactaacaaacccaaatgtaactttgtccctgctatggaacatttaggatgttttccatttttgccccttataaatcatgtctcactaaacgtcttccttcatacagttttattcttcttttgaatgtaacgtttggatgggttcctagcagtaaaattactgagtgaagggatatgtgcattcataaagctctcgataaatgaatattgcctgattacttttcacaagggtgctatgaatttatactcccacccaaatcaagagaatggctatttatagatgctttcagagccttagcttatcttgtttcctgtttgaactttattacataaattttcctttaaaactgtcacacacacacacacacacacacacacacacacttttatggggccttggggccaaagatggaatgaaactatcatttatcacatgattttgataggaagctgttgttaggattgagatgcttgcttctgatgatgcagaagacagttttaattagtatgtggcattaaataagatcagtttgcatattggaaatgatattctttttcaattatctttcagtcctctgatcagatcaaagaggaagtctcagcttggtgctaacacgcctttaacaccgctctggcccctttttacctgtaagatgaagagctttccataggcaacagtttctagctcaaatttaatggtgtcattaggtctccagcatgtttatttttatgttttccttcttttatgtgaagtgatactaatgttttatttaaaatgatacaaagttttcattttgaacacatttaattaaaaatatgagttacgcatagagcaaacaccctgacagtgtcactccaataactgaacttgtgacatgctacttggagagtgcattccaacagttgccccactgatcatataataacaacacgtttcccttgacaatacactgaatacaagtctccataatgcctgacatagtttgggactttgtgattgtccctttatccctattcatttgtgagtgtaaggaccttgcagtggctcatgaagagagttgctttttattttttatttttaaaattttttttgaagactcttaacaaagtataaccattttgaaaatgcctatctattaccctagataaaaattacctagtatcggaagagtatctaaaaagatattcaaggggtacaagtgcaggcttcttacatgcacacactgtgtagtgggaagtgtggccttttagtgaacccatcacccaaagagtgaacgttgtacccaacaggtgatttttcagctctcaccctcctcccaccctcccactttccgaagtccccactgtctcttattccactctgtatgttcacaagtacccattgttgagctcccaccaaaaagtgaaaatatgcggcatttttctgtttgagttatttcctttggatcatgtcttccggcttcatccatgtggctgcaaaagacatgattttattctttttttaggcttgagtagtattttatggcatgtgcgtgtgtgtgtatgagtatgtgtgtgtgtatatatgtttttgtgtgtgtacacatctttatagatatgtttatatatacgtatagatatatttacatatatgtatagatacaaatatatatatatatatcccacattttctttttttcttttttgagactgattttcactcttgttgcccaggctggagtgcaatggcgcgatctcggctcactgcaacctctgactcttgggttcaagtgattctcctgcctcagcctcatgaatagctgggattacaggcatgcaccaccatgcccggctaattttgtatttttagtagagacgaggtttctccatgttggtcaggctggtctcaaactcccaacctcaggttatccaccctcctcagcctcccaaagggctgggattacaggcgtgagccactgcatctggccccacatttttttttatcctgtcttctgttgatggacacttaggttcattccatgtctttgctattgtgaatagtgctatgataaacacacaagtgcaggtattgttttgatataacgattccttttcctttgtgtatatacctggtagtgggattgctaggttgaatggtagttctgttttcagttctttgagaaatcatcatactgtttttcatagagtttgcactaatttacactcccaccaacagtatataagcattcttttttctcttcagcctcaccaatatttgttgtttaagactttttaatcatagccattctgactggtataagatgatatcgcattgtcgtttcaatttgcatttctctgatgattagtgatattgagcatttttcatatgtctgttggcccgtcgtacgtgtccttttgaagaatgtctgttcatgttgtttgccccactttcttttgtttgtttgtttgttctgagctggagtctcgttctgtcacccaggatggagttcagtggtgtaatcttggctcactgcactgtccgcctcctgggttcaagcaattctcctgcctcagcctccctagtagctgggattacaggtacctgccaccatgcctggctaatttttgtgtttttagttgagacctggtttcaccatgttggccaggctggtctcgaactcctgacctcaggagatcggcctgccctggcctcccaaagtgctgggattataggtgtgagccaccgcacccggcctacccacttttaattgggtcatttttgttgtttgagttccttgtaaattctggataatagtcctttgttgaatacatactttacaaatatttttcccattctctaggttatctgcttagtctgttgattgcttattttgctgtgcagaagcttttaagtttaattaaatttgaattgtccatttttttttttttttggtcatgtttgcttttgaggactaggccataaatcctttgccgaggccaatatctggaagagtttttcctagggtttcttctagaatttttatagttgcaggtcttatgtttaggtctttaatccatcttgagttaatttttgtatatggtgaaagctgtgggtccaatttcactcttaggtatatgattatccaattttccatatgggtgtttaggccaacaccatttattgaatagagcgtcatttccctatcatatatttttgccgactttcttgaagatcagttggttgtaggtatgtggctttagttctggattctctgttctgttccattaatctagatttataccagtaccatcctgttttggttactatagctttgtagtataatttgaagtcaggcaatatgatgcatctaacttagttcttttcacttaggatttgttataaaaccaattctttattggctgtaaatcaaataaaattttatatctaagcaagtcctccagattcctgaccaggtgagtaatccagtagcttggcagattaagaacagcaatatgcaagcaatgagggatgagtaaatcaagactgtcattgtgaatagaatgatttggaagttgggtgttcaaatagcttaatgatagttatagtgaataacaatgtcagctttagtattattctagtaatgtacttggtaatgctaatagggtttgatggaatacagtgaacactttccaaacagctgtatgctttcccaacaaaggaactctatctcggagcagactgatacatcatttcaatgggagattttaatcaatccttttgttttcccttttaggatatatttaaatttgcaagaacttctcctgtcccaagacaaaagaggtccattgtggtatctcccattttaattccagagaatcagagacagcctttcccaagagatgttggcaaggtaagtcagacaaacagcaaatgacaaaaacatgtttttatgaaaagatgagcacagcagactgagtatgactgtcttggtgaccagctggaattagtcttcatctgtctatgataagagaccaaatggtttagtcatgaaaagaatgttggaagatcattcatatgcaaaagaggaaattggaaaaaaccaatagcagctttgaatattacgggatcaacatggtagatgatgttgaaattaagcaggaagatgtcaatggttaagaaacaaggctcattgcttttatagattatattcaggtgatcaccagatagggccccctaggatggtagtatgttgacatgtggccttcactgagatcctgtttttcaaatatttaggtctacgcgtaccactgggtcggttttccaaaaactaaaccagatcaagggaataaaatcatactaatcatatccagaatcggatatggaaaacactgtcccatgaatcagaacaatagcttttccaggaagaaatagtcactgttaaatgtgccaaaatacggatactgcctcatcagtacattctcccctctttaagagagtcaacatggagaatcaaattttgagcagtttgtactttttggttgttagaaacaagtgctcagtgccgcaaaggagaaccagcactcaggaaaagagttttctcagcaaggcaatttacttctgcggaagggtgctgcttgtacttctggccactgggagagcacaccaaacaaaagagggaaggggtttttatccctcacgtggttagtccctgcttctgtgtcctgtccccattggctggagttggattgcacaatctaagctgacctgattggctactgtttaaaattgaatatggctaattaggcaggaagggagaggctgtctgttatggtacaaggcatgtttgggcatgtcagggcacggcaaaggcgggaagggtagtttcattgggaagagctgttttggctggaggggcagtttacagaatgggtagccaggattaaagaggactctttccaaataagaaagagatgtgagtcacagattgggactaatgggagaagttgtttatagagcaggtagcttaggagaagggacaaggaagttgatctcgagaacaaagaacaagggagtcagaaattaaacgtttgaaaaggaacttactgtatcagacattggtgagcctggaattcgaaaaatggtggttggttaaatgaatgatcttaatggcagttgctgttgaactactaattcattaaatacacagtacatgtgatatgctggactccaagctttggactgggtgtgaagaagcagataataaagctaacatgctagtgggaagacagaaacaagaacattgcagagtatgacaaatgctgtgaaaatcagcaatgggatgatgtgaaaaaaagagcaaatggcaggatgaaggagtagagggaggagggaatcttcacgcagatggctgtgatggctggttggaggtactgatatttgaggggagactggaagggtgagaaaggaacagttacaggtatatctggttgaacagcatctttggcagaggtgagtctacattgcaaaggcctgaagatgggaaagaatagcatgtagtagagtcgcaacatgcctgggttgcatgagagtaagcaaggatgacagtggtaaaagtgaaatcagagaggccagcctgcccttggatgaggagttggggtttcatcgtgcatgcagcaggggaccactggaagatttccccagaagactgcatgttttgaaagatcatcctggctgccttgtagagaatgattagtggtagcagagcagtagagaggagtggaagcaaagagacccactaagaggggagtttggtggtgatctgaacaaaggtgacttggactattgaaaattgatcttggacgggcatggtggttcacgcctgtaatcccagcactgtgggacgctgaggcgggaggatcacccgaggtcaggagttcaagaccatcctggccaacgtggcgaaaccccgtctcaactaaaaatacaaaaattagccagtgtcatggcacgcctgtaatcccagctacttgggaagctgaggcaagagaaccacttgaacccaggaggtggaggttgcagtgagccgggatcatgccagtgtactccagcatgggcgacagggtgagactctgtgtcaaacaaacacacaaacaaaaaatcgatctttattgcaaattgaaagaagtgctaatccaatatcctggtaatcattatatttatcattttaaactcccactgtgccaaagatacctttctctaagcaaaaatctttttaagagtctgggacatgatacaaagggaagcagagctgctctaaagggatagccctgtccccttgggcagccctagccactgtgatgatccttttctagacaggtttcctgggagcccaagatgccagatgccaagggacctgactccccacttcttcaaaactcttcccaaacagtttctgagactcaagatgcattctcgtttttcagttttcttttagataatcctgggcttctcagctctcaccatgcatcagaatcagcagagacacttaaaatgcagatgtcagggctccaccctcagagattgattccactggggtgggggtgaggaccatgcatcaatatatgttaaaatatccgaggtgattcagatatgcagccgaggtggaggactgccggtcttaagcagtcctccaagagtggttgtggaccagctacattagcatcgcctgggagcttgctagaaatgcatattttcatgtcccaccccaaaaccactgagccaaaaactctggggttaaagccaggaatctgcgtttttacacagcttctaggtgattgtgatgcacactcaaatttacagagggctgacctgaaatgcactttctcctcctgtccaccactagtacacaatactttcagttgcaattccattaattaggttataataaggacaatcacatttcagttgcctggaaaatcccagtttacacctgtcgtccaaatctgtcatgtccagatttagacaataaattatgtagccatcctatagttttcttcaattacacacaatttcctccggggtatatttgggtgaattttctcacaagcctcttttcttgagctattcaatgggtccataagcatgcagctaattgggaacattcttctgcattgtttttttacttattacagcttcaaaaagcaatttggtttgcaagctgaggactcacttcttcttagccccttatgtgttgcccatacttgttctcaacttagattctctacaaagcaactgcttttctaagtgtggtaggctactaactagacaatgcgcaagagccttcaaaacctctagatgttttttgtagaattactgcactgctttgcaaaaactatttatttgtccctgctttttatgcctttgaaggtacgtattttcctttttgttcctgcttgtttctatttatctgtcttactctttatatctcctgtcttatcctcatcaactccaccacagctgacgagctgtgctctgcagagctgtggaagaggacgtaggtgttttcagtgagtgctggggaggcagggagaagggaaggaagaccacagaggcagagctctggcctccaaacaccaccacgctcccaaaaaatgtctaagtcaggacacctctaattttataaatattacgtattagacttcgatatagaatgccatttgaagaagagattctgcagctctaaaagtataaagacgtttgtctttggcttcccctagaagtggaccgcaagacaagaattcaaatgaaggcagttcatttcagaggtggaggaaatatttgtaataaagtaagggagagacgtggagaagggaaggcagctaggagagaagcttgtttatgaagccagctacccctgtgggtgactggattgtaatgtcaggggctaactttaacatggtgtggaacacactgtcagcgttacaccacccccaggggatggcactgggatactttgacaccagctggggtatttctactcccagcagtcactggtggagggccgcttccaggggtgtaaattccctggcatatctggtctgccctgcactctgtgcactgacgcgacagcctgctgaggtttggaggagaaccttagacaaaaaggattctgtacagcagccaccagtctgctggtctgcactgaaaagctgacacatagaggatgtggacagggcactgatcccttctgcttcatcaccaaaactaatatatctatattattttttgcatacttcatttcatcctctgcttttacctcatttcctgaactagcattctcatgtcctgggcttttgaaaccccctgtacttgcctctctctctccattaataagtagttcctgcatcccaggagggaaaacctctgaaattcaacctaattcatatcaacaagcatatattcagcatctgtttttataaggaactgtgctaggggctgggaatttaatggaggagaaaacagacagaatcattgatcttgcgggattacaaaagaggtgacaatatcagcacatagtcattatttgtccagcactgtgctaagcacttttcatctattatgttgaattcttatgataacaaccacatgaggatcattttccagcatgccaatgaaggtaatgagactcaggggtgacgtaacctgtccaaagccacacagctagttcataacagagccaagctttgttactgctttttgagatttcaaagtctgtgctcttaaccagtatcctcaggaaatactaagcccaatctgagaatactcttccgtggaatgaaatatcttcactgacaatttctctttttaaaacagcattaaaattgagtgcaattcttggcaatgcactcaaaaataaggtggacagagggttggatcaatagatcgatatctgatatgtgataaaggaagtatattaaaatgttagtggtagaatataagttggtgaacatatgggtacttgctgtacaattctttcgagttttctctgcatttggaagttttgtaataaaatgttgggaaaaattaagtttaactaaatataaaattatcataaaagacacaggagttagcatgctggcacaaaaacgccttttaaatcatttgtcttgcatttcaagagggtgaatggagacaaagtacgtaactggttcttgatttttttggtcatattttattacaacctgaattcctgtaaagaaaggagactcatatcctgaagaatgaagacatcaaaagcaaggtgctgtggcaagttagcccttggtggagggtttttcacaactggatatcctgctgtgtagaactgaatacccacagcagggttattcaggcagctccagggatgagagaaagtgtcttgactgatacataatttatctgtctgccaagtaattagttggttggtaagtagctaaactactagaatttgggatctgcttttccgtaatacgagggaatcatattacaaccctgagattccaaatcactgctactcacttagatagcaggtggggagtataagggggtgtatgacccccccccccccccccccgcccacagacacacacaggagacaacccgagagatcactgccagccctgggaaaatgagtttgcctcctaatttctggctcttttccatggtgcattctgccctagactatctgtcatagttttggaagacaaggtaaaacacccagtcgtgaacatacttgctcatacctgtgattttctttccatttttgaactctagacagcagggaggagctgacagtgagtgctctggagaggaacatgcagatcccaaagtggctttttcccctcccccttcaaagtatgactatttcaaaatttgggccataaataatttctcagttttaccaactttcactgataactaattgattgcatctttaaagatttttgagttcttgggcccgattgattgagagcaggggactttaaatctgtaagccagcagggaggtctttgggagatgtattttattctgttttatattaagtttgaaagacaagtcatttatgaaatgcttattagagattctgctttcatcacaaacccttttcatcaaaaccaatgaaagtacttttttacagaaaatcctgttttaaagaccctataaattggtagaatgggcatttagaaggccatctttaacccaggatagaagaaatatgtaactgggccaagtgctgtttgtaaagggaatcaacattgatcattagactaaatcatgaaaaccactcaaccaggactccgctttgattgtgtcatgaacgtaagtcagacatgacggtaatttacatcagctttgccatgttcctcagtgttctgtgcatctgattcttagaggtctcactgcatccagatactctgtacctgagatttatgcccacctatgcgaataggtgccaaggagtctgatagtcttggaatttaatttgttttattctatttaatagccatttgcctcactttgaagacccacgaagaccaagctatatccttagaggctgaaccagaaagctggtactgaagccccagcacctctccatcacccctctcctgaaatgcagactcagggttacttgctgttgcctgattgattttatgatcaggcacttactgggttgtctagggtaacccagtaattgctgtcatccctctacctcttttaaaatctattgttttgtgccctttatctatgtctaactatatacacttttctcagaaatttacatctgcttaatttctaccccccacccaccccccaacacccccccctttttttttttttgagacagagtctttctctgtcaccaggctggagtgcattggtgcaatctctgctcactgcaacgtccgcctcccagcttcaagcaattctcctgctcagcctccctaactgggactacaggtggatgccaccacgcccagctaatttttgtatttttttagtagagacagggtttcaccatgttggccagactcatctggatccatctgcctcggcctcccaaagggtggggattacaagcatgagcacctggccttaatttcccccttttaaggcaactagcagttttattcaataactgaaacttaccataggctagagtataggagaaaaattggaatacagagtatctaagatgcctaaaggctcagtgctcaaaaattcttcttgagatgaacatcacagtttatttctacattcagcagccatagctacacataagcctttcctatttccaagtctttgaactgtcagttcttcctgggatacaccctctgtatccttattccttaggagcagcccacattcacactctaaggctgcactgtcccatggaacattgacattattgcaggaagttctgcctctacacagcccaatatggtacccactaaccacatgtggtcaatgcagttataaagtctttactaattttaattggggctcaaaaagtaacacttcattccattattgggacaacttggcagttgaatgtacctttttcctgatacattttaatctatttacagataaaatattttttactgaaaacgcaatgtccacactgagatgttttgtaagcgtaaaatacacattggatttcaaaagcttatcacacgaacacaaaaagaatggaaaatgtctccttaataatctttgtattgatttcatttggaaacaaatcccttgtatttcttttcactttttttttaacgtggctgccagaaaagtattaaattattaatatggctcacgtatttttatcagatggtgctaatgtaaataaggcctatttttgatacagtctctcctcagtggaattatgtttttgagacagagtcttgctctgtcacccacactggaatgcagtggcgtgatctgtgctcactgcaacctctgcctccggggttcaagagattctcatgcctcagcctccctaatagctgagattacaggtatgcaccaccatgcctggccaacttttgtatttttggtagagatgggggttcaccatattggtcaggctggtctcaaactcctggcctcaagtgatccacctgcctcggctgcccaaagtgctgggattacaggtgtgacccactgagcccggcccatggaattttacttgatctcttttatacattgtttatacatctttgatggcacttaacacattttgagagacaatgtccttccctgccttcccactaactgtaattcatcagatgcggtggcccaggacagggcctaacacagagtagcgactcaaatattctctgaattgaattctagccatatgtatggctgattaacatagacattcactgcttactgattaattaaagtgatcatagcctgctttgttgttagaatggaattaatagaccattatatgatcagtctggatatttccagcaaattttaattttctaaattggtaatgaggccaccagataaattgcttggcagtcaactattatgtcaggtcatataagcattcttagtagatttgttttttttctttgagacagagtctcgctctgtcgcccgggctggagtgcagtggcacaatcttggctcactgcaacctctgcctcccaggttcaagcagttctgcctcagcttcccaagtaactgggattacaggcgcccgccaccatgcccagttaatttttgtatttttaggagagatgagctttcaccatgttagccaggctgctctggaactcctgacctcaggtgatccacctgcctcggcctcccaaagtgctgggattacaggcatgagatgctgtgcccagccagtagatcttgatagatttgatgttgatggattttatgtggggatggggtggggggagagagagagagagagagagagagagagagagagagagagagagagagtgagttacatgactgtatttctgaatttgcctatgtatatgatggtgttttaattccaattaaatgaaaacactcataacttttatcttttttcacaactgaacacagtcaattctaacttatttttgctaagtctaataaaagctatgttcaccattcgcaagtgttgccctcctgcaaattttaattaatgacaaaacataatcgggtggttttggctttttgccaaatacatatatatgcaaaacttccctccatgatctacatcccgcaaataaaggcatctgagcccaaggaggaagcaatatttttaaccctgagtttatcaccctttcggttctccattttaaaggttcctagaactttattgttattatgaacatctggcctcagactgaatttatatttaattatttgtgaacattcaaggaccaggcatttcagcttgaattagcatccagactcagggttgttgaagaattttcaaattggactagaatgttcactacctaatgaatgtctggatctaagccaaacatggctaaccctactgtcctgcttagtttttacaacagccctataaagtaggcaatcctacactcatttctcagatgagaaagtggaaattaagagagattaagtaacttgcccagggtaaccctcttaaagaacggcaatgctgagacccaaaaccaagactcttcaatgccacatcagtgatctgtccaccacaacgtgtgtgaatgcttaaagcttccatgggtctttgctgtttgcatagcacactcacacaaatggtcatttgactctcataagtaccctcagaaatcaatattatgtccccattgtacagtggaggctctgaactgagcatgaccaaggtgcagaagcatcttgcaaaacagtctatttgtggtacaaactgagttgcctttctgtgtcacctgcaattgtaccagggctctggatggattttaaaatagcacatggcatgagttaagccactatggaaaacagtgtggagattcctgaaagaactaaaactagaactaccatttgatccagcaatcccactactgggtatctacccagaggaaaagaagtcattatatgaaaaagatacttgcacacacacgtttatagcagcacaactcacaattgcaaaatcatgtaaccaaatgcccatcaatccacaagtggataaagaaactgtgacatatgtatatatgatggaatactactcagccatccaaaggaatgaattaatggcatttgcagcaacctggatgagattggagactattattctaagtgaagtaactcaggaatggaaaaccaaacatcatatgtccccactgacatgtgggagctaagctatgaggacgcaaaagcataggcatgatacaacggactttggggactgggaggaaaggatgggagaggggagagggataaaagactgtaaacaggatgccgtgtattctgatcgggtgatgggtgcaccaaaatctcacatatcaccactaaagaacttattcatgtaaccaaacaccacctgtaccccaacaacctatagaaattaaaaaaaaaaaaaaagaaatagactttgtctgggcacggtggctcatgcctgtaatcccagcactttgggaggccgaggcaggcggatcatgaggtcaggagatcgagaccatcctggctaacatggtgaaaccctgtctctactaaaaaatacaacaaaaattagccgggcgtagtggtgtgcgcctgtagtcccagctactcgggaggctgaggcaggagaatggcgtgaacccaggaggcagagtttgtagtgagccgagatcgctccactgcactccagcctgggcgacagagcgggactctgtctccaaaaaaaaaaaaaaaaaaaaagaaatagacttcactagaggaaggagaaacatacaagccaggggtgagccaaggatgagaagcatagctcaccatccccctcattccacagggaggtctgccaggggagaaactgggctctcatagctgttccttctctgccggacagcttcagtacaatcttgttagtggacagacgatcaaacaccagggatgttccgcagcctgaatgcagacagcttcagtacaatcttgttagtgggtagatgatcaaacaccagggatgttccgcagcctgaatgcaggttcccagattcgtaggagtggtctgagattccaaagttcaaagtcagatgctttgggtagggatgtgctggaaaactggctctcggaggctggaagccttgagttggagtgtttgcagctactttggcataaattctcccacagcggccagtttcaagctagcagcttacaaaatctctgaatgtttaacaatggacttccatgaaggagtagggttgacttcagcacggcactggccttgggactcagggaccgtgacactggaaggggtcagggggcacatgggtcccaggggagctacgcttgagtgaagccctccattgtggagaagtggcttccacacccacctgttcaccccgggttgcagctggtctcatgcccagtttagcagtgaggatcattttttgacaactctgcctgttgcaggtgttaagtaacttgtccaacttcatgcagcaagtgcaacataaaagcaaagctccaccactcttctccttggcacagaaaaatccaagtcactctcctaaggctggaaaattctgcagcaattgtcccagttctacctggaaaatgaggaagggagtgataaaattctctgtgaagtgaggagaaatgaggttaacctcgccaacatttatttgatgtgcgtgtttgtgcgctgagtcagggccggaggtcgtgtcttcgtttaacaaatagaccacatgttgacaagcaaaaaacggctttctttgtctggcaagaaaagccactgcctcgcttcagacaacgcttttttttgttggtgtctccgctgacaaccctgttcaaagagagccacaaggaatgaaagtgaaagcagaaaaagccaacttcggtgtaattaagagatatcactgcccgtttttctcagtgatgaggccgcagctgactcagtcgataagggccgtgaaggagtggggcccagggcgcagtggggatggactggccttttcacggtccaattactggtccaattactagtccaagttttgaagaggattgaagtagaactggatggagatgggaaagagaccaataaagtgttttttgttttttaggttttttttttaagaggggaggaatgaatgaagaacttcttttattttcttttccggcttggagctagctctggttcccaaatagggtcctgggggaaagacgtgatgtgagtctgggtggctgggaacagtccctcctgggtatctgcgcttggcccacttctgcaaccagtaatggaggagacagaagaacgcttgaatgtgggtttaattgttcccatctgtgagtgttgcattaaagatgttgctgtcttctgttgcatcgggtggtttgggacaagtgatgaagaaagagagtcagttgatgcctcttgagcaggcatacactctccctaggctgaaaattgagctgcattaattcagaaatatttactgagcaactactatgtgtcaagcactgcactggctactgcttatggattcccccgagaagaatgcccgtcctaggagagggggcagacctgtaaacaggcagacaagcgctgtgatggggtgctgtgggatcttggaaaaatcgagaaggcagaagaagtaattccgaagaggactcctgaaggacgcctaagagcaggcaacgcgaagctgagatgggaagaaagcgctctccaggcagtgggaagaacatgatccagtatctacgggcgagagggacggtggtctgtccagagaggtgagaataattcaaagtggctgtgatgcaaggaggaaattgtcacaaataaacttggagaaatcatcaaaggctggaagaggaaaaattgtaaaaactactgtatggaatttggacctttttctacggatgactaagtgttatacattggggaatcacacgatcagatttgcatttcaggaagtttagtcctgttacgctgggtaacacctgaaggctgagaaaaccaggagcaggggtgacaaagagggaggctgtgacagaaatccaggagggtgacgaagggctcccgggcaggggagaggcagaaggactggaaagagggcacagtgaagggccatggtgggggataccaggcaacactggcaagcaagtggacagtgatgagtgaggaggtagaggaaggtcccctcttagctgggacattatgcctctataggacgctgaacaaagtaacctgcggaggtgttactttgtgggaatgtagactgtgaaactgaaggaactgttttatccacctccccgtagtttgctctgtgctgaggctgctgtactgctcctctttgaaataaaagagaactcttcccagaggtgacagatccacctgcgtgctgtatgttgcatggaggtgggcgaacaggttatgtggagggttgttcttggaaagacggattcattttgcaccagtgacaggcttgagggaacaccagcgtgtcacacgtctcttcccagtgtccctgactcatccatgcctagggattttactttagtccttccttgctgtgaatttgaaaacttttattttatttttttctactagctaagaaatgtgtaacagctgtgttcactgttggccttctagcctcaaatttattttaaatacatttcttcttagtgatctcttctttgaatgctgatgttggctatgcattagtttacacaattcacaggctctgtgttgctcaatttttagttcatttatttgacaacttgaaattcatcacaagtggtgcttttattttgttatttgcatctggaaatcattcctaacatgccatgaaatacatctgttttttccttttgcaaatcacttttttttcttattataagagtaatatgtgtttattgtagaaattttagagaaaaatacacattgaaaaataataatataaaaatatccggccaggcgcagtggttcatgcctgtaatcccagcactttgggaggccgaccgggtggatcacctgaggtcgggagtttgagaccaccctgaccaacatggagaaaccccatctctactaaaaatacaaaattagttaggcatggtggtgcatgcctgtaagcccagctactctggaggctgaggcaggagaattgcttgaacccaggaggcagaagttgtggtgagccaagatcataccattacactccagcctgggcaacaagagcaaaactccatctataaataaataaatatccctgagtcccaccattggggataaccgctgtagacatccgagggttttacctctctatttttaaagtgcgtatacattcataaagacacagcatcaggctgtaccaccagaggtttagatcccataggtctggggtgacacctaacagttaacattccaacaagcctcctggcactgctgacaagcccagctccatggccggcccacactttgaggagctccacttctaatcatacctattcctacacatgaccatcttgtgctcatgcattttccacttgccaatgtctcagaaaccttcttcatgtccttcatcaacacgtggtatggcagaccattgctatggccaacactgagtttcagggcttctaatgtgggatctactgcctctgcagggacccacagataggtctgttcactttctcatctgatgtatcttttttcttttttttgagatggagtcgtgctcttcttgcccaggctggagtgcagtggtgtgatcttggctcactacaacctcgctgtctcaggttcaagtgattttcctgcctcagcccccagggtagctgggattacaggcgcctgccaccatgccctggctaatttttgtacttttagtagagaaggggttttgccatgttggccaggcttgtctcgaactcctgacctcaggtgatccacccgcctgggcctccaaaagtgctgggattacaggtgcgagccgctgcacccggccgatctgatgtatcttaaggcatagagcatgacataaaatgactgaagagcacctcacgatttttgtttcttacccttgtttctccctcctgggaacggactgacccaaggtttaaggcaccaagaatgcccagcaatgtatttttttcccagataaaggaagatctgccacatgaaaaatgaccagttatcttggtctattgatgcacaattgctaaacagacaattttcacatccattctcatttgaagttcccaatgaaccagagtcactgaagtatccactatttcccttcctgttgcagaggaatccaccttgaagctatgaatacttttttgttgtatttatatttatcaacacttatatcttctccctctcctgattcagtgagatcagagaatattaaagccggaggggctctggaggtggcctgctccaaatacctcacttgatagataagacacaaaatgatttttctgggatcacaagatgggaacagtccttaataaatctctactccctcactctggtgcccttttgcctacacccagtattctgagccttcattgtcctaggaatggctgccctgagcctggggatgtcccagggtttttaggagcctcagcataagcttgacataattgatgtcagcatgttcacaatctctataggatcatttctactgagactaatcttattctttatattttcatttctcttcgcagtgttcttagaggttgattttttgtttgtttgtttgtttttactttaagttctgggatacatgtgcagaatgtgcaggtttgttacataggtatacatgtgccatggtggcttgctgcacctatcaacccatcatctacgttttaagccccgtgtgcattaggtatttgtcctaatgctctctctccttttgtccccaacccccaacaggccccagtgtgtgatgttcccctccctgtgtccatgtgttctcattgttcagctcccacttacaagtgagaatatgcggcatttggttttctgttctgtcttagtttgctgagaatgatggcttccagctttatccatgtccctgcaaaggacatgaattcattcttttttatggctgcatagtattccatgtgcatatgtgctttcactttaggagctcaactagcaactcccccatgcactccctcctccagtgtcagagcacactgcaggacccacccagtctttgaataggaaagcactggctgaaaagccccagaaagtggggatgtaccagtacaagtttcccacctgtgtatcccactgttttgtttggggagaacaacggatataaccgaaacgggctatctggtgagcataagttctacattaagttgtccctgtgcctgaaccatttttgtttgtttgtttttgtttttttttttttttttttgaaatggagtctcatcctatcacccagctaaagtgcagtggtgtaatctcagctcaccacagcctccgccttctgggttccagccattctcctgtctcagcctcctgagtggctggaactacaggtgtgtgcccccacacctggctaagttttttattttttagcagaggtggggttttgccatgttggccaggctggtctcgaatttctgtcctcaggacccacctgggcctcccaaagtgcttagatgacaggtgtgagccacagtgcctggttgccttgggccattcttcatccagctgcctcctactcatcccttgggtctgaggttgaacgttacctcctcggggaagctttcctcaattccccaaactgaatcaggtccttcctcatgtgtagccgttcgcctagtccttctccagagcactgatcacaccagtgattaattaagtatttgttcaattgattatgcagcaaaccccaagatagcagaatctcagtttttcttatttacccttttatcttcagcatctaggatatgtctggtggactaggctctcaataaatattttttgactgaatgaatggtcaaaaaaggccaactccagtggtctctctacaaggtgataaaagagtaaaggggccgggcgcagtggcttatacctggaatcccagccctttgggaggccgaggcgggcagatcacctgaggttgggagttcaaagaccagcctgacccacatgaagaaaccccgtatgtactgaaaatacaaaattagctgggtgtgatggcacatgcctgtcatcccagctactcaggaaggctgaggcaggaaaatcgcttgaacccgggaggcggaggttgccataagccaagatcgtgccgttgcgctccagcctgggcaacaagagtgaaactccacctcaaaaaataaaaaagagttaagggcaggctgtcttggacacatctctacccctatcttacatgcagaacgaatggtattaattttgtgatgaataaaaaatattttttctttggatatattttaaacttggatatagttcacatattataaaattgagtatatttgatccaatatgtcaagtaccattaaatggataaaatgataaatttggtagaagaaaaaatatttaggaaagtctcagaaatttaaatgtaataaatgaatatgtattcatatacatactataaaactcattatgtaacatattacataaagcacattttgtgttgaggagtgagttccctgtatttagcttcatggaaaaaatagtttcttgtagataaatattacaggtgactgaactaaaaatattttgacaatgtgaactacttggatagcaatattttgagttgttttatacactagttccttatcttaaacagaagttaacatactcatttatcaatggagaggtggcatttatcattaggaccatcaaaacaattgtgttaaaatctcagggacaagaatgagtgcagggattgtaagctcctctgctgggtgcttcgttctgctcttctatacaacctgctctgcatcctcttgagtgctttttaaacttccctcgtctcctccttcgtttccaggctttctcacccactactcctctttgccgttcctctgcctgactctattaagataaactaatccttggaatttgctgctttgaagttgatgtcggctgggaaactcatacacaggcgtgtcccagtcctgtggtctagaatcaacatagtgagacgagacagaaggctggtggttgctgctctgctggttaccagctgtttaaccctcggataggtcacactgaaaacccctgggccctgtttgttcttgtatgagataaggctagtaacactcacattccacgtttggggaaggataaaatgaaatcgcctgattggtcatacttgacccacagctagtgcttggtcaacgtgccccttccttctttctctccctacctggagagcctacagatgtggtaagtgattctgaaggtttctcccatgaggaagtgacacaggcttgtacttatttggatagtcaaggcaccttttgttcctgcggttgacactcttccaaatagttgaagttacgtgtaagtgaacaccacctaaccaatatgctactgtatttataaaggatgctaacttgaattagctttgcccaagcagaatattttaaaaaataaaaataaataagaagcagtagtccattctacctgtctgccaatttctatgttctagttaaggacatgggaacacatgatcagcaatacatgatcagatataatcaccacgagacaaggtgtgttaacaactttacgttcagggcctggaacataatagatgcactgtattttttgactaaataaatagctattcctggaggtgtgatgattatactatgcccagatcctgccaaaggcaaaaaggcaaaaagttatattcagaccagctatctctctatttttttccctgctcagggctaaatttttccgaaaaaatcacataagagtccaactgtcagaatgagttcatcacctgggctggggatcccagattctgtgagcagaagacttcatccacccaggtgtctatttcaagaacagtctcctcttttgcaaaagcgttcatggaaatggccttctctcctaacagacagcagctacagagcctcctttccctgggctgcagagggtaggttaatggagactgaggagccctctggagaacagcaaaaggaacacgatttcacccttcttagcatcctggggcttgtgatacagatggcccatgttgcaaatggagacgccgtggctatgttgccacttgcccttgcagacacaagtacggggacattatattcaattttgggtctccatccatatgctgctcctccaatttatttgtctacatgaagggatatgaagcccaaagccagaggacatccaattcggctttaattacagtgatgagctgtttgtcagggtgccatgagctgcaacgccaccttggtcgctgacaaactcggagcaggggtgacaccaactcccctgttggctgctgatcattgaggcttgggcagcagcagcacttagttcaatatttgttgtttgaaacccaacagttatgactctgccaagcttaatgaaagggagaaaataattatcagagagcttatgcaattttgaagaccaggggcttttaaacaaagttaccatgccagaagtgttcttggcatgtcatgaggactgttgccgttattagcgatgacaatgcagtcattatttttacactggcttaattgttcagcagacaccaaggaccgtgtcaacacagttctgcaaatggaaacaaacacgccatcattcagggtcccactttgatattctgcctttgcacttgtttcattttttctttgaagaacattctatagatcgaaggaattattccagacctctgattcatgctaggcttattctcttcctcattcagtctctcaatcaatcaatacttactgagtacttgtcattgcaagacctgaggaatagaggggctagcagaccagcctgggttctgcccttattggaatctttcaccttctactgcagaaggtcccacctttaggtagaatgatcagagatctctctgaggatgtcacatttaaactgtgactctaaggatgaaaagaagccagatttgtaactaatgaaaggatgttccagccggatgctggaactttgggaggccgaggcgggtggattacctgaggtcgggagttcgggaccaacctggccaacttggtgaaaccccatctctgctaaaaacacaaaaaattagccagacatggtggcagcacctgtaattccagctactcagaaggctggggcaggagaatcgcttgaacctgggaggcagaagttacagtgagccaagattgtgccactgcactccagcctgggcgacagagcaagactctgtctcaaaaaaaaaaaaaaaaagaaaagaaaaggaaggagggaaggaaggcaggaagaaaggaaagaagaatggacatttcaggtggagggatagcaactgcagaggccctggtagttgaagacattatgtctagataactccatcaccatggcttatgccatgtaggggtttgtctgtctcacatagcaagaaacctaaaagtaggcaaaagtttaccagtgcagccatgtcaggaccagcatctctgcaatttgtttggtcttcccttatggttacaagctgcctgcagcagctcaggccatcctatctaaggctggggcaggagtaacaggaaggttttaagctaactatatctgtcattttttgtttgttctatttcaagaaagcaagatattttccagaaactttgagcagttatatgtgtatgtcacgttaaccagaatggtattcaacaggcatccctaactgcagcagcagctggagaagtaagatttagttgcaaataccaataattcaagcacaattggagtttggttatcaaaggacaaaataggccatagatatttcaaaaaaaatggtatgttcaaagtattattttaaaaaggccagggatggggccaagcatggtggctcacgcctgtaattccagcagtttggaaggccaaggcagacagattccttgaggtcaggagttcgaagttagcctagtcaacatggtgaaaccctgtctctactaaaaatacaaaaattagcctggtgtggtggcacacacttgtaatctcagctacccagcaggctgaggcaggaaaattgcttgaactcaagaggtggaggctacagtgagatgagatcacgccgctgtactctggcctgggcaacagagtgagactccatcttaaaaaaaaagcccatggaggctgcactccaaaggtggagcgatagcatagtgtaacatgatttttgagatgtgtgaagaggtcaaatccacagaaactgagggccgtgatcagacatcaccaactgtagtcaaccacatgttaaagttgaattgttccgtcttctgttttccacatccaccttcttccgtccaccctttcctgaaggtccgtgtgaggcctgaccttgctttgattcttgcagtcctcttctaactgtgcccctttgcctccacttcctgcctgcacccttgcatctcctatctgtgacttttaaagaaagtaaatctcaacattcctcagggctccctatgacgtaaattccaagcttctctgtgtgacctcaagtcatttctgatctggtgccttatcctgcagccacagcccctgccacttcctcctttcacgactatcttatcacagctgtcctgttatttgtgattctcccaacatccctcaggaacatttgccttccttgaagtcctttttcttcgggtcctttccagagtcagagtgggcttttcttgacatccttatgggaaagggacaactcattcctttgcctttccaccccacttgcgttccacccctaggttgctacacattcccctagagggcttttgtttgtccacctgagtatcttcttcccactggtctctggggtcacagggggcaaagacctcacctcactcatcttggtctctggctctgagcacagcaccctgacaccatcataagctgtaactacaaattcaatggaattagtatgaaggtaaggagccagcaggttctggtggctcactgaggcattactgttcttgtttttgagatggagtctcactctgttgcccaggctggagtacagtggtacgatgtttgcttaatgcaacctcagcctcctaggtacaagcaattgattctcctgcctcagcctcctgagtagctgggattacaggcgtgcgccaccacgcctggctaatttttgtatttttagtaggcacggggtttcaccattttggccaggctgatcctgaactcctgacctcaagtgatccacccgcctcagcttcccaaagtgctgggattacagatgtgagccactgtgcccagtttgaggcattgctgtttaaggggccagagagaccacaataggcacagaggctgagacaacatgggtggtaccatgtagacaacatgtagacaacatgggtaccatgtagacaacatgtagacaacatgggtggtgccatgtaggctcatccctccatgatttgctggaagaactaagacggcagtaggagaagtggataaaataatgtctgtggagtcagactgcaagggttcaaatcccagccctgccattcaccagccagatgaccttggtcaatgtacgtaatgcctctgtgcctcattttatgcacctgcacagtggaggtaataatagtgcctgcctcataggattttccagaggattgaataagataatctttgagagtattccagtacatggtaaactctcgcaccatattaactattgcagtatggtgttattattattatgaatatctaatacagttaatatctttgtacgtaggagttttagcaggcaggtgtgaatggcacttttgaagatgcagagacagatttatccttatactcctaatatttatcctcaaagacactatttaactcattcaaaaatatttactcttttttaaagaccgctttcagctcctttttatacaaaaaaaaggaattctatcctcattctagcaatagtagcctaaagaaaatcttattacactcattatcttaaattaaggtaattgaaaaccactgtttaagagtagaccccaaatgtatcataaaattaattcaattataaataacaagaattgactgtacttgaatgtgcatgaagtatagaatcatagtggaacatttaagaaatatgtccttatcttgttactatggctacatgttactccaagatacagtagttctatggtaaggttggaattacattatttcctctctatattgaaatattcagcaactaatttcctgtagcttcatagtaaatcatgctaatgacctcagaggtggaaaccaaggtggtgagactttctccctgctctaaggttattccattaaacaaagcagagaatacacatttatactcatttgatcaggaagcataaggaagcttataatgagaaagacatggcaatgacatctcatgaggcgatgttaactttaaactcaagtatttaatattatttattcattgcgtccatgataggatcacaacagtgagaaaactagagattcatatgggcaggaactgagaggggatatggtacaattgaattcaattccacaagtaattcatggaaacttatcatgtgctaggtacgtattaggtaggatacccccataccctattctttgtctactgaaattattataatatttttgtgtatatcactaaacattcaaaacagtgggaataatgaagaaaggaagttacactggtttctaaaagccctatcatcagtagcaatttctcaaaagctcttcatgacatcctagagacatcaaagcattggaagcactggggtgctggggctggctcacggcatcttgcaccagcggtacatatctcttccaaactctgtattcagcgatgtcttgttggtagttgaagtccaccatgatggtaatatttacaccacagaaacaaacaaatattacaagtcaggtctttttttcttcttcccagagaattggctattaaacagttagcagcatgccactgattacaagcagcgatgtgagattgtatcttcttatttcaaagactgctctttccactttatgtgtttgtttccctttcccaaacctcttccacattcacctgtaagactgatttttgcctctctagatgaaggtgagataagagaggtttgtaagcttgtctctgtttacttcaccctgagtcaagccaccaacttctcttgctggactttgtctgtaactttcaaattagtccctttgtgttgatgcttgctcccctccaatccaatctccatccaccaatgagagtgatcttctaaaattgtaagtcacttaagcaaacagaagaaaagtaataataatgacatccctaattctctctctctctgtctcatgtctatgtctatgcctatgcctatatctgtgtctatatctccctatccctacccacttttctctcccttgctatcattatctctgtccccaatatatgcttctgcacatctcacattctggctttttcttatgctgctccccataagacccttcacttctctattgacatcattttcaccttcaactccacactcagatactgactcatacatatgattgattctcacctgcctgtgtcttgttgatccaggtctcagcttagaaattacttcctccaggaagctgtctccaagtcctgttcagatatctgtccttatagagcgttttttatctcacttactatactttttgttgtcttacctatttactatatgcttatatagtaagcaactcttaggaattagacaaaagttcccatttctgtaagacagatttccaaaacaggacagatgcttgatgaggaatgcttgagctggatttcaaccttttcttcccaagtattttgtgtggtgaacaacctgcatgactggcccttccccttaaccatttccattatagcatacattctgtcattgtagcacttagatgtgtatagcaatctttattatctgcctctgtccctgaagattatataccccatcttttttttacattcccagtgcattgtgatcatatattattcatctttatgtgaaacatggtgacaagcatatagtaggtgtgtacattttgcttgaagtaaagtgaaatcaatcttgttcccataccactcaaccttactacctttattcacccagatactaatcaggtactgcttcattccagatgcttagaaagatgagcaaggcacggaatatccctgtaggaaactcgaaggcccatcagagagacagacacataattgaacagtggtgacacaatatgctccatgacaaacatgtgtgagactaactgcattagaattccctggcatgctttaatgaagatttccagactgtacctcacacctaatgaattaacatatttgtgctgcttcttctgtcttctctgtgcccctcttcccatcgtttccaaccaactcagccagtcactgctccctccagcagggaatatgcccctgtgaaatgtacctatgggaggatagccatcattggctagacctggaaactagttattctaacccagttaataacaaacccagaacaactgaacccctaaaaggcggtggatttggacaagaagttctagagagtatttgctaagaggtgttgatatgttgcaaagaatcaatcacttatttttcaaggatagctttaaaaaaaaataaaagcccacctacttagtctattagaaataaagtcagtaggccaggcacagtggttcacgcctgtaatcccagcactttctgaggcagaggcgagcagatcacctgaggtcaggagttcacggccagcctgaccaacatggtgaaactgtctctcctaaaaatacaaatttagctgggtgtggtggcacatgtctgtaatcccagctactcaggaggctgaggcaggagaatcacttgaacctggaaggtggaggttgcagtgagccaagatcgcgccattgcgctccagcctgggcaacaaaaaaaaaagaaaaggaaaagaaaaaaaagaaagtaaatcactaagtagccttttgcaagacaaacaaaaaaaaaaagaatatttaggatttagtctataaccattgacttttggaaatcctgtccttcctaaggaaaattagaggaaaaaaaagagctgaagtctctgttgcatgagaaataccatttgtgattaaactgctgtgaaatacatactcaaaactgtgggaaattcttgccacatctttctaaaattgctgtttgatgtcttacatgccaaaatgactgtgaactagtgctctcttgaaaaccacctaaatgatccacgacaaggaagtcattaattaaataataaggtggatgtggactactatgcaatcattaaaaatctattctcaaataatttttaaacatatagaaaaatgcataaaaatactattaagggaaaatataggttataaaacaatattatagcattgttctagttttactaaaaaatcgtgtgtattcaccaaaatgttgacagtagggtttaaaatggactggtacttaaaggtgattcctttacatttttttctacttgaaatatttctatatttatttgacttcttcataatggccatgttttatttttagggctgccattcaattggtcatccaatctgggacaggtttcagagtaaaagaggaaaccttagcaataatatgggactataggcaaaagcaggactgttttggacaaacacgctatgtggttgttacgggctgaattgcatcccccaaaacccatgtgttgaagtcctaacctctggtctctcagaatgtggctttccttggaaatagggttgtggcagatataattagttaagatggggttatactgaatgatatagattgggtctttaatccaatatgactggtgtccttagaaaaaggaaaaatacggacatagacacgcccacaaagaaagaacactgtgtgagcaggaaagcagagattgggatgatgcatctacaaggcacggaatgccaagaacagacagtaaccaccaaaagccgtaaccgcttagtgggttcaccttacctgctgcctacccagagccaacttctcaagacaggggaattgcaatagagaaaaagtaattcatgcagagccagctgtgtgggagactggagttttattattactccaatcaattcccctgagcatttggggatcagagtttttaaagacaatttggtgggaggggaggggcagtgagttggggagtgctgattggttgggtcggagatgaaatcatggggtgtcatgttcttcttgcactgagtcagttcctgagttgggggtcataagatcagatgggccagtgtctctatctgggtggtgccagttgatccatcaaatgcagagtctgcacaacacctcaaacaatgaccttaggagcagtttagggagggtcagtatcttacagcctccagctgcatgactcctaaaccataatttctaatcttgtggctaatgttagtagtctaatccccaggcaagaaagaggtttgtttcgggaaagggctgttatcacctttgttttaaactataaactaagctcctcccaaagttagttcagcctatgcccaggaatgaacagggacagtttggaggttcgaggcaagatggagtcacttaagttggactgttttcactgtctcagtcataattttgcaaaggcggtttcaatcctataagaccaacatacaacagattctcccttagagactcagaaggaaccaaccctggcattaccttgatctcagacttctaacttccaaaaccatgagacaggaaatgtctgtttaagccactcactttgtggcatttcggttttttgtggtaggcctaggaaactaatacaatggtcattgtagttattttatatttagaaattaagagcaattctggaggtgagagatgggcaggagtagggaagaatgaagttcagtgcaacaaaagaagcttgttcactcaactaagactgtaaacaatgctgtttttcaaaaatacgtattccttctttctgcctggcccctctttagagagccatgtcctgttgatatcaagcttgaccatgtgacttgcttcagcctgtggcgtgtgagtcacagtcacatgttccattgagaaatgggagctttaaagaccatgctacggttctgccacctttgtcgtttgccatgacacgagcttatcctaagggagagctgcttctttagcctgaaacagagttgaaactgatctgcaatgaacctgtcacatgagataaaaatgtatcttttggccaagtgcagtggctcacatctgtaatcccagcactttgggaggctgaggctgggggttcacaaggtcaggagatccagaccatccaggccaacatggtgaaaccctgtctctactaaaaatacaaaaaaataaaataaaattagcaaggtgtggtggcatacacctgtggtcccagctactgtggaggctgaggcaggagaattgcttgaaaccaggaggcagaggttgcagtgagccaagatcgcaccactgcactccaacctggcgacagagagactccatctcaaaaaaaaaaaaaaaaattgtatcttttactagtgttattcaccaagattaggaggccgtagtgttactgcagcagaatgtagcctaagctgactgataaaacattgactaagcaactctcaggtaccatgccaggatgaaaaaattaattagacacagaccctgccagtgaagaactaacattatactgtgtaccattggcctttaaaagataaagatttttggccccaggtgtgttctatattttctgtaagacctgcaagtaaatgttaaatgatgttatttcaaccggtttttctgtagcaaaaatctttaaaagctctcatattcaaagtggttcttgcaatcttgaactacatgtacagatataaaatctgccaattaaaattttatggtttagggaaaaaatcccctctgaaaaataaacctaggtcaattatttcattatttaattctcatttggaaaataagatgttcagacattgagttatattagaaggaagaaaaccacttctgtgggaacagtcaaatttatttcatttactattagagaatgttaatttcaagaagcaatctttgaaagcaaccaaatttggcaaagacaagtagtcttccctgagaaatattggacagcaacagattatataaggaaaggacagaggggagagacatctcaagtgtaggtctggatggaggtagaagagtcatgttctagagtcagcattgtaaagcaaaaattgcatggtgtcaaaattatccttgaaagtcccttaaatggcccttaaattgtctggacctgtgcctttagaggttgaaaggccaagaattaatgtcttttgtttctctggggcagtgaaggccaaggtctaatttgaaaggggcaaaggacgatggggaaaataaaggatctctgcctttcttggtccatcttttggtctcctgtcctctctctaggtgactcttcctccagctctcctcctgctctttcccctcaacagtgcatatagctaaagtcaaacaagttaaatgtgcatgttaggcaactctagtccttacaacttaaaaactttaaaatggatgcattgggggcctattgtgtaccctgtcctaggctagatatggaagagatataaagcagggatgggggtgagatgaggagaggaaacaacagacctcacaggagccaggaagactgaactgcaaacagatgatataaatacagtgtagtcaagtcaaggcagtagctcaggtaaacacacaatgccacaaacaggagttctcaaaccttggctgcattttagaatcacttgagcttccaaaagcttcaatgcccaagacacaccccagatgcaccccaattgccagtgaccctggaatctttggggaggacctggtcatcagcatgtctttgagctccccgggtgagtccacatgcagccaaggttgagactgggggctacagctgtgtagaagagcatctggtgtgggtctgaaggctgggcaggaattagctggtagcagtgtgcattccaggctaggggaaccccagtactaaagcttcttcagcacaaagaggcttggtttgtgctttgaacatagcgtggttataaattaaagaataaccaaactccttgagttgaatcagtacacaccataatgcatcagctcacattgacatggcaacctcttttcatctctctttgttaagggccactggttctttaaaagcatgcgtattaatggattctatctgatgatgattcactccatagttccatcatgtatgcatctctaaccagtataagcaaagcattttcctttcaagagtctaatcctagcattgtgccatatccatggccctctaagatacacaccccatctacaaaggcgacatgtactcttaaggtacaaagcatttcctttaggggagtgattgcctgtgtgtccaagctgatgaagggtgctcttttaagttggagaaaattgattttgttgtggttgttgcacaaaggtttatgttttcaaagcctccagataaaaggcaccatgggcagctaacaagcccctaataggactacatcaagttttactcacctgctgccagggcttgacttctgcgtcttgacgacatgaaaccaggctttgacagcattcatttttgctgaaggaccctcccccagcctccttccataaatcctatgctcctttattccgtattcattcagcacagatgtttttatggccataatatatttatactaattcagaggcttgccatcagtagataggctcatctctctgatccggaaggcggcagaggcactccttctgacattgcagatgaaaataaggtctgcttttttcccacagtgctcttcaaaggagcaattttctaaaattcgaacaagggtgtcatagttaataagatggaattctccttttctttttcttattatattttccaaatcaagggcagtagattccagaactccaatgacgtcaggccactgtactttcaaaatgctgttctcagtcaggtttcttattatctgatcctggttcagtagattgtctcagaattgactttttagattaattttgattcttagttaaattactttttaatagctaattaccacacagtctatctgattaacggtattgtgattcagatcaagcggtgagatgactacaggtaacagacccttgctatcatttgggtgttctcacaaggaacaggagccaggtagtgaaccatgtgcctaccctttgggcagggaatgggtggctctaagagatgacagatgctgtcatccggaatcagttctcatcttggtcaattggatgagtcagagagattttggaaacatcttcaggctaacccaatttacattatagttatattttaattgccttttaaagtctaaatgcagttgattgtgaaaactgtgtcacatcatttaagggaactagagctttctttttatggaaacgcaaaaggacctagcaggaaaataccacattgcctaagcagtaaagaaatatgtccggccgggcgcggtggttcacacctgtcatcccagcgctttgggaggccgaggcgggcagatcacaaagttaggagatttagaacatccgggctaacagggtgaaaccccgtctctactagaaatataaaaaaaaaaaaaaaaaaaaaaaaattatctgggcatggtggtgcttgcctgtagtcccagcaactcgggaggcagaggcaggagagtagcttgaacctgggaggcagaggttgcagtgagccaagatcatgccactgcattccagcctgggtgacagagtgagactctgtctcaaaaaaaaagaaagaaaaaagaaaacagaaagaaatgtgtcctcaaagcttcctcagattgttctagaaaagagcactagcagcccccaaccaatgcatgccgtgaactcattccaggtatcatgcacctttgattgtttcactttccttgggtcaaacctttagaaagtgggttccctgtctcaggcactgagctaggtaaattcaggggataagatcaggaagagtcccttcctgaatccaggtactcccactccccccggacaacaaggtcagaggcaatccctcgccttcacctctcatcttatttttaaataaaagtttctctttctttatgttcttcgctttctccttcaacaagattgtttcctgctccctccccacccctgctgcctctctgaatgttgtttctcctcactgcactgtgctgtgcagtgaatccatatttcttttccttttttccttttcacacttgaccacgtctttattcaataactctgccccttcacagcacagggcccggtggaggctgcccttccagggagcccaggctcacgtgtacttgccagggctggctgtccctgtccagcaggtcacagacctctcctggtctgacactgaggagtgaccagtgctgactcagagcagcccatctacgggcgcactgttcagaaagtcgtggaggtagatatactgctccagcgttggggtcataaggccacaggccggggactgctgcagagccacgttaaacagatccacggtacactcagtccctgcctggtgctgcagctgctccatggccaggaaggtgcccagctgggtcgcacccttgctcgagtcactgagcagtgtgcctggcttctggctcttgccctgagagcagcactggcccatggtagccaggaagggcggcggggtggtccttggtacctggagccatcaaatgctgggctctctttgggcttcttcgcagcagccttctttctttactttactcacttcctaaataacactgttctcaggaccttcattactgcatatatattaataattcacaaatctgaatttcatcctttgcctctcatttggtttccaaatttattttcactcacaattcctacatagtcagacaccttcaacttcacgtttccattttgattctttgtcttgccttccatgtcttgtagcttatctatttttttctgtctcggtaaaagttcccatttgcccacagtagaggattgaaaataatctggcttttaaaaataccctgggggaaacaaaaaaaaagaccattcatcagtctgctgattctatatctctgagtaacactgtgaattcctgtgactctagttgagttaaatttattcctagcttttaaaaataaagccaatgaaagaccagagagattattacaaagcctgcattcttgtgaagttgctgaatccacagttttattttagtcaaatcacatttccatattgcaaaaatattttctaaacaattaatgggtatcatatggggtcagtcttgtggcgtttattcttttgtaacactgagctaaagtctctatgggaaagataaataggttgttggagaattaaactggtcaagaagtgaacattgatgcctaaacctctcctctgaaattttgagcacatgttaacataggcacataaaaaagagccttagcagaaagaagaaacgatatttccattgttgggtcacagtggtcactaaaggggatataactttaatttctcatttgaacgtacatggcatccatttaaccaactcatttacagcatagccgcctgtcaagcatataaaactgtaccacattgagctggatcggtttttaaattctaatataatgcacctgggcacggtgggtcatgtctgtaatcctagcactttgggagactgaggctagtggatcacttgaggccaggagttcaagaccagcctggccaacatggcgaaaacccgtatctactaaaaatacaaaaaattagccgggcatggtggtgcatacctgtaatctcagctactcaggaggctgaggcacgagaattgcttgaacccaggaggcagaggttgcagtgagccgatatcacaccactgcattccagcccgggtgacagagcaagactctgtctcaaaaaataaagagaaaaaaaaaattgttacataatgcaccctcgcacatgctgttggatgtaccatgattcaaactatgaattctgtaggaaagctacattttaaacatgtttgggtgaaaatgatgtgtcaatgtaggttcaatgactgtatcaaatgtaccactctggtgggggtcattggtaatgagggaggctacatgtggaggcaggaggtatatgagaaatctctgtagctgactttcaattttattataaacctgaaactgctcttaaaaaaaccgtaaaaaaataagtttgatgaacttggttttcaagcaggtagcaattaagactgtggttgtcatagagacagacctatggcaatggagatgaagggtgggagcttggctttatcagaatggcaattctgcatttttgtgaatgtcagcaaatgaatttgacccatgacgtatggacgtagatcaaagggcacatttagcatactgtcaatgtggtgctcgtgtggccttccaaaaggccagttccacagtgataaccaccactaataatcctacaaacctctccagctgctttcagtgacatgacttctgatctggagggaaagaaaagaggggtgatattttataaatatcaattttcaaaaatctctgatctgttggtattaactgatgagctcagagatgctcggaaacctcctgcctgcacaacaactgtaaccatggcaacctgcatttttaaaggatgttaaagatgtttttaaacatcaggtgagaaaaacagtttccacacaagtgtttgtctgggatgttatgtctaattcctccagtacacatttttccgttactgggacttgatacaatgctggaagctttcctgttagggcagaaattgggcaacccaagacagtcacagatcttgagatcgctgccattgctatgaaaatgaggcattcttattgcatctagactgagcatcagcatgcctggtgttcttatacgtcatacatgaaagagattggcaacccttcctgaaagctttgaatttttgatatcatttgttccacgtgattttctaaggctatattggaccactatacattctagaacaaattaattaaagcctccagtttccagggagatatactaatatctcaataaagtgctggatttgagtaaaagacagagaatcatgtctgtaatcctagcactttgggaggctaagttcaatgtagtattcagaatttgaatattgagcttctatattaaagaaatcatcaaataaataaataagggtctatcagttttctgaagattcagatttttgttgtttttaaatgagtaattctaattgtattttaaatgagtatagggagggtccattttaaggagtcagaatgtaatcaaagatgcctattactattatattttcagatagaaacagataaagttcaagcagtgcaaatactaaataagcaaattaagcattatgtcttttttttatggtctgccactcatccacaaccaccagcatttgtcttgacaaaccaccaacatttccctcccccgccttgactgtgcatggatttgcatatttatagagttaaagaatcacccaccatggttctctttcttatccacattcttgtcttacccatccgtctctgtcactctcctgatatacctcttccctactaattacattaatcaacaacaaacaacaactctaaaagattccccgagatgagagtttcagaagcctgagacgctatgtcaaacaacccaccgtagttattcagggacactgcaactcaaaatgaggtagccatcgatccagagaacaaatgatcattattcatgtaactctcttctttgcttaagaatccatctttttctatcagtgccaaattctctcactactttcctggttctaattcagaagtaagtaaagtcagctagtccctttgtttgggggttaggcccattttataaagaattaaaggaaaataggttaaacatgaactgcttctcagacgtggcatttacatgcctggtgcttccttagctcatcatataaccaagtactggaatctgttttacagataataagaaacattcacgtgttccatcttttacatatgtgaggaccaggcactgactagaaaattttcatcaccattgtcctcatcatcaccatcattagcatcttgtcgtcatcattgtcacgatgacaaagatgctttcatgatgatgaaagcatcatcatgctttatttacgtgatatcattgaatccttccaacaagataccagaccattttattgtagacattttacagatatttacactgaagttcagagttgttgagtggtttacccaagaatacgtagcaagtaaatgatagagctgaaaattcaatctgtctttctctagtgctaagccttagtttccctaccaagttttaaaggttgaacaaagcaaggtgttgaaagagcaccctgagtctgacagtcagaggggaatcagggcaggaagtatctactgaagaggtcctcaaatttcaggttgcctaaacagttactgaatgagcttgtcaaaatgcataaagaaggccctacaccactaccactaccaccaccctctgacacacatacacacagattgtgattcaataggcctgagattagtccaaaatctgtatttgtggcaaactccccaggtgatttcaacagagacagtctgtaggccacccttggagaaatggtgttatagctggattggggactgttgagatgcctaaatccccaacttgtagagctagcttgggctgctcccaagtctagcacactcattgatatggtttggctgtgtccccacgtaaatctcatcttgaattgtaacccccacaattcccatgtgtcgtaggaggaacctggtgggaggtgattgaatcattgaggcaggtctttcccatgctgttcttgtgatagtgaataagcctcacaagatctgatggttatataaaaatgagaatttccctgcacaagttctcttctcttatctgccaccatgtgagacatgccattcaccttccaccatgattgtgaggcttccccagccacatggaactgtaagtccaataaacctttatttttgtaaattgcccaatctcgagtatgtctttatcagtagtgcaaaaaatggactaatacactcacctatgtagggaaacctctttgttccctacataggttctctgcattggttcagagtccatctcttccactgggatgtccatcttgtggtcaaaacctgcaccccaggtaacataaaataaaaataacaatggctataattgtgaaccgcccgctaacctcctcttgtagtgctccaggccagacgctcatcaccttgttttgttgtctttgccatcagcattatagtagagccattggcactcacccatgtccagccccgttcctcctgggcacacagaaatttccgactctgttttctattgcctttgcagtcagatggaaccatatgactagtgctagccaaagtgtgtcatctccactctctttctttccttggtaccatggatgtgtttgatatggtgccagctgcaaagtagtggaggcttcttcagtgtgggttcttgagctgtcatatagcataaagccgccacccaccattctgaattcacagcatgagcaagagataaacaaacctttgttgagttaaggctctgggattttgttttattttgttcagtttttaatttctgtaccatatcctaacccatcctaaccaataaaacctcgtcgctgtcaacatcatcatcatcatcgcaataataaaatgtattaattatgaacataaaaccttaccgtgtgctgaacattagactaagcattttgcaaacattatctaatttaataatcacaccaacactataaaaaagacatagttgttatctgtgtcttacccagctggtaactgatcgggaaaaaaatgaaaacccagcagcctgactccaaagcccgtgtgcttatccaaacactacagcgtaggttgcttagtgccagcttcagtggttagttctttacatgcttatcataggtaatcctctgtcaacctgtagaagtaggcatgattaacttaattttccattgtgaacactgaaggttggacagattcaatgtctggtctgaggccacacatcacacaccacacactacataccacacatcacacaccacacatcacataccacacaccacacaccacacatggtggagttaggtcacaatccacgtccctctgactcttgaaggaagcatcatttattgaaaaactagagtgtctaagcaggtgattttgattccttcaagtctgtttcagaaatgtctaggggccccacagatctcctgaggtcaggggttcaaaaccagcctggccaacatggtgaaaccccatctctactaaaaatacagaaattagccaggcatggtgggggcgcctgcaatcccagctactcaggaggctgaggcaagagaatcgcttgaacttgggaggcggaggttgcagtgagccgagattgtgccattgcactctaggctgggtgacaagagcgagactctgtctcaaaaaaagaaaaaaaaaatcatcgttttactgatgatatttacaataacagcttctgccagtaatagagactaccaataaccaatgctatttattaaatactaacagtgtgtatatatatatatgcatgctggctagtgtcacgccctcacaaagtggacattattatcttacagataaaaacactaatgcttggagagtttcattgtttgccacagggtgcccaggtaaaaccatggcagaactggagacaatccaggcagcctggctccaaaaccttgcagttggccagcacactctctgcccagagcccagcccacgctctgatcacagaaagtgtgtgggagatgagtagaagcaggagaaaaaaaaaaaaaaagtaaaatgtaggctaaggggttgtcctgtaagaatttaggaatccctaagaaggagaactagaggatcaagggaaaaaggccaagtccagtaagtccctccaaacgtcaagtggggacatctcagtagagtatacccctacaactgatctgccaagatgttccacaatacaaaaaggattctgttggcaaaaacaatgcccacccctgcctgtcttgaagattcaaaatgcacagtagatgatagatgatggatattctaagatttgttgtagcaagaggctggttgtgtgcttaactcttcctttctaatttgcttttgaccacagcaccctttttattatgcaaaacctattaacatctactgaaaggcactcagcatttgagggaggggactagcaggctgcagaggagggtgctaagttctgtgctgaggaaggtggttggttgtggaagatgtagtggtcacaaatgagaagagtggacagtgggtacagggtagggatgatgagacctggaattgatgacctcagcagagaaggggaggaaggataagaagcaaataacagtgacatatgtgtaagttaaaaagatggaggtagagctagtttccaagatggcttaaaaatacacatgggtgccggtttgacctcaaaatagaaattagagacctagaattcaggagagaaggcagaactagcaaatggagactctaggtcaccttacctctccttttcttggaggaatggtggaaagagaagaacaactgaaaggcttcagcacaatcgctctgtaggacccaggagagagaagagtagcctggaatcaacagtggtgggagaggctggagggcctcaggaaattcaaggcaaaagagtagttagctctaatgaccattctttaaaagtagaaaaaatgaaagtggagatgtgcattgtttgtggaaagatagaaccttcctcagtcagaaagcattttgccattagcagcaggcagtgatgctgacaatttgcagttggtggccaggttttaaacagtagtttgggcaagaaagggtatccagcaaatcaatttgcaatagctgatccctgtcattaagggagtcaattcttgatactgtaagtgaataaccaagtgctgctctggtacaattgaggtatgaaataccagacctgactattttatgtaaatctctaacatggtgtttaagcaggacagagcagcggggaggaaggggcttaagcagaaatgggctttgaggacctctcggcccagacaggaagagtaattgggctaagatgagagaggggcaaaactcagcacatctccaaagccatccaaggttgcggacaattaacctcttgattcctccctcctttccttccaagatcagatttttatcgtctcagaaacatatgaacttcaagaaaatgtgaggaacacagactttctgagccagcttccattgacatgccatttgattaatttatgtggttgggacagcagttcagagggaatatagattgtgctcttacctgccccatttccatatttaatatattcaggcatggttatgatagagcatctcatgtttacactaactttgtgtcttttgaagttcacttttaactttgtgttgataaaatactattttctaattcagatttttcaaaaaatgcccgttgggcatcaagtagcttttacagaatgaggtgttcttagcattattatgaagcaaggacaagtgtattaccgccattcacggagacatttttgcagtgttgcaaatctcccaaatgtttcaaaaaattacagcagttgcctgttgcacctcacaattagctgcctaagattctaggagagaagcagttggattttatatgtgaaaatgcctctatttgctgcatttttactttttgagaagttgcaagttacatgaaaataaacatactatataagaaaacacggcagatttctcctggtgttttaataattccacgaaggtttatgaatattggcaaacgtatttgcagtggtacttccctgctatttactttgtagactttgagtcttagattcttgtctgtaagtgaaatgtagtattaaaaaaaaaaaaaaggccgggcacagtggctcacgcctgtaatcccagaactttgggaggctgaggcaggtggatcacttgaggtcaggagtttgagaccagcctggccaacatggtgaaatcccgtctctactaaaaatacaaaaattagctgggcatgctggtgcatacctgtaatcccagttactcactaggctgaggcaggagaatctcttgaacctgggaagcggcagaagttgcagtgagctgagatcacaccattgcactccagcctgagggacagagtgagaccctttcccaaaaaaaaaaaaaaaaaaaaaagcattacaagttggagtagcctgggctcccgtgttggctttattactgagctgtgtgcaggtggatgttttgctaaatctttctatgttccacgttatcaagaccctttctctcttttcccaaagctctcgtatcaattccatttaagccaaatctcattatttcattgcttttttttttaattatcctatttttaaaattattctccctccttctggtttccattttcaaatagttcaactggatagacataatagcaaaggcatagaatcaacctaggtgcccagcagtggtggactggattgaaaaaaaacgtggtacatatgtatcatggaataccatgcagccataaaaaaataaaatcacaagctttgcagcaacatggatgcagccaggggctattatcctaagcgaattaatgcaggaacagaaaaccaaataccacatgttctcacttataagtgggacctaaacagtgaatactcacggacataaagatggcaacaatagacagtggggactactagagtggggagggaaagaggggtatgagggttgaaaaactactagatgctgtgctagctaggtgacaggaccaatgatactcaaacctcagcgccacacaatatacctaggtaacaaacctgcacttgtacccgctgaatctaaaacgaaagttgaaattataaaataaataaataaatgtggtgcttatttttaaaataaatgaacaaaaaaaccccaaagagcttagctaggtgttaagtaccatccaatggacggtgccatccattatataatatagatatttacacacacactcaaacacgcatacatgtatgtatgtgtatatatatacacacacatatatttacgactgtagccttctttccagcagaagcagtttgccaaatgcctctgcccttccttagcccaaatgctaatagtagctatttcatgaatagatacagaatgacagagtcaactttacctaacttctccaaaatgccgactccagtattccattttcaaattaacttattctgattataaaagtaatgttcagtattgttagtaaaataaattttaaaaaaaacgaacttgtaatttccccactcagagatagcttctgataacatattggtgcttttacttctatttttttctatccatatgagtataattaaatacatattcacatctatatctatactcattcatatatattcatatgtaagattaaactatatgttcaaattgtattctgctttttaaaatcacactttattttctgggaatgttctcttcataaagttcttccaaaccatgatatttaatgtccacataagaaaacatctcatggactctcaatttattgaaacttttccctagttttggttattctgtttcccaccagtcattaattactttaaacaattctgtgaggaccattcaggtacacagacgtgggtccacagttatctattttcttagcctcagtgcttggaagttgaaatttgtattgaataactaaattcctttgacaattaaaacataattatcaaacttttttgcaaagaaataacactatggtatatgacatctatggcatatgacagtccctgcttaccttatgcttgccggcattcagtgcttaggtttccttttttttttgagacggcatctcactttgtcgccaggctggagtgcagtggcgggatcttggctcactgcaacctccacctcctgggttcaagcgattctcctgtctcaccctcctgagtagctgggactacaggcgcctgccaccacacccagctattttttgtatttttagtagagacaggatttcaccatattggccaggattgtcttgatgtcttgacctcataatctgcctgcctcggcttcccgaagtgctgggagtaaggtgtgagccaccacacccggccaagctttcttaaatgggccactttgattgatgaaaatgataaggtactgtggcctttttttttgccatttaaaaaacagtggtaaggttttttttttgtttctccatgtcttgggaagcagctgcctgttcaagccctctttccttttcctatttgggtgttaatggcttccctattgattcataaaggcccactacttattgtggatattaatctcttgcctgtcatatgtttgttgcctttcttttatgccagctagttatttgaattaattggatttgatgttttgaaatactgaatttttaaatctttagacagatacaataccattttttccttatgcgtattctcttgtttatacaattaacaatcttggcctgttccaaaatcaaagtcacatgaatacatatatttttctaagtttttatggcttcatattcacatctgattcttcagtccctctagatcttactttcgatgtatggtttaatgtgaagtcccatttcaagtttttacccttcaaattaattttccttccaaatgttattttattttattttaaatacccattctttttctggttttgtcacatagctttcatgtgatgttaagctctaatacatacaacaatttactttgggaccatctcatatattaaattttgcaaaaatgccatactgttccaacactcatagttttataatgtgtcttaacacatgacaataaacccttctaaaatacacacaggtttcagaactgccttaattattttttgctttgatttttcctctagaaaaaaaatgtgatcattttctcagactcccaccctacttgttttctcaaagctactgtcacactctggatgtacaaggtcaggggtggtgagagatcagggtgtttaggagtgtttgcttgactgatggagacacagggttcccaaactggaagatgacaacataggagaagcttccagttttccagtcaaagatactatgtttcatgaggcaaagcgtgagaaactcaccaatacaatttcccccaattccactctatcagcctttgagattttccggacagctatctgtcagtcttagtacttaaaattgttggaagtttgaacacaattcttcaaagatattttagtgaggaacaagagattttgctttggaagatcctgaacagatttccttacaaaaagtatttctaagcacccatccctataatatatctaaatgttaaatgcttattgatggagtaaaatggaaagtccaagagtcgtaacattatctggtaacagtgtggatgagaggtatgggagatgtaggcatgtgcatgtttcctgatttgaccaaacttttcaacatgagtgacccttctaactagttttccaaaaatagagagaagagatccagcatcaatgaaaatgacaaaattgacaaagttttgccttggccctcttccatcgtcgctatcctcttctcctctactcaacctccccatcagtctttttacccgcccgcctccttttttttgagggaagctgtattaggccattctcacatggctataaagaaatacctgagactgggtaatttataaagagaagaggtttaattcgctcgtggttctgcaggctgtgcaggaagcatggtggcttctgcctctggggaggccttaggaaacttatagtcatggtggaaggcaaaggggaagcaggcacttcttcctggcagaacatggcagaaaaggggcatggcggaaacagggcaagagaatggggtggggaagtactacacacttttaaaggaccagatcttgtgagaactctatcatgagaacagcaccaaagggatggtcctaaaccattcatggaggatgcacccccatgatccagtcacctgccaccaggccccacctccaacatgggggattacagttgaacatgagatttgggtgaggacacagatccaaaccatatcaaaagcttttctaattaggttactcattctatgaaaatagactgcccataaataatctttgtttttcagatgaagatttggcaagttctgtgcctagcacgatggctgacatgagataagtgcacaggaaattttgaaatatctgtgtctctatcttcatttccttgtttgtgtctccaatttcctatatgccatcaggggatttagtgacactgcaaatagcatgctctttggcaggcacgcctctcccatttccccagaacctcttcgtctttctgaggcatggagtcccaagctgtatgttttcaggtagtattgtaggaagattaacagtttcctgacatctttcttgcaaaggcatgaatacctccaccggtgcagatcaacataagaaatttaatgtttaccttgccattttataatgctatcaactttctcaaaatctgtccctctgcactctgttatttaagatttattgtcatcctgcatggtgagatagctggtggacattagccccattctcaggggtagctgctatggttgaaacatgctctaccaaaattcgtatgttgaagtcataatccccagtaattcagagtgtgaccttacttggacataggatctttacagaggtaatcatgttaaactgaggtcatttgagtagaccctagtataatatgactgatgcctataaaaagagaaatttggagatagactcacactcagagagaactccacatgaaaataaaggcagatggccgggtacggtggctcatgcctgtaatcccagcactttgggaggccgaggcaggcagatcacttgaggtcaggcattcaagaccagcctgggctatagtgaaaccccgtctctactaaaaatatgaaaaatttagccaggcgtagtggtgcatgcttgtaattccagctactcatgaggctgatacgcaagaattgcttgaaccccagaggcggaggttgcagtgagctgagatcacgccattgcacttcagcctaggtgacagagagactctgtctcaaaaaagaaaaaaaaagctaaaaacacaaaataacagcagaaatcaggatgatacatctataagcccaaaaatgccaaaaaatgcaaaacaaacaaacaacaagaaaaatccatgagaagctaggagacaggcttggaacagattcctcctcacagacctcagaagcaccttgatctcagattttcagcctccatcactgtgagacaatcaatttctgttgcttaagccacccaatctacagtactttgtcataacagccctaacaaacaacatagtagataaaaacaaaaaacaaacaataaaaaaagaaaacaaagaaggctaaatagcttccttctgaatgtggatcgtttcatcagaggatttgatctactgaaccttctactgcactaaaaattctcatttcatcaagtataatgaactgaagtcaaagggatttatttgatgctgaaccaagccaacactctccccaccccaccttagtctaccgttaacgtgtccgaaattgcatgcgttgttttgcttggatgttactagcccttgctgggaaaggtacttggcactaatgtgactatttaaactaatattcacaaagcagttaccctgtgccaggcttatatggattcatgtaattctcacattaattctgtgagactggtgccatgactatgccacttacatatgtccagccagaatctctagttataacttgttcctggtcatacactctgctggttgtgaatccagcgtttgaactcaggcagtctgaccctgggggtgacatttaaactactttattgctgggttctatgttctcaaaagtttagaaggtatttgttaaagagaattggaatatttgctatggaacttgtcagagcttttaaatatgctattatcttagggaatctctgagagtgtggtaaagtaagcagcatttctagcacatagttaaccgtgggtctctttttattaaggcaagatctcttgggactggtgtttcttgaatagacttgccagacaaaatacaagaccccattatgaaatttcagataaacaatgactagtgttttagaataagcacatcccaactattgcactggacatattaatactaaagaatttgtgtttgtttatctgaaattctaattttactagggcgttctgtatttttatttgcaaaatttggcaaactatatgaaagatgcttcgaaaactatagagaacacagccaaagatccctgcctctcccaatcttctgggcctctttctttaggaaacaaacataaacctgcccaaactgaggttgtaccctttttacctgccctgttaccttcctagcatccatcttgctgtccttcattctgccaccctggggttcctatcaaactctgcttcctgtctcttatgacttagaacatgccatcccagacccagggaacagaacaggcatatccctggttatttcaaagccagtatcacaccagcatgtagagatatgaccagacaataacaatcctcctccagttatcactcgagggaaaggagagggacttatggggaacagatgcagataaaacccaaatctgatgccttgaggctggtcagtatgaagtctgtcctgtggtatccctctgcaacatttccatttcaggggagttgagggcttatcaagcttaggaagcaatgtgtactgaaaaggatgaggtcagttcggggtctgtcaaatcaattgaacatatcttgaaccctgaattctatcatcaatctcactttacaatccatcccttccaattaatgctgcatataataacaccactcaatgatgttcatacatcccatcttcttacttggcactatcttttttttctttttaagagattaatttgtctttccaatatattcaagttatcttgaccaatgtttcagaattacttagagctttatggattgcagcaagaccgaagcaaatgaccactcataattcagaatatttctgagccagaataaagtttacacttcatgaccataaagaggaccctttatgcttgtatgtagaagctcaattcaggttccaaacctgcactgtccagttaggtagccactagccacctgtggttacttaaatttacccttaagctaattaaaataaagttaaaactttagtttacgagccatatgtattagtctgttttcacacttctataaagacatacctgagattaggtaatatataaagaaaaaaggtttccttgactcacatttctacatggttggggaggccttaggaaacttaacaatcatggcagaatgtgaaggagaaacaaggcacatcttatcacagtaaagcaggagagagagagaaaaagagccaaggagaactgccaaacacttttaaaccatcagatgttgtgtgaactcactcactatcatgagaacagcttgggggaactgcccccatgatccagtcctctccaaccaggtccctcccctgacacatggggattaaaatttgaggtgagatttgggtggggacacagagccaaaccatatcaccatgctagccacatttcaaatcatcagctacgtatcgctggtggctattatatgcagtacatacatactgcacagtgtagatatgaaacgtttccatcatcatagaaagctctcttggacagccctattctagatgctttattctcaaacatgccacaggataacacataagatattggcatggataccattctatttggtttgggacagaagaaataaggaaaaatgtttctgaaacagggagtccattttagattattttatatgaagttatcaatagtttattaatatattgattaaaagatgacaagttctcaacccccacgatagcccactggtgaagacagaaccatgcagacactattaattcggctctgtttctttttctaatgagccagtgtggagactggggaagaggaagggattgtttggaaagatcagagcatccaggagaaactgtatggggatgggggcaccactgactgaatcagagcctccagtttgctttgggtgaccacagagggactgaacaaacccctgtgttgtcagtccttagttttgagaatagccttgaccagcacacttgttcactgaggaaggatacgaaaatgcagataagttaaaacaaacaaacaaacaccgtcattcttactctggcagccagatgagtcaccaacacattaaattctttatagatctctataccttcctttatgtaaatgtgtataatatgctcacaaaaataagatcataatatacatactgttttttcaacctgcttttttttttttttttttttttttgagacggagtttcactcttattgcccaggctagagtgtaatggcgcgatctcggctcaccgcaacctccgcttcccaggttcaagcgattctcctgcctcagcctcccaagtagctgggattacaggcatgtgccacaatgcctggctaatttttgtttttgtttttgtttttgtttttttttcagtagagacggggtttctccatgtaggtcaggctggtcttgaaatctctacctcaggtcatccacttgcctcggtctcccagagtgctgggattacaggcgtgagctaccattcccggcctcaacctactttttaaattaatatgcttcaacacatttccaagccaaaatgacttgtaaaacgttgtacttaaagattgtggctacgcttggtggctcacgcctgtaatcccagcactttgggaggctgaggcaggcagaccacgaggtcaggagttcgagaccagcctgggcaacatggtgaaaccctgtctcttctaaaaatacaaaaattagcctggcgtggtggcaggtgcctgtaatcccagctactcaggaggctgaggcaggagaattgcttgaacctgggaggcgggggttgcaatgagcccagattgcatcactgcactccagcctgggtgacagagcaagaatccagctagagaaaaaaaaaaaaaaaaaaaaaagtccttgtgcattaatctgttctataggtgtttttagtggaacatttagtgggggtccagttcatccccaattataaatataattccactgagcatcctcaactttgtgcacattcctaataatctgcaaggaatacatttatggaaggagaattactgtcttaaaagggggttggggtgggtatatattattaaagtttgcgataaaagtctttagttgcttgatgaaatggaggcagaagtttaatccctaaggacccttctaattccaaagttgtctgagtgccggattgtagctctgttgagcctgggtcttaagtctgagcgagcccttagttaccttcctctcccatcagcctgagccagagttagcctgaggtcccaaactatgagcaggagaatgtcaccctaggaatggcaactagaaagtttttaccccggatgccatgatgaggcactgccatccactggagcttgctgtgattatggaaatgttctctatctgcacatccagtatgataagcactgaccacatctggctgctgaggacttgagatgtggctggtgtgaccgaataactgggattttaaatcttatttaattttaatagccacatgtggctagtggctaacattttagacagctgttctaagagcatacctctgagactcaaatactcagatctttgccacattgttttatcttaaatatgacaattgataacattgctcatgctcagctgcttgcttcaaatgacatttatttccctcgctagttcttcaaaggtagggactaatcaccaaatctccaatgatagtctgatgccatccccaggtctgctacagcacaaaggggaccctcaatgaataagcatgtcaacatcaatcactttcctcaaagtttaactcagctatgatagatcatggcatatccgcaagccaagctactcatccaaaatatggagatcttgtaagttggagattgtgatgataatagtacctgtcccttagtattgttgtgaggattaaatataagaagagcacttaatattagtgcctagtgcagggtgagtctccagtgaatggggaccattactcttgcctccaacattgtagcaaggtcccctccacatagggataagcctgtcaagacccacgcctgttactcaaaatctcttttagggttatttaaatacgtggtcaagtattgcattaggagaaatggcttaagaacaagagaatgtcaaaccaaattgagttccccttattgtgtgctctcatgaagcacttaccacaatgataattatttgcagtagtattacctaatacctgcttttcccaccatgctataaacacaccagagcaagactgtttatcttgttcacggatgtattcccagtgctaaacatatagtaggtgtttaataaatcctgaatgatagattgaggatgagtgggtagtagatgggcaggaataaaggagctacgggaaaccctagcatagaaaaaaatagtaccagaacccctgaaatctagtcctgtttaggttcacagctaactatcggtccactgaaaagccctggttttggcttctctgttttataaagtgaaaaaggttgatccagattagggtttttcagcctcagaactatagacatttggggcagataattatgttgtgggaggccgtcctgtgcttataaaaggatgtttaatgcacctgtggctgtacccattagctaccagcagccctcctccgccagctgcgacaactaaaaatgtctccagaaaaatgttccaagcagggaaaactcccccgccgcaccccagttgagaaccactgatttagatcctgtctgaagtcccctctggcactgatagtctaagattcttcttgggaccataatttctgaacatgtgaattttctgacatttcatagatggttatagaattataagaatatttccagctactcacgcaaataactcagacctgattatcaatttaatatttggatcagtgggccattaaaatgctgatttgaaattcaattttccatttttaaaaatgatcactttgtgaattctgttagctggttgattttatttaaatggagtgtgtaatttttcccgctctgtgttcatgaataacgctttatagttgaatgtcagaatgcctgctaatgaccctaacaatcatagcttatttctagagaatccatacagtcattgaggctttgttttttttcatcttccactcgtttccttggaataagacctttaattaatgctcattaagatgcacaaatagcctggccttgaatcctcccagtgtttggttcactctcccctaacttattaaagttgcttctggaagttacatagagacgtgcagttaattcctggaacagtgtgtttgtgcttctcattatgcaaaaaatatacaccttggtcaaaaaggaggtatatttttacacaactatttgttcataggacatgtatgcattaagcctcaacaaatgcgccaccctattggcaattatggaattcgagtctcacatcagagcaaatgtggtggtggcctagtaggactttcaatccccttccttggaaaactgccttagtaaggagttcagggattccaggaaatacaggaaagcctttgggatgtgtagtcccattcatatgaaatccacatttcccagaagaccacagaacttttgtgttccatgcagtgtccctagcactacaagctattatctccttaaatctctcaaccctatcaggcacatgctaacaggaccatgattttactatcaacaaaagggaggatgggcgcggtggctcacgcctggaatcccagcactttgggaggccgaggtgggtggatcacctgagatcaggagatggagaccatcctggctaacacagtgaaaccccgtctctactaaaaaaaaaaaaaaaaaaaaattagccgggcgtggtggcgggcacctgtagtcccagctactcgggaggctgaggcaggggaatggagtgaacccgggaggtggagcttgcagtgagccgagatcacgccacggcactccagcctgggctacagagcgagactctctctcagaaaaaaaaaaagaaaagggagcctccctagagaggtgttaagtaacctgcctgaagtcacagaaccagagtttgaattcgtctccccagatttctggaattgcagtcttttccagtgctacattgcccctagatttaggataaaatacaaatgacttatattttccacttaaaagaagcattccttagcatcaaactaaagttagttcaacatatattcctatcaaaataggttaagtttttttttttttaatttataagtgcttatgaacaggaaacgatgggagaatagcttactttcaatgactgctttgagcgtctaattttaatccatatattttctgtaggccactgtttgtagcttttagagtagatttccctctcttaaaagtaaactttgttttacttagaaaacacagagaccttggagcatagtgattgttgtgtttttaaatttcattggtttaattgtcgtttaaaagtaaggttttttttgttgttgttggtttgtttgtttgttttttttattaggaaaacattctcttcatcacatagccctaaatcaatcaacatattttaagagaactgaaatggttttggggtaactttatttttgctattgtagtctttggaggaaataaatgcaaatgaaaaaatcagttaagatcagacgatggatgtattttttttttcacatcctttcctttataaggttaggaacaaacaaacttcctaggaactatcctaatatggattatcataatctatgtttttacaaaaatagtgccaaggaatggaaccaatttaaatggcttagagcatgagacttttaacgtaggactcaccttttggtggtagctaactgaaatgacatcagatctgtaaagaagtgtcccatcatttaagatttcttcagttacaacctaaaagaagccatatgtttgaagtgtgtgctttgtacattttatgtgaaaacatggtcccagcagtccatattatcttggaactatgcagactcccgaagccatgcctccttttcacagacgtaattattagactatgcatgccaattttaattctagaaaaacggtcactctaggtaatgttctttaagacaaacaaacaaaggctgcttaatccatgatgctgtagtcatttgttggcttgtttattttaatccccaatttacaacaaaatgtgttttttttttcttacagagaacccacaatcctattaacagcgaacttctcttgaatgaaggcattacagcagatttaaatccatgcattacaattttagcaatttaatgaacatcctatttggcgacattattgctttaaaggaataaatcacaaacattttacttcccactagcactcggtatttcaaatccattttctctacagaatgatgtgtttaaataaattgtcctgttgactgaattttgatcacattattgggtatttgggatagaaatgtgtagacagagagtcagaagtcatcacatctactgaaggctttgcagccaagaaatgaggcctcaggcaagtcatttagtattaggggacttaatttcttctcagtccaaggcaggtgtttaattgcaacgtgtcccaacttgactaggggagtttgttcacagaatcaagcgaattcccatcctcaccctcacatttggatttgataagtctgcagaggggtccactggacctccttgctaacaagctgtgggtggctctagcctaggtgcccaggtgccccataaaggaaccactatgtggttaataccagaagtcccgtcaagttggaagcttctctaaccacatcttgggctgtagtacttgacaattggcttttcttcaataaagcaaaaataccctcagttatgtcatcattaaaatgtacatgagctagaatcttatgcctgcctggttctgtgagttcaaaataagagaaactcaggaaggttgagttgagccgcatgctgaaaagagggggagaagaggggatgacttggagccaggaaggcttgtgggacagagcttcttaacctggggtgttcacccttggtccctggatggacttgagggagtctctgaatgcctgaaatcacaggcaaagtgagtgtgtgtgtgcatgtgtgtgtgtatgtgtgtgtatttttctggagagggaaggaccacagtttgcatagatttcccatggagatgttgattgcaggttggtcagaaccatccttctaactaggtggtgatttggagcacaggcgtcgggcacagagaccctgacttagagcccatctcttctattaattagctgcacacagaagctggattcccctccaagcgtgctctacctgtggcaaagtgctattgtgggactacttgggaacataggaaaagtgtgcattgtctggtactcagtaattgctcaataaataccagctacatcctaacaaatattttatggaggtccttaaactgagcaagagcaattttacctgatgcattttgaaaggaagtgatgattaactaatccttcctgcctcctgctagtcacgccttacatcaccatattgtctctttctcctcatctggatctttcgctaaagactgacaaagaaagcttcctctgatggctctggtctccagctaaggccataaactgtgtattgttgaggctgcaggagaaggtggaagagtcataatgccaggttcagaccccttggtcttctgtctgccatgggtttgctgtgctctgctagggaaaataattcatcttttgaacccctctgggacatttctgtgagttttgttggatggtcatgtgtgttcactttatgatctccacgtgaaaggtgaagttcataactgccaccagtctctaagctttgtcctttaaagtctgcggacacttgaagccctctgttagtcatgccatgctgtgatcaaaaggattgtgtttaagaatgtatagtctaaatgcttattgtgatcactaacatttgtatagttctttggggtttaccaagtactttacttgtattttctcatttaatcttcacttaggactaaaaaagttagtaacactaatgggaatgagcgaaaaccaaattcagacagtattaaatacacaaaattataaagtaaaatgagactgatttcccacgtcatgaggaaaaatgtctctttactttgtgattctttttatcacatacttaaaggcatttgcatttttccttttctgaattttctgcttttagtttttcctcttgtattagatgttcagtgtaactcaccaattgtggcagttttctgtttgattcacagtaaaaaagaataaaaaataaaaattaaaaaaaaactgtgacctgcattgtccacctgattaaaattagtttggatttttcagataaggttccttctttttattattataaacagactttatcttaagagtcggaagaaacatttaagggaactattcgtcttatttgtatttcaacctgataaaaggaaaagggatatagcaaaaatttttagtcgtttgagtgggaagtgctttatttgagataaacacaaaaggttttaagtatcgttgatattagtcaaacataatagcttttggctattgtctgaagagctcttgtctgttgacttgcagacctgtgacctctagataaagtttcaaaatgcagaaaatatttatcttcttgctatgaccttccacgcacacgacgtgaagccatggatttgtttcctagggaactagtgagtgaggaagatctataattaaatctgtgagttatatgctacacatgggaattgggtacgcaccaagtcctttagaaaaatcccataatatcaccatagcctcaactggtggaattaaactcaatttttcttcacacatttttagaaagcatcattcagaatcttaatatgggaaagttcttgtgtttctttccaaagtcagggtgtgtttagtttggcttccatttcgctctggatccagtgtccctccctgatgggacggcacctgccattgctactcaggtgagtgctttatatggaagtcttggaaaagcgagtggtagtctagtctcagacatcagcacgtcagagctggaagggatccaaggcagtgtttggcaaaagttttttgatgttcaaaatgtgtccttcaaataaaatctaatttaaaaattcactgagtgaagcagacattaggtgaattggttttgactagaagtaagggagaaagaaccttttcatcaccaccccaatcccaaaattccagagcaagaagtctctaaggcacccccgtttctcaacttgaacattaacatctaagccatagcactgattgtagagggggcagactgaggctcaagagatgttgccattggtcagccatctcatagcctctagaggttaaacacacacacacacacacacacacacacacacacacatacacacacacacaactagtaaaaaaaaaaaaagtcagaacaatgaatagctgtttccaaatctggcttgaatatattttgtagtaaatttccccatctagaggctcatgagggccaagatttctctacggtgcttttatttttcaccttttgaaaccaataatcagcctcttacattaactctaaaaagtaaaactctgtcgactctttgctttcaatgggattgtcctccccgtatcattcctcaaccaacagagggactctatgagagggaagcagaacctcaggactaccagagaagagatatttcacagataccaaggcttgacgtagatgtgaggccaggggcagggtgcggtggctcacacctgtaatcccagcactttgggaggctgaggtgggtggatcaactgaggtcaggatttcaagaccagcctggccaacatggtgaaacctctcctctactaaaaatacaaaaattacctgggcatggtggtgcacgcctgtagtcccagctactcaggaggctaaggcaggagaatcgtctgaacccaggaggcagacgttgcagtgagctgagatcatgccattgcactccagcctgagcaacagagcgagactccatctcaaaaaagcaaagatgtgagtccagggtgggtgttgatgaggacggtaataatacctgatgctttcgtagcagtccctgctccagactatatatacattagctcatttagtgtttgtgatgtctaagccgtgtgtgtgtgtgtgtgtgtgtgtgcgtgtgtgtgtgtagtagcagcttattttttttctatttctctttgattttttaaatacacacttataagtgtacatgtgtggtgtgtgggtatatatacactttcctctatctttctgatatacctatctatatatttatgatcttcccaccaacctggtaaggccgatactactactatccctattttatatataaagaaactgaggcacagaatcctaagggtcctacagctggtcgtggcagcactgagatttgtatccaagcagcctggcttccaagtctgtgctctttgctggtctacattcataccccatcttttatttttctttttgaagtatacgctatggggctttgagcaaaacttctgatgtgaaaaagaaataagaataataactccaaagatttttgctatgaggataaagcacctgacctactgcaccttgtaatttctggcaactaataatttctcagtaagtttctgtgttgctgtaaaaattgtcaaccatgtacacaaacagatctttaaaaaaaattgagacaaattaaagtgaaagacttcaaaatcagtttgtcacatttgatgctaaacgctatattttctctgagaattttaaattgtgcaggtaatttctcaccacggtaagtcatgatttttcatacttgaacagtatcacttcatctaaggaattttccccagtgcagtacactcccacccatgcctctgaaaacgtctaatctgtttctcctacttacctgttggtccaattcatttctggaaatgttctgcaggttatcataacgagaacaggagtgatctatggaataaacaggcactgttgtttgaattaattaccaggaacagaatcataagtggtgacaacttacaacagctcattccacattctcctgccactgatggatagatttatgcatttgaaacattttttactgattgcctgcccatctcctgttcacatactccctgagaacctctatgtcttatccatggagtatgtccgaaaaccaattatcatcccctttttgtttctgtattgtctaatggaagaaaagaaattataccttagaggagatattttcctgataaacagcatttagtcatttagtcattaaattagctcttttaaaattgtattatttttaaaggcatctttttattttattttattttattttattttattttattttattttattttattttattttattttattttatttgagacagaatctcactatgtcaccaggctggagtgcagtggcgtgatctcggatcactgcagccaacctccgcctcctgggttcaagcaattctcccgactcagcctcctgagtagctgggactacgggcacataccaccatgccaagctaatttttgtacttttagtagagatggggtttcaccatattggccaggagggtctcaatctcttgaccttttgatccacccgcctcggcctcccaaagtgctgggattacaggcctgagccacagcgcccggcctaatggcatcttagtcattcgacttttcgagacagccttatcagtagcctctgatgcttgaggttctcttgtgttgcttttcgttgtcatagtatttttgttgttattgttttgtttttctttctttttgttatttgctttatgtttgtatttgtcgtacgttgtgtttaatctaccccttctctgcccaagactgtagtatgtcgtcagggttgagaaccactgggttaaggagttacaaaaagttaaatttctcagggctaatgttgaattcttgcatcggatgagctcattgtaacttaggaaaatcaaaagcttgacttgaaagaatgagacaagtcaagctcttgtgagacaagccaactctttctcatgtggaggaagagttctgatggggagaaggagctgaagaagtggtgcccccattgaagcaggcagctgggatcccctgtgaaggtggtgaagggcagatgggagacggagatattttaatgaaaattgtaacctattttatgaataaaatttattttttattactgtaattttttttttgagacggagtctcgctctgtcacccaggctggagtgcagtggtgtgatctcagctcactgcaacctgcacctcccgagttcaagtgatcctcccacctcagcctcctgagtagctgggactacagttgcctgccaccacacacaactaatttttatgtttttagtagaaatggggtttcaccatgttggcctggctggtcttgaactcctggcctcaggtgatccacccacctcggcttcccagagtctggaattacaggcgtaagccaccacgcctggccccaaacaaaatttaatttaatccttacaacagtcactcaaaggaagaaggatatttgcattattagagcaccttcatgagcttgacatttttatgttgctctttgaatcctctcaaatgccagctgatttaggtttcatttttcccgtcatcagtgataaaaccatgacttgaggcaaaggtgactattcagaaccagggtttctgattctactgcctttttctactgcttggatacagcctggcctgaagcctcagggactttaggatgtagattggcaggggaaatcccaggcaggggtgttttttgatgggagaagctgtttgcaacccgcagctctggagtgactcagagagagaaatgactaatttctccattcagcaaaaatgcattgagctccagctacatgatgaggactgctgtaaattccgtggacacagcagtgaacagaacagaccaagccctgtcctacagtccacctgctagtaagggaacctgacaaatcaaaagttaataaaatacatggtgtgtcagttgctatgataggtcctgataggggctatggaggtcaatggctagagatgagagtaggttgcagttttcaacagggaggccctcagtgagaactgatgaactgggatgagtgcagggatgcatctatctgggggctgagcatcctcgataaaaggaactatgagtgcaaaagctgggggcagtagtgtgtccagaatattctagaaactgtaggaaggctggtatggctgaagcagagggagcaagggaatgttagataggagaaaagctgtgaccagatcacagaaggtcttggagcccaccatgaggactttggcctttattctaattgagtgggaaagccactggtgggctttggtgaagacagatgtgatctggcttatgtctttattgaatggctctggctgacggatggagaatagaatagagtgtggatggggcaagggtaggaacagctgcaatcactcaggctctagaagcaatgggggcttggcccagagcaatggtggtggaaggggagaggcgtggttatggccgtattctggatataatttgaaaagatttgtcgggggaagtgaggattttagctctgttttattgagtgtggttgcctgcaaaccaggctctgcgcctctctgaactgtcatgcattctttttgagtcctcttggtggttttgtaaagaagccagcctcgctgcccatctcccagaggggggaaactgaagctcagagacattcagggatttgcttaaagccccatgccaggcgttggccatggtcctggctcccaaacctgtcctttttctactgtaacaggctgcctcccctccaaagtctgcaggaaatttaagcctcctggaatttcttattgtatcagcatgaatattattaagtttcctataaactcaaattttgtgtatttaaaaagactatgaatctttctttttagaaattgaggtggttaggattaatgaccaaccataaaattttataagcaattattacggtttactgtaccttcttcagctgcttgtcgccttgccttcttttctttctcctgtagtcggggtgagttttcacatcactgacaaagatattgggctgggaagaggcacgcttggagtgagacccttcaggaagcctctgtttttaactttagctgtgacactgggatctcagtcatggaagttcactgacatctactcatcctgcattagtaatatgggcatggtgcattttctgtatttattagctatgtttaacagaatctttagaaaggaactcgatgccctgtttcaacaaagtacattgattttttgctttgtgatagataaggcaaaagcggtcactttgttcggtgtgtgctctcatcctaatttagggcccctttctgcctagaactctgtagatttccgccgtctgtgtttttccatcatcccagaccctcagctgcaagctcaggcctccagcccctcatgcacaactgctcctttagatcaggattactttgcccccagtctccctgggacttgctgcagatttatttcaaagttgtaaatcctctgtggattacctcctcatgctattctcaacctctggttctttctttttctgattgcccccaatattaacaaagtggagcaaaaataactacagttgctggaaagtggtactgtgttagtcagaacacagaggttgtatgtgacagatacacgttcacatggctaaggctaaagggtattcattgactcccatagtcaggaaatccaaaggtgcatctggctttaggacagctggatccaggcctcacacagttgcactttgtactctccctttgcgtggtagcctgatcttctcctgccacagacacttggtcaaagaagctggtcacaagctgcatccttctagcactgtgaatattaaaggcaagaggaatcttccctctgagcctggtgtggtttggctgtgtccccacctaattctaaccttgaattgtagttcccataatccccacacgtcacgggagggacccaatgggaggtaattgaatcatgggggcggcttttctcatactgttctcatgatagtgagtaagtctcatgagatctgatggttttataagtgggagttcccctgcacaagctctcttgcctgcccccatgtaagacgtgactttgctcctcattcaccttccggcatgattgtgaggcctcccccaccatgtggaactgtgagtcaattaaacctctttcctttataaagtactaagtcttgggtatgtctttattagcagcgtgagaacagactaatacacacatctaacaagaataccccaaggagaatactgtttggtataacattgggcaaatgcccattgctgtagccatctctgaggccaaataaatgggttccgcttggctagaagtacatctcattatgagtggaagtgggggaatgtcatggcaccatgattgtggtacagctgattgtcatggggcaagtgggagggttgatgtaagaaggggttggaaagcctgctgggtaaacaaatctatagctactgtccttcaccatagttctaccaaagtcaaattgcatttatagcactggagtttcacttaaagggaatgcagcactggggacagaccctagtattttttccaattgtcctttattttcagttgccaccatgtcttgagcgcctgccctatgcccccatactgttctaggtacatatgatggcaaaatgatgaataacacattgactctgccctcacaaatgctgttcattaggatgggtcttcctaaattatagagactgatcaatttacatgccaccctttgatgctaactaagacaatggagaaatagccccaagtgctaatactctgtctcttgaattgagttatttttccaaggcagtaaaatgtgaagattgcaattagttaaccattatgaagacaaatcttcaaatatttttctcactgtggtgacatttaaaatgcttcctgctcaaccaaacagccaattgatttctttcccatcttcttataatggctaattgctaagcaattgattgaatcctcttttgttactatgtaattactaagctggccaaaacgactctcccgaccatttctcagttggctcattttggtcacctataggacaggtttggggtgggaatgttcttatttggttaaactttttgcaaataatcaatcaaattgctttatgtagtgattccgagcaaaggtccaactggcagaaaggcttacatattacttggatagtttcttaacctaaactttggtgaagtttttgttgttgttattgttgttgttttgtctttgatatggaaagaataagaacctgcctcctgaaattttgggaagggtcatacgagataatacattttcagtgtttagcaccactgggacagaataagcctgtaacaaatcacaagtgttaatagtttgtctaggccacctctactgcatgcttatgggaacatggtcaacattgttaacttttgtgcctcagtttcccaatctgtaaagggaggataatagagccactcatcatcaaataaattagagtttatttgatgattgtattagtcggggttctttagaaggacagaactaataggaaatatatatatatatatatatatatatatatgcacatatatatatatacacacacacacacacacacacacacatatatatatatatatatatatatatacacacacacatatatatgaaggggagtttattaaatagtatcaactcacatgatcacaaggtcccacaataggccatctgcaagctgaggagcaagggagccagtccaagttccaaagctgaagaacttggagtttgatgttcgagggcaggaagcatccagcatgggcgaaagatgtaggctgggaggctaaaccagtctaggcttttcacgtttttctgcctgctttatattctagccatgctggcaactgattagatgatgcccacccagattaagggtgggtctgcctttcccagcccactgacacaaatgttcatctcctttggcatgatcctcacagacacacccaggatcaatactttgcatccttcagtccaatcaagttgaggctcagtattaaccaactcaatgataaaaagagagagcaaaagcatgtagaattgatatgacggttaaaggggatagttaaggcacctgaaggaccaagcccaccagcaatctgcacggatactcggtcactattttgttatttataccacctggcacagttcctgccttctaattcacactcaagcctcaagcaagagccgttcctttgcctccattcctcccagagattccccttcccatgctgaagccttggaaattattgtgaatgcaataatggtggccgcttctgtaaacactgtacttgaccttcatgcccacagtattcagcaggtaactacgtagtgtctgttgtgtgtcagggactgtgctgtggattcacttctgcagagagcagagggtagatgcagaataaagggtcttctcctgccttgagccgttcagagttgtggcctttggaagacttgctcagaatgatccagtgcttttttgacatttctggatatgatcactagctgcaatcttgcatttggtgctttttgtgattcccagctctccctccacatgctctgagaaaagtgatatccccagagctgtatccaaagaagaaatgtaaatccagaggctataaactaataggatctgagtttccgtggttgactgtatgaaagtagatttggcttctctgtgttgctgactttaacagggagcttaaaatgtgagatggagcaggtgtttgcgtgctgtatcaccaagccgttcccatggctgtgaattccgggaagttgagggactatacagacactttatcttgtggtgacctgatgcatgcaccaggccactgttgcccaacaactgccccctaagtgtgggtggaacggccattgcaatcgactcggggcgaacagtgcatctaaaagatgaaggtctgattttctttgcagagtttaaatggtgcatgtgtctttaccccaaaaaccacagaaacaatttctcttaaagagaaagagaggaactatgtacttgggctttgtatttggagattttggcaaagatggaggctgcccatcatgggtgacggtagaatctggtgtcagatggcacactcggagttgtctgactcacttggagagtacaagggcatctgcacctacaggcattgctgtgaatgacagaatcatcaacatccagggaaatgctatacttgaaaaaaaaaaaagatcagggtattagccgtggcagctatgtggcttctagatactgagccatcctagatgctagctctttacctgcatgatatcatgcaaatcttggaagcaagcctccaggtggattttattcctattttacagtggagggagctgagggctagagaggtttagtaatgtgttctctgacacatagattaaaaagtggctgagcaagaacttgaatcgcaagccctgcatgccagttgcgagccccaaaccctacctcctggggagaagacacacattgtatttctcttctcttcatgggggttacagactccgttatttcagagcagaacctaggttctctataggatggggaggtataaggactcctttctatgcagtggaagcctgtgtggtctccctgagaccttttcccacaatctctgaatcccattcatttgtgcaagagtcaagttcaaaagcagagagcttgagagctcctgtcttcatcacattgttgacttatcgttacatctgctcttctaacttaaatcactggctccttttctttcttcctctgcatcttcaccaaggagtggtagaaaaagaattcaccttggcatagacaagcctagatttgattaacagctcttaaaaaaatcattccacctatttagtgttctgcttccttctctgtgaatagggctaacgatgcctatttagattatgaaaattaatataaaaacagaatagaagtccctagtaagttgcctgtcccaaagcagacacttaactaatgtcaagtctccctaaacgttgccctcatccccacaatacgaggagggaagagtccgatgttttcattagaaaagctgccacccacacacaggatgcttttctctacttctgagtgtttatagtttcagtgattctgtgccttacaattttcaaggacagctcgttccaacctttgcgaatatgaagaatggtttttctaaattatataatagtgtgacctacagatagccttgggctttcctttcttctggctgcagcctttgctaggtacacatagggacatgcaccctgacaatccacgggggccccctctggcctgggtcctcagaatgagaacctcagcttttaggactcacaatgcaaggatgatcacgcttgctgttagcagcgcagatccagcgtaattttaaaagcaaaatgactgactacatagaaagaaaaaccacattgttttcctgtctccccatggaatgctgcctccattagagaaaaaggagaaaacccgattaggaaggatagaaacataaatggaactgtgtcaggccttccaagctgtcactgattattctaccaggcagatatttctcacctcccattcagggccatctcctgtaacagccatttctatagccgaaacaataagggataaattaggctggtcaatttgtcctttccctttcttgggtaaaaagaaaacgacttaactaaatcttttttctttaggatgaaaagagattttaaaaaacattctagtagcaaataactgtcctaaagtaggtaaaatgggaattgattttacttacctgacttcctagttgggtagttgggagcattacctgagacgggtctgtggcaacactttgtgacggccaggcctgggtggctattacggtcatcatcatttcaggaggcaaggtggcttcattatgcttcattcctacaatctcctttttgttcattgatgtgcattctcctgctttgacatacaaacccataacaccatgaaattttaaagcgaatggtaatattttttcatataggtaaaaaaagtatgagaatattccaatagaaataaccataaaacattctttctctttgtttgagtaacccctttcctgggtgtctatcctaaggaataatgtaaaatgtggagaattatttttttcagaggaagatgttctttgtagctttatttacatcattcacagtgtttataattaaaacagttgagagtccattatgattgaagtggttgttaaatgatggtatatctgtcttaaatattgcatagctaaacaaaaggagctggtaatgatagaagaaaatgctcatgatataatatgtgtattatagtctgttcttgcactgctataaagaaatacctgagatgaggtaatttataaagtaaagaggttgaattgactcatggttccacaggctgtccaggaagcagagtaagcagcttctgcttctgggatggcctcagggagctagcttccaagcatggcagaaggcaaagtgggagcaggtgtcttacagggcaggagcaggaccaagagagagatgggggaggtgctatacagtttcaaacaaccagatctcctgagaactctatcacgagaatagcactaggagggtggtgctaaaccactaatgaggaaaccccccgccgtgatcccatcacctcccaccaagccccctcctccaacattggggattacaattcgacatgagatttgggcaggcacacagatccaaaccatagcaatatgtaaagaatcaccctagcaacagtcatcaagatagcatgatacagcaggggagagatacatggatcagtggaagggaatagacaacccagagatacagccacacaaacgtgtccaactgcttcttagtaaagatgagaaaggaagtcagtggaggaaggatagatccttcagcaaatgatgctggagccattggacatctgaaggcaagaaatgaacctcaacctaaacctcactcttcatacaaaatttaactcaaagtggtccaggcccagtagctcacaactgtaatcccagcactttgggaggccgaggcaggcggatcacctgaggtcacaagttcgcaatcagcctggccaacatggtgaaaccgcgtctctactaaaaatacaaaaattagccaggcttggtggtgggcacctgtagtgccagctactcgggaggctgaagcaggagaatcacttgaacccgggaggcggaggttgcagtgagcctagaacacgccattgcgctccagcctgggcaacagagtgagattccatctcaaaaaagaaaaaaaaacaaaaacagaaaatgttaactcaaagtggatcacagatataaatgtaaaacactatgaaactttaagaaaaaagtaggaaaaaatcttagggatctaaggctaggcagagttcttatacttgtcacaaacaggtgtgaaccctaaaatgaaattttgataaattagactttatcaaaatttgaaacttttgctatgtgaaaaatcctgttaagagaatggaaagacaagctatagactaggagaaaatacttacaaaccacatatctgaaaaaggattagtatctaggatatagaaagaactctctaaactcaacagcagaaaaccccaatcaaccaaattaggaaattgacaaaagacataaacagacatttcagcaaaggggatatgaggatagcaaataagctcatgaacaaatgttccaactcattagccatgagggaaatgcaaattaaaaccacaacagactaccggtacacacctattagaacagttaatttatttttaaaaagcagtaacatcaaatgctggcaaagatgtgcagaaaccatcactcagacattgctggtagaaatgtagagtggtacagccagtcaagaaacgagtttggcagttttgtataaaactagacacgcacttaccatggaacccagcaattgcactcctaggcgtttatcccagaaataaaaacttatgttcacacaaaacctgtacacaaatgttcatagcagcttgattcatatttgccagaaactgaaaacaacccagatgtccttcaacatgtgaatggttaaacaaactgtggtttattcatatcatgaaatatggctcagcaataaaatgaatgaattattgatacacagcaacttggaagaatctccagggaattatgctgaatgaaaatgctaatcccagaggttgcatactatatgattccatttatatgatattttctttgaaaatgttatgtttatttttaatgtttgtgggtgtatcataggtatatatatatatatatatgcatggggtacattagatacagacatccattgtgtaataatcacatcatggaaagccgggtatccatcccctccagcatttatcctttgtggtgcaaataatgcaattatgtgattttagttatttttaaatgtacaattgaattattattgactatggtcacctgttcaccccgttatgctctcaaatactgggttttattcattctttctaattttttgtatccattaaacaccccttcgtctcccctccccaccctcaattaaatgaaaaattatggaaatggagaacagatcagtggctgccagaatgtgtatctgtgagggaagaggcagtctctgcaagagaggaagatgtggttgtgaaatgacaacacgaaggatcccagtggggatggaatggccttgtatctcaatggtggtgatggatacgcaagccaatacgtagataaaactgcaaaaaactaaatacacacacacacactctcacacactcacacactcatatgctcacacactctgacacattcacacacacacacacacacacacaaagtataagtaaaatggcaaatctgaataagatctgtggattgcataaatgtcaatattttaattgtgacattgtaccacagtttaacattagggaaactgggtaaaagagtattttttgcaaatgcatgtgcatctataattattgaaaaagtaataaaagtcaattaaaatatgtttatgcagttgtatgcatttaaaagactagaaaggatttatcgacattttagtatagttaactatccagtaggacattgagcatcttgctttctaccttttactttactttctctgccaggattttcctagtgagcatgtgttagttttgtaaagaggaaaaaaagcaaacctggttttaaaaaaaaaatcccattgccaagtacaacaatttacagcactctttttagtatattctgaaatagtctcctcatgatttctttctcttctgtactccaaatgtaacactaaatcacacacatgtacacacacacacacacacacacacacacacaatcatgaccagctcaagaataaatatgtggggactaagcatccaaagctcgacaccaacaatttgcagctgaagacataatgaacttttgttagtggatggaccagctgggaagactgtaaagttggatgtcttgttgtgctttctatttattattcagatctccagtccagtgtacagacagaaggtgcatcttgatggatagttcaaaagggtaaagacttagacaaaataatgagaaagggactatttggcgacatatttcatcctctccatcccactctgtggcttcctccctttgatgcacacataatttcaggaacccagagtgcaggattggtagaaacggaataaatatatagtctgttgtatgggaacaggctcagaagcctataaaagattcaactcctgctttcccttaggagaggtacccaaccagtattaatattttagaaatactggaaggtagaagaggagccattattcatcactggcaactctgtggtactaaaattaaataatggggttttttttaaagacagaattgtgaaagttgtgaaactataaaaaatattcctctcttggggatgttgcattttttgcttttatcttttcttcttctcttgagaacattttgatttactactgtgataagcttataacaactagggaacttgggagaaaagacgaggcaggctgggaggaggggtgttatggcagcttacaaatgggcccgggtacatttgcctggcttcaagtcagaaggtgctggagctgggcttggattcatttccattgtgtggcacacatatctcatgcatgggccagggacgtgccttgtgacagttagcacccacggtgccatgtgggcttgggatgtgagcatgcttgtctgctcagcaggaacttttcataaaaggtctagtcatccttttcctgaagcctggaaataatcagccctgctccttgaggagatgtctaagctgttaggactttgttatccaggagttggcatctgaccagcatctggagttttggattgatctggatgatttcagagtgttctgtacctgttcctccccctgaactagctgtgtaacccattggacaaatgacttcacctctctgggtctccttaactgcatttgtgaagttaaaaaaagcaatagaaaccaccaggtaaaatgcacacgtagctttagcacagtacgtggcctgcacaaggcctcagtgaatgcagttattacctaggatgccacttgaaaaacattttaaacccttttaatgataaaattactctccgtgactgttacatgttgtgtttcaatgcatactcatgagtgtcgttaacatttattgagtgcctactatgtgcctgccacggtacaatgtgctttagggatgcagttccattctgtcctcccgaggacctcaggaatgcaggtctattattcccaatcaacagaagggagaactgaggcttagaggggtgaaaagatttgcccaaggttaaaaccaagggcacattagagccagcgtacaaactgacccagaaatcattttctaaaccactgcaccacgggggcaggaatggtggctattgctcgggacctagagaaatgaaggcacagggaatgaagacgaatccttgctccacccatggggagacagtggctgggccagatttaagcagagatccctggacagcgcctcattccttacctgattcacacggtgctgatacgcttgttcagggctgcctcaagcttcagactcagagtcagaagggacctcagagtctatgtggtgctgatggtctttgtaacgccttaacaggatgagggtgtgagcctgggcgctgggtggcagccttgtccatcaccagatgagcttagcaccgtcggccaagttttcaaccccaggaagcctgcctccttttgagctgaaatctgtccattccatagcttgcatcgattggcttttctgaaagttaagactaaaccagtctccttttctgctggtctttagatgatacccaaaactgtacctcgtgttccatgtctctaagcattcaaccacttactgggttgggctgtgctcatcttacacagaacagatctcctcacttttctctcaaatgttttcctccttagtcccctgtctacacgtagcctctatccatccctgtatccttgtgggttagaattcaccacacaacatgatctcattaggagtcatcacctacaaagcaggtattgggcaattgtgtttacccagggtcgttttggggaatattagtaaccgaaacttgagaggaacttaaatctacatataccacccaccaaagacttgcatggatggtgcagtttccgaaaaactttgccaaagcatttattgactcacagctactatgatcttctcttgttgagcttcccttagggaaaacaacaacaacaacatattttaggtagccagagcttcagaggaagagagatattcatccaagttgatctcattgtatccatgagcctgttaattttcagggagcaagattctctagtcttaaaaatgtgtgtgtgtgtgtgtgtgtgtgtgtgtgtgtgtgtgtgtgtgtgtgtgttattgggatcttttaactaggagaatcactcagaatgactctgttggaggataccagaatatctcttggaactcaagcccaagaagcagaactggtccttaccagaagttggcaagccattttgaaaccagggtagctgtgcctgttcattgatttatgcattcattttccttttttcctgaccatatggtctctcatttcagcttgtcttagcatagcttctttatttattaaaaaatatttgagtttctactatggaccatgcactgttcacagcagagaacaaaatgaaaattcctgctagcacagtttatatttaaatggtaaatagagacaacagatataaatatgtcaggaagtatgtcaggtactgagggttcggtgaagaaaaataagacaaggatgatgctggaaggaaaggcactactttctttcaataaggtggccagggaagtcctctgcaaagagatgagtataaattgagatttctgtagcaacaatgtaatgagccacaggagacccatgtggtaaggtcctggcgaattcaagccattaccagacaccactgggaaagggggctgggatacttcagtgtcagagcataatttgggaccaaggctgaggaataagattgagtaacgttggctgggcacggtggctcacgcctgtaatcccagcactttgggaggctgaggcgggcaggtcacgaggtcaggagatcgagaccatcccggctaacatggtgaaaccccgtctctaataaaaaaaaattaaaaaaaaaaaaaacacaaaaaattagccgggcgtggtagcgggtgcctgtagtcccagctacttgggaggctgagacaagaatggcgtgaacccggaaggcagagcttccagtgagctgagatcacgcaactgcactccagcctaggcaacagagcgagactctgtctcaaaaataaataaaaaagattgagtaatgtcagagaagattatttaccagctgtagggtggtgtcaccatgtttgagcctgcatgggattcatttacacaagcattaagaactctatttcagttttccctgtaggctgttttctttgccaaggtctctgctaatggccccatagtgtcccctgaaaatggcggactcgactttcaagctggtaagacttcaaaggtcctcagtctctccctgtcccaatcccaggcttccgaaagaaatgatcttgccaggctcagctttggataggacgctctgggtcacaaagggcagcccgggactgacatagtgctaggcccaagcatggcgcttttggggaaaacggctgcaaaataggatgaggggatgtggacaaactcagcaaaagttgatgctgaagacagaggcagggatatggctataaagagccttgctttcctgaggggacttgaatttttcctgaaatcaatggggtggggggccctggaaagattttaatcagggcatgatccaattggaagagacagtagcggcttcacagagtgagaaacctcaaagctgtctacacatccttccaatgaaggcacatgcaaggcagaacagaatgtcaggatttcggatgaaaatcatggaaattttatttatttttgatactatttacatttccaggcatcagtcttcatgttaaaatttgtcctgaatgataagaataataagagtaagtgttaaaactctcagggaaagggcagtcaacgtgaatttccagccagaaagtcttcagttgttcatgttgattactagcaaatgggaatagtgccaggttcataatgctgattttattacattactttctctgaactctggtttaaataagtgcgtaaatatttggtacagggagataaacattgagtacacatggacataaagacaggaaaaatagacactgaagactccagaagtggggagggatggggtagggcaagggctgaaaaacttccttttggggccaggtacagtggctcacgcctgtaatcccagtactttgggaggccaaggtgggaagatcacctgaggtcacaagttcgagaccagcctgaccaccatggagaaacccatctctactgaaaatacaaaattagccaggcatagtggtgcacgcctgtaatcttagctacttgggaggctgaggcaggagaattgcttgaacctggcaggtggaggttgtggtgagctgaggtcgcaccattgcactccagcctgggcaacaagagcaaaaccccgtctcaaaaaacaaacaaacaaaaacaccaaacaaacaaatttccttttgtgtactatgttcactatctgtgtgatgggataattagaagccaagacctcagagtcatgcaatatacccttgtaacaaacccacacatgtaccgccaaatctaaaataacatagtaaaataagatttaaaaataaggccaggtgtggtggctcacgcctgtaatcccagcactttcggaggccaaggcgggcggatcatgaggttaggagatcaagaccatcctggctaacatggtgaaaccccgtctctactaaaaatacaaaaaaattagccggctgtcgtggtgggtgcctgtagtcccagctacttgggaggctgaggcaggagaatggtgtgaacccgggaggcgccactgcattccagcctgggtgacagagtgagactccatctcaaaaaaaaaaaaaaaaaaaagatttaaaaataaaaaataaagcaaaatctatacactaataaaaaaatttggtttaacctttccctgggaacagtaatggtctgaaatgatggaaagaagaattgaacaactccagggaagtgaagtttggcaagttagcaagagagtaagcatgtatagttcaacagcatccgagggcatgattaatttattgtccttttagatggcagaatgcacacaaaacccttcaaattacaccattattatgacaaagctcagggggtgtgagaagttaaagatgttcctgccaagagtttgatgtacagaggaaacgggcaacccactggatacacataaatctggaaatcgagactttgaagtccctcgtcctggctctgccactgacatgggcctgagatgaatgttcctgggccatgaatggccatgtcacacggagttccgattgggagctcttccatcagtgtcgggctcaatgccttgttgggtctactgggttgagtgctcctacccaactcaggacacgcttatctgttgcccctatgaagtatgggtcaagaccatgggctctgggggatttggttccaatccaaaatctttatctagcagactttggcaaggtttgtgggactcagtttcctcctctgtaaaacagattattaccaatacctacctcatagaattgttgtgcctgtaaaatgctaagaatagcatgtgccggagtcagtgttcagtaaatggtagcagctgtcattgtcatcatcaccatcattttaaactgttgagcatatttatgtacctaagcatttcctatgtctcaggtcattcactcaccatgagcctttccattattttccattgtgcagaagacaggagtgaggctcagagaggccacacagctttctataagtccacgttgtccgtgagccctgaactgggatgcagatgcgtttttatgtgtctctaaaccctgctctgctaaatactgtgtgtgttaatcaggataggttaggctttggtgacaagaaaccccaaatttcagttgatcaaaaaaacaaaagcttgattaagctccatgccctcagaaggttaggtgggaactgtgttcctcgttgtcattgtcctttctttgggacccaggtccatgaagtcactacaatttggaacattgctggtcaccatgaggaaggaaaagggaatgtatctaggcacactagagttcctaatgctttcgcccacaattaactgaagtgacacatatcactttcacttacacttcactagctaacgcaagtcccatggccacatccaggtccaaatggccaaggaagaacactgctgtgtgcccagaaggataggagcccacaggggctgaggcagccaccatgattactttctgataccataaatctgatctgtgaatagaagagatgggaggtacaggagatccagggttttcaccagagattccaggagccaccttgacttaaagcagaacaaccaaaggcaaagccaaggagagtgttttcaaagggctcagtgatcaggagagtgaaacacacagcatgcattaagaaatcagaaattcagaaagagacacttacaaatacctagttattcactgggacaataagggatgtaaaattatggtactgattggcaatttggggggtttgggcccagcaaataaaatgcaatgattgaatgacccaaagatgactcctcctcctccaatctgctgaggcatctttcagcgcatctcccatgttatgtaaaatgaggttcatagagtttattgagcagtggtcccttgaaggccatgagtactctggaagtcagaaatgatcaataagtattttgaatgcaagaaaagaagttgaggggagatcatatgttacaagaaatggtgcccaagaggaaaaccttttttttttttttttttttgagacaaagtcttgctctgttgccaggctggagtgcagtgacgtgatcttggctcactgcaacctccacctcctgatttcaagcgattcccctgcctcagcctcccaagtagctggggctacaagtgtgcaccaccacacccagttaattttttatattttactagagacggggtttcattatgttggccaggatggtctctatctcctgaccttgtgatccacccgtctcggcatcccaaagtgttaggattataggtgtgagccacggtgcccggccaaaggaaaacatcttattcaaaatcatgagagagaaactgaccatgaggctgagcgaatgtcagtgtaggttgggatatattattaacaggcatagactgagctcttacagtgagaacagccttgtgctggttacatatttcattacggggtggcctggtgtgctttgggaaggacaggcatgaaagggtgactcatacatggcctatgggtcctatgaggaaatttacctcaaccaggggaggaggactttcggcagcttttcccttctctctctgtctgcttcttaatatcacaaccatcttctcaaaaacaaacacaagtactgattgcctacgaagccctctggccgtgatttctctgacaatctcagaattcacctaagacttccctctgcaccatctcatgctatcttcatcttcatctcatgaaggttcatattgcagcttctcatgcacatctcatgtccccaggccaaggggctgggcatgagatccactgcacacctcctccagtgtcacccatgacgtgctgcaatggcagatccctgaggagctgtgccctggatctcatgcccagctccaagatcagcatgccaggcattctcacatgcacccgacagttttgtccttttaggaaaatgtcgagatacattcattcactagatgacaaatgtttgaggaatcactgtgtgccagaaactgggtttggctctgtgggataccagcgaatacaatcagacgtggccactgctcctaggaccacagagtctaatcagagagatggctcttaaaccacaagagttacataacatttcaacagttgtgttgtgtgggtgagctagaaaatttcaaaattatatactggaggaatttgacttggggggacccattattttctccaatcaagagaccaaggacactgaccagagtatttttctttacagagcctcctagtgcctacaattcacaaaagggccttgaccttctctgtgcattcaaaccacagtaggttaaacaaacaaacacattaagggaggactggataaaatcacctgtactcagactaaaatacttcggaatgtgacagatctggaaagcaacataaaagcaaggacatagaggatctgaatagtttaatcagttaatactagaaaagatagataaatatggaactatgtggcctacaaagagaaaatactattttttttaattgtggtaaaatgtacatggcagtggcattaagtacatccacattattgtgcaaccatcatccccatccatctccagaacgttttcatcttcctcaccttaaactctatacccattaaatgctaactccccattcactgcctctggaatcctctgttgcactttctgtctctattaatgttacaactccaggtgcctcttgtaagtggaatcagacaatatctgttcttctgtaactggcttatttcatttagcataatgtcctcaaagttcatttgtgttgcaataggtatcagcatctccttccttttaaagtctaaatagtatttctttatatttacacacatgtagacacatacaatctttacatatgtacacatataggtacacatacacttttttaaatccattcatctgttgatggacacctgagttgttcccacattttggctattgtgagaaatcctacagaatgcttattctttccgtgtgtctatgggtcacttagtaaagatgatattgcacctggccaataataagttttaaaataacattcaaaggtagaactgttattagccacattagtatataattatttggaaaaaaataaaacccctgcaaatacttagaaattaacaaatactctccttaaaaaaaaaaaaaaaagactgaagcctagtgaaaataaccagaaaaaagggcacactctcagaaaataatgcaaaaaacccaacaatgaacattgacttccttagagctcagtttaagttagacttaagcataatcttaagagtctgctatataagaaggaaaccagactggcaaaatgaccactaaaagatgaaggatctggatggtagattcagatcccctcattgtgtgttgctggagttttatttttcttcccaagtgctccatcttgcctgtaaccttagcgccttccctgggatgatgggagctccatttgaccttggtgatgaacacagacagccctaggtggcgtgagcactgctgattgataaggtgggtgtggagcttctgtccttctcagtggattgcgagaactttggctccatgtttcttcaccagggtatggggactcttggccatgagctttccttagttccctggctaatttatgacctagaggttgaacatggttgagcagcataagggtgagagaaaagcatggtactccagctacccagactgctgaatggctgtgtcttcaatttcaaaggcatggcaaggactaacccacagctgagaattaattaatgcttacagattaccttacagaagcaatctaatgataaaacacaaatgcctctgaacagctataggtaaaggcaacagtgtttttttttttcctatttaacgtagagtagaaaacatcttctaaattagcatatgcatgtaactccaataattcctcttacatgtttttaaaagttgtcttttcctgtgtaagtaatataggctcattttataaaactgaaaatattataaggtgaaggaaaaagtattacacctaccttcatcctctaaagaccagtgctgttcacatgtgatttgttcgctttggtagccaggaaggaaggtctaattatttcctagttttgcacccttgtgataataatgcatatgtatagttatcatcctctgaaaatgtgtcccttgattttctacatagaggaaaactaggcgcatcaatctggttggatgtgacagggaaagggtactagaatttatttatctagaagctgccttgcctcacaagcagtgttcacttggagggtctccatttaaagggacccctgcaaattataaggatagggagggtattaagtcccttttcaactcctaagcattaccactgcctgggaagttcactatggggatgttctgctgaacccctatcaactccagtgggggtggcagcaggttcaagatgccaaagaggagacctggagccagcgatgagacgaggggttttattggatgcttccatacaggggaatccagtggtggcaggctgaacaggagaaccacaaccacctgtaaaaggcatgcagtttatatagcattttcagttagcaccctttccctaacatccttcacctggcaactttcattccacctatgagtcagggcctggatctgccgtccatgttccatgggacaggccaggggttcagatgttcctcatagacaaggaaggagcctccaggtcggccactcccagatttcctagcttggaacagacatccgggtgcatcctccacacagagtcattttcagggtatgcataagttattgctatcaggtgcatttaccatgcaggggaattgtaaaaagagaaataaaggtctgaaaatgtgtctccaggtaaagtggctgcattttccaagaaaaagaaaaaggaggtttgtatgacagaccttatttttaatttgtgagtttatgaagcattttataatcatataaaaacaggcaaataaagttgtacttcttcactcagagtgttaatcaagtgtcttctatgttccaagccctgggaatgtgaaagagaataagaaagcaacagcctgagggacagttaccaccacccaccaagaggcaaggtgctcccctagctttaacagaccttgcaggcgaggagggctagagctcaggtggatgaggttaagtctgcatggagtgggcaggagaaagggtcaggggaaggttcagtgggtaagtaatcgccggcaccaagtccaggaagatgagggcatccccagcagagtaggtgggggatggccatccagctaaagaaaggcacagctcagagggctgtgcctcatgctgggttgtggcttcggactggagaagcaggtggagacccatcaaagaagagctctgagattttaccctctggcagagggagccattgcaagttttcatggggtgttttttgtttgtttgtttgagacagagtctcgctctgtcatccaggctagagtgcagtggtgtgatcttggctcactgcaacctctgcctcccgggttcaagcgattctcctgcctcagcctcccgagtaactgggactataggcgcctgccaccacgcctagctagtttttgtattttcagtagagacggggtctcaccatgttggccaagctggtcttgaactcctgacctcaggtgatccaccttcctcaacctcccaaagtgctgggattatgagcatgagccactgtgccaggccgattgcaagttttcatatgggtactgccccagtcagatgtgggtttgcattttagaatgaccattctggttgcaattaggacaggagatgggataaaagagaaatcagaaacatggaggccagggaagagactacttaatattcatttacgtattcattatgcaatgtttatttaaaagcccaccacgtacggcatactgttctaggctctgaggacaaagcagacaaagtagctacttgagatctgggttaaggagcagaggatagaggttggcagagtgtgggaggaggacaatgacttgcagaacttggcaactctgtcattctgatacttcaaattcattttctatacaaggaaaaaagagtaaccgattaaagtgcaattcaagaaagtgagaacctacagggaagtaccaaaatatacaacgaaacgccacagtcacacatggcagtgggggatcctggattggattttggattaaaaaaaaaaaaaggttactagaggccgggcgtggtggctcatgcttctaatccgagcactttgggaggccgaggcaggcagatcacaaggtcaggagattgagaccatcctggctaacacagtgaaaccctgtctctactaaaaatacaaaaattagctgggcgtggtggcacgcacctgtagtcccagctacttgggaggctgagtcaggagaattacttgaaaccaggaggcagaggttgcagtgagccaagatcacaccagtgcactccagcctgggtgacagagcaagattccatctcaaaaaaaaaaaaaaaaggtactagaaaaactgatgaaatctgaatacataaaatctggagtctagttaatagtcaagtatcagtgttaatttatcagttatgaccaatgttccatttttacgtaagatgtcaacattaggggaaattggatgaagggtacatgggaactctgtagtatctttgtaatagttctgtaaatctaaaattaccacccgaagtttataaatgaatacacacatatacacatacaaacctcaacctcaaccacattgagtagaaataattgtataattcatatataatgaccttatttatgtaaaaccactcaaagctgctatatagtctatgagttcatatgtatgcaaatacattaaaaacacacaccacattgtatcattcattacagctgagaatagaggtaggcatgggactttgcaggggaactgaatggaacattggctttgtccatattgtgtcacatctgtaaaaggcataccgtgagaacacccttaaaatcaaatcaaggagtcactacctgctccaggcctcagtactccctgcccctgcccggatgcagaagacactggtcccagctatgcgacgcccacctcccccccccaaacagccagccaggaagtctctttacccaggtatgaggcaagactcctgtgtgctatttacatgcccttccagagtgttgacaccaggggctcatgttctttctcatccttagctattttttccattccaactcagaggacaagaaaaaaaaacatcccactgtgaaaagaagtgtggaattacaaagaataataggaagttctcgctaactgtgaagccctgctatggagtatataatgggccttaacagctgctgcaacagtcgagactcgtggcagggtttgctttggccagaggagtgcactggatttcttatatttcttgacattaaacaacaacaaagggctgcaggctcagctgctgcagctgtggagttcccaggagttgagcacagcataatcaaggtggtctggaaacacacttgatttgcatggagtggttttgaagcatggctgagtgtatccttgggttatggtcattgcatacctcccatcccccagttcgtgaagttggaatatgctggggtccctctgaaaacccagctaggcaccaagaagccagagaggtggtgggtaattcagaagggcttgagcttcctcctggatctaaactaagccaagacactgagctttcccctgaagagggactttccccactccactttcatgctttcctcgccaagcttcctccaagccatggggtgcctttaacacacgtagagatgttgcatctagtgactttaagaaaaaccaactctgctttctgaggtcttagaaacaggtttttaaaagacttcctgttagtgttatatgtttaaaataggtctagaaagaaggtggcaaacagacccagcctatttttagcagagggctccaaacagtagcggtggaaaccagcatcagtgatactcaacagggatggtgctgaaagctgcccaaagcagtggtcttcaaacttgggtatgcgtgagaatcacctggggaggggggattgttaaagctcagattgccagcaattctccccctaccctgatttctgatacaagaggcttgggggaagcctgggaatttgcgtttttaatgagttcccagtgatgctgatactgttccagtgaatcatatcttgagaccaattagtctagagaaagcaaggcccctactggaagtgacacccaccatttccctgtgctggtggtcccatagggcctctcactctgggaacaccattcttggctgtgggtgtttcttcaaagtgaacatagctctgaggagcaggaggcaggttcagcagccacatccttaagaacataaaaagttgaagagagacagaagagagacagacgtgtgcagtgctaagctggggccctcacaatggggactggcttctttcctggggaataagtaatttcaattcagcagcaggagccaactcagctaggtcctgcctctaagacctttgtgtctgtaccaccaagtggctcaagctctctgagagagggcaagaaaatgactgagacccacccttggcagcagaagggaaagtcaccctgggataatttctgggtctagaattcagctttctgtgccgagtggcaggcagagaaacgggagggtggtgatgtttgtcccaagaggcccattcccccaccccctccttgtttcttctagaaggtctgggtgctgtgttcccaactttttctgagcagagaagggtcaagaaaagataactaacagcccggaaggcttttcctggcaggtcttcaccagcggggcctgtgtctggcagatagatgggtcagagaagcccattcttgggaagcatgattgcttcatagctcttgtagaattcccatgttcgttgctcgtcagaatgcattgtatgttaatagaatcttcaaaaaggacctgctcatctcaggtgtgcttaggagaacaagaggaaggagttttaatccatatttgggcaaaggtggtaatgagaggtgaagccagctggacttcctgggtggagtggggacttgcagaacttttcttagaagaggatggtaaaatgcaccaatcagcactctgtagctaggattgtaaaatgcaccaatcagtgctctgtagctacctagaggtttgtaaaatgcaccaatcagtgctctgtaaaaacgcaccaatctgcactctgtggctcgctagaggtttgtaaaatggaccaatcagcactctgtaaagtgggccaatcagcactctgtaaaatagaccaatcagcaggacatgggtggggacaaataagggaataaaagctggccacccccaaggcagcagcgacaacctgctcggatccccttccacaccgtggaagctttgttctttcgctcttcacagtaaatactgctgctggcagagaggggtgaagcaataatgaccacagtgacagagaagaggtgagtgtgcttggtgaccccttcccacgcagggagctgtttccagagcacttctcttctgggaggcctgtgaattttgttattaaaaaggaaacctaggccggacgtggtggctcacacctgtaatcccagcactttgggaggctgaggcgggtggatcacatcaggtaaggagttcgagattagcgtggccaacatggggaaaacccatctctactaaaaatataaaaattagccaggcatggtggcgtgtgcctgtagttccacctacttagggggctgaggtgggagaatcacttgaacctgggaggcggaggttgcagtgagccgaaattgcaccactgcattccagcctgggtgacagagtgagactctgtctcaaaaaaaaaaaaaaaaaaaaaaagaggaaaccacctattccctcagaaaaggatagagataccattcttacccattaacaacagtgtaattttattgtgatgattaatattggaattattagctttgattaactgagctccttctgtgtggcaggacatgtactttatagatgccatctcattaaaccctcggcaatgctgggaagtaagtggtgtcatctgcactttaaagatgaggcgatggaccgtgttcatactcacacagtggatcactgggaaagctaggattgcaacatatagctgtctaatccgtggagttcattctcgctacttgccagccacagggatccaatggtgagcccagtaagctgtggctcttgacctcatggggcttccaggcagcaagtagaggggtcagtggaaaagtatcagttggattaatcaagtcaagcaatgactgaaaattattttcatcagagagtatcaaacacctctttttttttttttttttttttgagatggagtcttactctgtcactcaggctagagtgcagtggagcaatcccagctcactgcaacctatgcctcccagattcaagcgattctgctgcctcagcctccagagtaacagggattacaggtgtgcgccatcacgcccagctaaattttctgtagtttttgtagagacggagtttcaccatgttggccaggctggtcttgaattcctgacctcaagtgatccgcccaccttggcctctcaaagtgctgggattacaggcatgagccaccacgcccggcccacatagtttatttttaattttcttttgtatccaattttcagttactcttaaaaatacaaacatatgtaattggtgtttagtcaacactcagtgtattttaataaacaacattttttaatcggaaaaaaaaaaaacctgtaatgccttgagtgatcctgccagatgaaccctggcgtaaagttcatgctgccttaggcaccattgccacctggtgtcagacatcggaattgcaggcttggcggcagctaaagtggcgggggtggtggggtggtggagcagggggcgggcaggacccattttgattaggagagggcaggtttcctgtcttagccacctaaaccctccaggcgctgttgagtatgtgtcaacaggtgcctgttcgtttgtaatttggtgacagctagatctgtatcagctttcttttatctgtgtgtcctgaatgattattgtgttcatgacctttcaattgttttgttataatcaaattaacgtttgaaggttctgatgataaagtgacataaatatagatgaatacttgagggtaaactctagattccacttatgccaataatagttctctttagttgcacatctacataaaaagaccaccccccatactttgaccccaactgcttctcagcctaaccctctacatgcttaagcatatgccagtaactcacgatttgcaaaactttccagactcttccttgtctgcctgctgcctttgtctgtgctgttccctctgcctggaactactctcctccacctttcccttccaaatttattcttcaaatgtcaaatcaaggtcgacaatttgtaggaaaattccataaagtaaattcagaaacgacagtgttgtatgttgtattgcagtgtctctagagaatggaagatgtggttctgaacccatttttatctctttcatagctttggccatggccagcttgctgactcattctatctcagtggtttcatccattaagtggaaataataatgtcctctgcctccagcattgaaatatatatatatatatatatatatatatatatatatatatatatatacacaaccctaatttgaggtttatatataacatatatattttatttattatatatatttaatacatagggatttaatatatgtaatatttaatatatataatggggtttaatatatataatatgtagggtttaatatatatattaatatataatacataggggtttaatatatataatacataggggtttaatatatatattatatatcatatttaggggtttcacatatataaaacccctaaattgaggtatctatatataatattgatgcatatatatttaatatataggggtttgatatatataatatttaggggttatatacatattatatatataagccccctaaatagatgtgtgtatgtgtatatatgtgtatatatgtatatgtataaaccttttctgatgagacaaagtgcttcctctgcaccatgcctagtacctagtagaagtgacagggcaggtgacactggattagtggatatatgtaaatacctggaatcttgatcaatgcatgcgcagcaaatggcttccattaccttttttgttttgtttgcagataaatatttttttgaaaaaaatatatttcgtggagttaaaaataataaaatgtccaactttgactgaactggcattattgccctccttgatccatcactgtatgtcacccgagtgctggtaagcttcctcagctgccagctgcaaagacgtggatattaggatgaaaggcgttaggcagtgatgctatttctggtgctgttactttagtcaaatctgtgttcaccaggtacccatgtgctggcacctgtgattagtgaattgctcatgggagtatgtttgcaatgtgctttctctgtgttttccaggcagttttaaatgtctctctgtttttctgactaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaagtgagtacccctctcccatgcccaccctgtgcgcagaaatgtggctttcaaagattgttttcttcccactgagctcattatttctgtgcctcatcaaacccgggactgcatggctttagggtgtttctgtgggagctgaagtggatggaattgaaccctgacagggcaacagtggggggtctttatctcatcagtagagccctccaggcctgcatcagactttgggtaccagagaccaagaagggagaccctgggggcatctcagaggaggtcagaacccttagggcaactttggctttccagagaccagcttgatgatctagagctggaagaggtataaaccccaagacctgatataattagcaagacatggtccttagggtgaaaacagttgctaaatattcagccataaaggagtagttaaattatggcagattttgcaaggcagttttctctagccatttaaaatgcttctgaagaagttgtgttatatgggagagattcaagatattgaatgaaaacaacatacagacacatatggtatcctcattaccaatggagtatttgcacatatcatgaggtgtatatgtttaacaaaaatgataaagaaaaatcagtgggttaatggttgtatttggaagtgattgattgattgattgatttggttttcttacctacttaaatgcattattgtgagtttgaagtgagaagatactataagggcgttggaggcataaagtgctggacagacatagagcagtagcatgatggtaggtagtaaagtccccaccctccagcagaacccttactgggcaatgcgctcaagggtctcaggccctgggaggatgcgggtgctttccagatgtccatctcggaagccttgccaaagccttttctgagcatttgctgggggagtcacctgtcaatgagaactgaaacgtgagccatgagtcccaacttatactcaagggggaatcaggtagttgtataaattgaatgttggtgacctcagaaatacccagttccagctggccttgacagtaaccagaggtgacctggcagctattggggtccagctcctgtaggaacaaccagcagcagactatggatagatgccctcttgtctttctgtgcccatcatgggagtctccaagaaagttctggcacaaaaaactaaggaaagatacaataaatttcataatttcttaacagagtgatcaagagctgtgggatctgatatggtttggctgtctccccaatctcatcttgaattgtagctctgagaattcacacgtgtcatgggagggacccagtgggaggtaattgagtcatgggggtgagtctttctcgtgctgttctcgtgatagtgaataagtctcatgagatctgatggttttatgaatgggagttcccctgcacatgctttcttgcccaccgtgtaagaagtccccttgttcttcctccatcttctgccatgattgtgaggcctccccagccatgtggaactgtgagttcattaaatctctgtcctttgtaaattacccagtcccgggtatgtcttcattagcagcatgagaacggactaatacagcatctgagatcctccattcaggtctcagtgctgctgcgtactgagctgtgggaccttgagcaacactcttaccctccctgatcttgggattcttgtccataaagtatgattacagctaacgcttctgaggattataaaaaatgaaattactagtttttgctaactagtaattgctaaacagctaataaaacagagcttcggttgcagcttggagcttcccatactttttaaaaactgaggccatataatattacggtagttaaaagcatggattctgcacacagccagattggctgcattcaaatcatggctatcatgtactaggtgtggaaacttgacaaattgtctgcctcaacttcttatcctggaaaatgggaaaaataataatgatgtcataggatttcataaggattaaatgagttaatacatatgaagcatttagaaaatgctggaaacatagtaagcatcatataatcttcctacatgggtgacaataatcaatgatattaaaggtgaaggaaggtaagtgaaaacccaaaggattccaagttatagcccaatctctcatgtccagcacaaactttccttgagtagtcttgagtttttactatacttttatagtctatgtcatagcatatggattgattgagcaattcattcattttacatacatttaattgagtgcttatagggtaagggacacgcttcaaggtgttcggaggatacagtagcaacaagacacactgggttccttgctttcatgtatcttttattctagttctttgtttcggaataaactggcttgaattcctctcttctgtgtgtaggtgacatggcaggaagttgtgcctggtttgtaacatggcttgttgataacaccagcacagggtcatataccctcattggaaagggtactggtatttagtgggaatgcagtttcttacacaagtacttgggttacttacgactggcagactggggcccagcccttggcagcgcactcttcaatgggctcatgagggcctactttctgatgccgtttccctccgtgcttcatgcacttcagttcggtcattgtcctgttttcatcatacccgcactgaagcttcttacagttgctgaagcttcttccttgaagaagcaagtttgaggaagagccccgatcattctgcggttctttatttttagatgatgagaactgggttactctcatgttggtctactttgggcacaggaatgttgcaatttccgttcattccaagtgcctgtttaagaataagttactattttagtagtacagctagatccatggtattcatggtagtcaacacggttgggagcaaatgtggttcttcaaagaggagaatcctgggtctccaaatcctcacattttagtttctagtcttgcaagtttaaaaaggagagagccgggtgcagcacaccaacatggctcatgtatacatatgtaacaaacctgtacgttgtgcacatgtaccatagaacttaaagtgtaataataataaaaaataataaataaataaaaataaaaatagaaaaacagagcaagaaaaaaaaagaaaaagaaaaaaaaaaaaggagagagcctgcaggtgaatgtgttgtcatcataatagcgccaatgtttctgttgtttaaagttaagtgctgctcacatgcaagtacgtgttgatgtattaacgttttccaaatccaacaagaaatattttgatctaaacctcagggatttgtatgataagaaataatctggaatacatttgtccttgggcccctgaaagtgcatcaccattgaagctcctgtttattgaacactgcatggcagatattatgctaaacactttgtataattctcttatttaatccatttcacacaagagacttaagaagtaggtgttaacaccatttcacagataagcaaatagctgttaaacaactttttcaaggtctcacagctggcatgtattggatttgggatccatatccatttcttttcagctccaaagccccacattttcaatcactaagaaacactcttcctattttatccccagctagattttatatctaatctgcaaattccttagctcctttcctaggaactctgcttaccggggctgggaagggagtttggctggctgggtgatctattactttttaaaaaccatccatttccgtgacccactgccatcttgccactcctccctgccccagcccccagaaaaacttccccagcttctgacccaaagtagcacctggcaaaataatttatctcttgcagtattggaagctgacatactaatgcaaagcctcctgaaatattactcattattatgcattttgccagcatttgagtgatatgtgaactcttcactggaataaagtactgtaaatgattcatgaatgaccaagtttatgaaattctataaaaatattagcaggtggtaatgattccctcacactgtgaatatgatctactggctgcaaatttgccaatatgggatgacgggagtggagtgggagaccatctgttaggcgagtgggggaggaagacggtgggggggcggttgggatgggctctgcaggaggtgcagggcaaaacaggaagcatggccaagaccatggtagcaggcaggtgtccttggcaggagaccttcacactgatctgttgtccagtgggagatgctcagataactgggaatgtcagagctgggtgggagaagagaggagcatatggaagaagaggcaaaactaactttattgagcatctattaagtgcccaagaattccctagatccctgacatacacagacctatgaaaatggttatcttgtcttcactgatgaattagatgagggctaaacaggttcccaagatgtatttttactattaatgttggggtgaacatgtcttgaacatttacagtgtgccaaggctccatgccaaatactcagatgatggtctcatctcatcttcataaagataaccttgatacgtctatcacactcaattctagaacaggtaactggaaccacctgtgttcctggcctcagaacatggaaaggacctcactgccaccttctgagtatttgctcacatttcatactatataacttgttcttttttgagccaatttcttggtcaagttttgaatttgtggtcaagaatgttgtcataaaattgaaatacaactggcattcagaggtatccttgctcatatattttcttttgttaatgtggctctacccctattctaacccatctgtagctccatgacaatttggcagaatacacattaaagtgaaagctgctgccgtcatgcggaaataggtgtatcataatgtcagtgcttataagacgattgggagatatagatgtacccatattagagagttatttaagtgattaacctggttataaaaacgttcatgttatgaacaaatgatgcacatattaccttgatgggattgtactacacctgattagacttgtacttggaaaggaccccagccctcactagtagggacatgctatgtaagtcttctttgtcctctactctggtctcccccattgctacctttcttagccagggttcttggtggcagtcaacaaaatcacctccaactagtttacaaaggaagagatttattaaagagtacaggtagccattaggattgcccaaagtgccaagtaacctagctgacaaggccagatgaggtggtgctacaggaaatacccacatatgaaactattctagggcaaggtttttcaacagtggcactattgaaatttgaggctgggtgattctttgttatggggggctgtcctgtgaattgtaggaggcttagcagcaccaatggcctctacccactagatgccagtaccaccaccccccacccacacacacacctaatctggacaatcagatatgtctgctgatattgccagttgtcctataaggggcaaaattgagaaccactgttagagagaagtgtcatagtccattttgtactgctgtaacaaaatatcggagcctgggtatttataaagaagagaatcgtattggctgtcatttctagaggatggacaatccaaggtcaagacaccagtaggtttggtgtcttgtaaggccattctcttcttgcaatatggtgcctggcaccttgcaccctccagaagacaggaaggctgaattctcatatggcagaaagtggaagggccaaaagacagcacctattcctgaaagccttttaaattaaggcatcaaacctacccatgagggtggaacacgcatgctctaatcacctctaaagggccccacctcccagcaccattacattggctattacattacaacaagagttttggaggtgacaggcatttcaaccatagcaaagagtcaaggtcgctgctggctcttcctgccactttgctctgatgctcacaactggatgtggcagccctgcttgggttacctaaaagagccaggtgactttgccaagctcagaacctctgatctgcaaagcacagctgtggcctcccgccactcacttccatccagtctcacgctggtgcatctgcaggaagaacctagaccgtaagcaggactctaggtgcaagagagctgggtcaacatagtttttagtttttccagctccctggtacaggaaagtccgcttgccagaggactggagtggtggttgtcatctaccacattgtgatgacatgagtgcaatttttttaattccatgggtttttggggaacaggtggcgtttggttgcatgagtaagttctttagtggtggtttgtaagattttgctgcacccatcacacgagcagtatacactgaacccagtttgtagccttttattcctcattcccttcccactcttcccccttgccaagtccccaaagtccattgtatcattcttttgcctttgcatcctcacaacttagctcctaattatgagtgagaacatatgatgtttggttttccattcctgagttacttcacttagaataatagtcttcaatcccatccaggttgttgcaaatgccattaattcactccttttgacggctgagtactattctaccatatatatatgtatgtatacacacaccacagtttctttattcactcattgattgatgggcatttgggctggtttcatatttttgcaattgcgaattgagctgctataaacatgtgtgtgcaagtatctttttcgtataatgacttcttttcctctgtgtagatactcagtagtgggactgctggagtgcagttttgttccaagtgagagcctgtcagtgagaagcttagttgcccaaaggcaggtaacaggcttacacctaggagactgtgttctcaaacctgtgatcttcacttctgtcatcattagggtcctatcaatcaataacacacatgtgacctaggcaagagccctgagtgggacaaaacaaaggatttgggttaaaagcccaggctttggagccagacctacggagggaagaatctcgactctcctatcacgtgaaccatatgaaattgccattcttacaggtgaaaaagaggtgaacattggcaatttcatggttcattctaatactctgacacctttagccagttacttctcagcctctgttttctcatttttagaatgagagtgagattacagtatcatctcctaacagtgttatcattagtgggtgtttatcactcagcccagtcacttagtaagtgttccggaattgggagccagcctgccacatatcggttttatagtttaagctccctgcaagtacaatggagttgaaagcacttgtgagggagcagctagcaggtaaacagttgaatgtcagtaactctctgtaaaagggaatcatctcactgggcagtttcaaactgtggccccagactaacagcgtcacctgggaacttgttagagatgtaaattgttaggtgctttcccaggcctgctggatcagaaactctcggggtgggtctctccatctgggttttagccagcccaccaggtcatcctgacgctcactgtagttggaggaacacaggtctaaataatcacactcttgggtattaacatcatggcagctgacctgatcactaattggccttgatgaagatgacctttgaacctgtttcgttacagttctggtggggtaacatgtgcctcaactgtgcttatttctcctggtgctccggtgtgccatttgaaagccctctccatccaattccaactcttccaaactgctttctttttgtttcattagtggcacctgagagccaggcaaatttgtcccaggcttccttgctgcatcctgcctagactttggatgactgttaaatgccatgttactgcgtgtttgcttgtttctcagccagagatgaagatgtcctcagaagattggagttggaacaggctgatgtaattcctgataggggaaattagccttggggtcggcagaaccagctttatctgccttagtagatctgtgaccttgaacaaagcatttgtggttcttgaactttgttgcccttagaatcatctggggagctttgaaaaccctgaatgcccaagctgcactccaaaccaattaaatcaggatgtctcagagtgtgaccaggtgtcagtatgtttataaaattctccaagtttttccattgtgaagccaagtttgagaaactgttgtgttactataacttgtctgtaccccagttcgttcataattaggaattaatataatgataccaaccagctaggtgtgtgtttgaatatcaagcgagacaatgcaggggtttctaacacaaaataaaagtcaaagatctcatttctcccaactgcttcactctgagcaaacatctgaggctgctttctaatgcctccttggacacaaacacttaaaaataggaattctgagaaacagaatttaataaacaaacgcttgtcttctgagtgcttgtgaaaaaataattcgaggtttgttcacagcccctccctacccctgcacctctgatcacctccacctgactttttccagttcgtctcttcgtatttccaagcacttcattttattacaacccggccttatctgtcaggtgcagctggcgaaactgaggcatgaagaggttaaacgaccttgtggaggcagctacatacctggattagactgctgagttgcttctgactgattatttatttggtccactaagcaaagctgcttcctcactcagggctatggaaacatatttttctctgaacttcattagcacaaactcctcagaagaggttcaacttgaatcttggcaggtgggagaaccccacattccttaattttctcttctccacccccacactggtctttgcacctgtggcacctggcccacactcggtacttagcacacatccatggaatgaataaatgacaggatggctacccttttttttctgttttagttgtctaactacaaccaggtctacttcatcatgctgattcttcaaattacttggcggcattttctttcccaaggtgcggaagcatcgcaatacattgggactgcaagagccttagacccattttgtccagcccagcagcccagcgaatttacagggaacaagttaaataacggggcaactgctcagactcccaggacttgagattccctggctatgacgagcattgtgagtgacactctgggaccagatccccaaatgcaggggcacggtgggggaccatccattccagctcccgccacccattagccatctatatgccttcagctatcagcataaagatatttatttttatttggtaaaaatgagaagggagaggaagaagaagtgcattagtggtgtggactggaagacagaggagcgaaagaggggatacggacaggttgtcctcctacgctgggaccctgaagtgtgttgaagacccttgggttcgagaacagaaaatgattgaagtcatgttttacgaaagactgcaagattgaaagtgaaggccagaagctaattaaattgatcacaaacgattgggtcagaacccggatgcaagcaccacagctatgggaacaggtggccaaggattacacagttggaaagagaggccccctctgacacctgtagcactgtggcatgggaagtgctggtcttcaggggtgggtcaccgtggtgacatctcccgcagtggtcctgataagggaggaggcagcagcagttggcacatggtatggaagctgacattgatcagggggcccttgtgaagccagccttgggcctcccaggaaatacctggggaataatgttgtgatgggggctgagttcctgtggagcaggttggaagctggtggtgcctatgatcagggaataaaggcaaatgtgtcccatgtcgtcatgcaatgctgggaagccagccaacctccgtgttacccatctcgattctggcctgcccactgcttcctgtttaattgaagcagatgcgtgactgctctggatatgaaatacggataacctgtgagcaaaacccccaggtaaaaagcacgtgggggagcatgctttttggccagctgagtcttctcttccagtctagagaagtggaggaaaacaggggagcatctggggaccatagagccagcgtccacgccaggcagtgcagactcggcagctccatcagaaagggattcagctcaacctgggggccgattcattcaaaggacattgatctggcacccaacttgtgttagccactatttcacagtgctggggatacagcagcaaacaaccaccaaatccctgcttcatggagctctgtcaatctacaggcattagtgagtatgtgacgatcaggtggccctaagtgctgggaatagacacggagccgataaaagatatagggtggtgggagacactgcttggtccaggaaggccctcctgggaggggccgtgagaagggaggccagatggaaagtctcctgagggcaggaatgagtgctgtccttatctctcatgtacccctgacagcttttctcaaccatggatgcttcagtcccctagcagatgcctggcagtgtctgcatatgtttttagttgtcacaactggggctgttattgccatctggtgggtcaggcatgctgctccacatcctgctgtgcacaggacagtccccacacgtccgcagggccgtgctctgcaggctccttgcatggcgttggccactcagagggtctaaaattattgcatggtttgtttgctcagtattcatcaggtttggatagtcaagaagtctgtcttcatctctggggcaccagagatgaaggaagggacactatcactgttcttgtaaagtccacacgctagctggggcaatgatttgcaacaatcgactatattatcttgtgaggagggtcatgttacaggttcagccttcggaaggacatgaggtcaaagcaaattctcaagaatgaggaatgacaggagacagagacgcggacggggcaggaagggttttgtgagaacagctgatggaagaaagcatttaatggcacctccagcggagtgcgtgcagtttagagcagacgagggtggggccatggcagggcttgactaggagcaaaggtgggactcgcatgctaaggagtgagcttagacatgatactcctgcggcgaaagggacaaatgatggaggattttaggctgaaagtgacatgatcagatttggattttacagggactgatccggttgacatgcaggggatgaatgggagacagtgagttctgtctctgggtctttgaagccagagtgacacacatcagatagatgcagttttcacccaagaagacctgggtagtgaatgggattagtccaaactcatagtgaagatattaaatataccttgggatgaaaagagtagcaggaatgcggacttgtgggaggagggcaggccataccgggcctcacagggcaggataaggtgcttggattttactctaaggaagcctcagcctcagagggttctcaggaagggagtgacatccaatttgcatttcaagaagataagatttatttgagcaagtcaacaataacattcaaattgtcatgaaatagaaattaattcaaaaatgcattcatttattgaggccccactaccaggcactggggaaaagagatcaaagagaaaactttgctttccctggagctctgccttcaagtttccctctacacatagcaaaccagaaaacctttattttttaattcacaagtagagggttggggagcattttatgcactgactcgttctccccatttagtctggcataatttccatgccaagtaaatattctctcttaaaattttaaattttgagggttttttttttcttctacgggggtttatcagtgggctctctcaaaatttattaaacacagttggccagagctgttagctgttgatttctttgattggtatctgttttaagatctttattatccagaaggcgtatcttttctcccagtgaggcattaggtagtaaaagagatcatttccgtatttttctttcttccaaaggtgcagatgtttgcataataggctcctttaagtaaaatccaccttttctggaatcatgttggaaagcctgcaggcccacgatgagggactatcttatattctttaactcaggaatcctcgttcctgtttctgcatgtgggaccaaactgagccatgttcagtgtgccagaccaaacactctgaagctggactagagtaatagcaaactggagagtcgcatcctcgttaaatgatggcttagcatgtaaaacattcgtgtgactggatagtcagtgtttgacaataagatgctgggaggagagccctgtgctcttttgaaattgattgtgtcctccttcaatggatcattaatagttggggaatccacatttaaaaggggtagacccacagcagaggtcttggtcagaggtcagaaaggctgagaaaaatgggcagctggcatttcacaattagtcgtgaatgcattttctattcctttcgagtttttattgcagaacctaatcatgaactccaccaaagtcacattagttcctgttcagtgtttcttatctcctgtgatgtgaggctctggtaattagcagggctgtttctgctcccaaataaaaaggagatatatttagaaaatggatgtgttaacccgggaaagcaggcacaggaagggctgcatgaagtatctttctcttggtgaggtaggctgcaagttgatgtggaagaagttctagatcatactgtgtgttccctgcctgaccacccccgcaagcctcttgactccctattcccaaatctggaattatttttagaaagctgtcccaggccggcacggtggctcacacctgtaatcccagcactttgggaggccgaggctggaagatcacctgaggtcaggagtttgagaccaacctggcaagagtggccaaaaccccatctctactaaaaacacaaaaattagctgggcgtggtggcaagcgcctgtagtcccagctacttgggaggctgaggcaggagaatcgtttgaacccaggaggtggaggtagtggtgagccaagatcatgccattgctctccagtctggtgacagagcgagactctgtctcaaagttatcccagaggatatcaaactgagaagacaagtatttcttgggaatgccacaatgtggatgacataattttgggtcagcccaggaaatctgggccctaagatagaaagaaaggaaaactgtgaattctgtatttggaatgtgaaccaagcatatgccgggagacatcctcgaaataccatttccattcagaatggttgctccctttgtccacatgccttcatcttcctcgggctctgaccttcgcccagctctctaaacttgagcaaatgctcagagcaagacctggtgctaggatcggaacagggaagacacatggaaatgaataaggtcacattctagataacttgcacatcacggccccatttttgtaataatccctttctccatcctccacccctatcctcacttccctcttctctatgaagaattcagtttaactgtgtaggttggatcatggcatgccggtaccctggggtgatggagagttgccttcctactgaaggtcagctactgaaagagcatctgtgcgttggcaaatctgctaggttcagggctctccgagggaatagataggagaaaaattttggattcacctttgattgtacttcctgatggagtcaggattggggtgaggagaattgcacgttaacaagcatagattgcacatggagtggctgtcctttgaggtagtgagtcccctcatggttgatgtgttccagcaggagctggtgagcaccttcaggaagagcacagagggattgttactttatgtagttacattagaagtagggggtctgcaaactgtggcctgcaggcccactccattttcacccactcattgcatattgtctgtggcctcttccaccctgcagctgcagagttgaatagttgtcagagtgtggcctgcaaagccaaaaggacttactctgcccctctacagaaaaagcctgccaaccccggactagatgaaccctggtatgggttggatgtttgtcccctccacatcttatattgaaatgcgacccccagcactggaggtggggcctggtgggaggtgattgaatcatgggggtggacccctcctgaatggttcagtgtcatccccttggcgaccgagttcttgctcagctatttcacatgagatcaggatgtttataaaagaatgtgacacagaaacagaaaaccaaataccacatgttctaacttataagtgggagctaaacaatgagaacacatggacacaaggcgggcttttcagagggtagagggtaggagaagggagaggatcaggaaacataactaatgggtgctaggcttaatacctgattgatgaaataatgtttacaacaaacccccatgacacaagtttgcctgtgtaacaagcctgcccttgtacccttgaaattaaaagtgttttcttttttttttttttttttaaaaaaaaaaaaaaaggctgggcacggtggctcatgcctgtaatctgagtgccttgggaagctgaggcgagcagatcacttgaggtcaggagttcaagaccaacctggccaacatggcgaagccctgtctctactaaaaaaacaaaaattagccaggcatgatggcgcatgcctgtaatcccagctactagggaggctgaggcaggagaatcgcttgaacctgggaggcagaagttgcagtgagccaagattgcgccagctgcactccagcctgggcaacagcaggactctgtctcaaaaaacgacaacaacaacaacaaacaaacaaaaaaaaaaaaaagtgtggcacctcccttcccccacacactttgctcttgcctttgccatgttatacgcctgcatcccctttgccttccaccatgattgtaagtttcctgagtcctccccagaagctgagcagatgccagcatcatgcttcctatacagcctgcagaaccgtgaaccaattaaacctgtctcttttataaatgacccactctcgggtatttttttatagcaatgcaagaacaacctaacacaaaccctcatatttaggaattgatagctccagcccttttatatctaattttaagagcttttgagactatcgtagtttatgccttaaaggaagcttataagtttccccttttctgggtatttccaaggaaaggcaaaaatgtgtcaccctgaaatgatgctgatgttgtctgacctagagatgaactaagtccagtctgggacaggctccccagggagcattttcatggaggtcagtgtgaacccccttttccagattggcggcagggccagctttaggtcccttgagattgtctgcatcccacttcctaagtaaacaaaataatgactagaaaagtcttttcaggaaagggaaaatgtgcaaatatacgagacaaaattgcttttctttcccagcagttttctcccttaggaccatttcacaggcctgagctaccctaggagtctgttttgcccacaggctatgcgtgaagccgacccttaccctctcacccagtgacgaccacgacaatgttgatgatcataagcagtgcttgcaggcttggctagtccttcacagatgctacgtcaccagtccttgtgctgactcaacgagtaggtggctgtattagttttctatttctgcccaaacaaattactgcaggcttggtggcttaaaacaacacaatttttatcttacagttgtttaggtcagaagtccgacatggttctcactgggctaaaaccaagctgtgggcagagctggcttcttctggaagggagcatcattctccgaccttttccaacttttgggggccacctgcattcttcagctcatgactgcttcctccatcctcaaagccagcaatggaagcagctcctttcacactgacatctttcctattctcccatccccagccctctttcctttataaggtcccttatgagtccattgggcccatctacataatccaggatcctttctttaatttaaatttatctagttcacaacattaatcttctttaccatgtaacctaacatagtcaaagtttccagacattaggaggtgggcatctctgggggccgctattctacctaccaccacactccttgtatagatgaggtaatggagagacagagtgggttaggaacttgttcaaggtcacacagtgctaagtgatggatgatcttaacctttgaccccagctattgtcatctttggaaagcagggatggataatgtggccagcacagtgtccaaggggttcccctcttctgctggcttcaaatagggtgacggccggaaggagaagtaactctggatgaacccccaggggcaaccctagattcttgctctgaaagctcataggcagtgtgtggcaacactggtgtctctgataggttttctttccagagtgggagtgccccagtcttttgcaaatcttccttttctcataaatgttacctaggtgctttgcggggatgattttcttcagaatgagtgagtgtcacaaaacagccggccacttgatttttattcctgtttggcacagtcctgggcacagagctcctttccattcgttgcttagcaagaagcaggccccaaataaccacctgccccaaggcccttttgtccactggagaggataggtgattagatggagggtaattgataacgcagggtcagtagggagagggaaaccccttgaggttggacctaggcagctccaagtccagattcctgctccagtgcaactgatgctaaacaacaacagctaggcttgactgagcaccgctggggttcaggtgtggcgtgagtgtgtttcctgaatgatcacttagaagttaagtctcccctgccatgccgggggcattgttctaggcacaagggattttagagtgaacaaaacacatttgtagccctacccccagcccctctggagcttatagtcctaaggaccttaaaggtaaagattgtttttgtccactttgcatgtggagaaactgagcttaggaaagtgtctggaaaaaggttacatggtagctgatagtgaaagaaccaaatgacaaacccacgtcctcccctccagagcccaagctccacacactgactctgttaactgcttggtttgggccgggcaccgtggctcacgcctgtaatcccagtgccttgggaggcctaagccagaggattgcttgaggccaggagttcaataccagcctgggcaacatagagattccatctctacaaagtaaacaaatagataaataaattagcacggtgtgatgttatgcacctataatcctagttacttgggaggctaaggtgggaggataacttgagcctgggagttcaaggctgcggtgaactatgattacataactgcattccagcctgggtaacagagtgagacccagtctcaaaaaagtacatacacacatatataaacaaacacttaggtttgcagggaagcaccctccaatgcacaggtcagcccctgccccagagaatgacgcaggtccgagtgccaatagtgtcactgcggagaagccccggtgtaaaatgaaaataataaaatccaccatagagcgttgctatgagttttgaaagccctattatgtgagccttcatctaaccgaatcatgttttcactgactggattttcagctggaatcgtggcatgtcagggctctgcctagccgggccccactcctaccccgacccaaaatctgagaaatgaccagtaacacggttctagaggaatttgccaatgctcattttttattctatgtggtggtgtttttttttttttttctcattgcagaagacaaattctatttccttactcctgagggaaaactaattccagcaaaggccatttgtctttggtaccttaagatctaggtaatttactgcaagtttatttttattgaaaattatgtagatattattcagaaacacaattttcaactatacggcacacttaagcacgttatattttaagtgttaatacatagactgaggatatatgctagaatgtgcatttctcaaagacacttttttcttttttgtcactcactgcattcgaggtccttaaacttgtgtgctatgaagtgctaaaggattaaaatattttcaaatggatattgtgctgtaagttttgagttgttaccatttgactgcaattgaaactcatgatgctttatatagcttagatgattaattcagaaataatttgcatttaaatgcgtttaagatatttaacttatgattccaaatgtgcctattttaagcctggtagaagtactttagtctccaaagtatgtggacgctctacttctccctagtttgtggacctgaaaaggatttagatattaatatagaataacttttccaaactagttctgaaaacataagaactgagagatagccccctgcaacacacacgcacatgcacacacacacacacacacacacacataggttttgtgctgtcttgggagcatttaagatactctgcaaactacaattgcttccttaaaatgtacagtggacgtttgacatagtaaagatattttgaagatttgcaggccagaaacctgtttaagccaacatattacacacttttaagaaagaaaagctcttaataacatcctataagaaaatcttaaccattatagaagttactctttgaataatattgtgagaaaaaatttaattagtgaaaccctaaggaagttatcagcatggagatttgtgatggatgccaatgtgccttcctaaaatgctgcaaggctattctggaaaaacagttctggagacagattctggcattaactatctctgttaacatagtggtagctaggttcttcccacttctgcttgtttcagctaagtaaaatataagggagtccagtaattcatgaatggataaacaaattgtgatacatccttgcaatggaatattatacagccataaaaaggaatagagtaggttaagccatagaaacacaagttagatgagtggcaggggtgggaaggagggcctacttataggtctgggtttccctttgaagtcatggaaatgttttggaactagacagaggtggtggttctacaacatcatgagtacactaaacatgactttaaaaatgtttcatatgtgagtttcacctcattttaaaaatcacagtgcacaaaaagaggtaagggaggccagagaaactggacaggaaaacccaggtgtgaggaccaggaggaagagggtggggcagaggggacaaggcagattcgaggggatgttccgccacattcttcagggtggcatgggcagcttttatgtagatgaaaacaattttaggaaattgcagcctaaagcggtgttcagtacacaagagaggccctcaagagaaggtcaccaagggaaggcagaagagcagcctctgcctgtctcagcaaagagctgagtgggcacccaccccatggtgatgctcacggtcacagcctagtgacccacacttgtgtctttgctgtcaagcagaagctagtgaccacgaaactaagcttaacttctggtgttctttacttgtgtaaaggatcgtaccttacatcgtagagaaggagtagaccaacactgtgtaatagacctctctgcaatgatagaagtgttccataactgcaccgtccaataaggaagccaaatagatagtagtccacgtggtgactattgagcatttgaactgcagctagtgcagctgtagaactgagttcttaattactgttttttaaatttaaatagctgcatttggctgatggccttactgttggaaagcataggttttgaatgtcacaggtgaaaactgtctttagcatcacgtgggcctatgttttaacaccaattttgcctctcccttgctatgtaatttgaggcaagttgtttaatcgtgaactttagttcctcatttgtagaaaggtagaaatgagagaatatgcttcctagagtcactgtcgagataaaatgaggtatagcatatgaagtacgtggaactgggcaaataataaatacttgataaacattatttgtgtctttgggtattgataacttatatatgtcttatgcagtggtgctttgagaaaatgaggtacagagaggtgaagtaactatgctcacgtcacatagccagaaggcagagggctaggaatttaatcccagatgttctgatgccaaagcccatttgcttgctactgcactgggtttcccttggaatcctggttaccaaattcatctcagcctgtagcattagactgggactgaggagtggatccctttttcctacaagttcgtccattaggtatgaactgttctggtctttgctgagatggtgtattagtccattttcatactgctatgaagaaatacctgagactgggtaattcatttaaaaaaaaaagagagatttagtggacttacagttccacatgtctggggaggcctcccaatcatggtggaaggaaggaacaaaggcacatcttacatggcggcaggcaagagagcgtgtgcaggggaactgccctttataaaaccatcagatcttctgagacttattcactatcacgagaacagcatgggaaagacccacccccatgattcaattacctcccaccaggtcactcccatgacatggggggattgtggagctacaattcaagatgagatttgggtcaggacacagccaaaccatatcagatgggatttcttgtaggacttgaaaccctggggaaacatgtggttgtgtgatggatttctatgtccatagtggtctttgtttcttacctaggttggttctgggtaggttctggactggattggcaggggagatcctggtctctttcatctcaggcacctaaagtcaaatctttcagaaataacatttaaccagtacctccatatgtgtttttttgtttgtttgtttgtttgtttgttttagcgttgaacacttcttgttgaatgccttctttttcattctatatgaaaatatctccaagtcatggagaactttgtctggcatggacaagggcaagacagtcttcttctgtcctgatgttagttggaaggacacatcctattctcctcacctttgggctaagagcagagtttgggtttttaatgaaaattttgtcctgacgagagataagtcaaagtcaggcattgcaaagtgccttgcatgtgctgttactggcatctcagttacattctccatgggcgcttaagaagctaacactcactgttggtcaggggactgatgctctacttcctactctaaatatagcgcctgtcttgtcacacttgctgtttaacagccttaccatgccattcttgagagaaataaagtgaggtttcattaatatgagagatcaacagtagttcagttataagttatcactgcagagggagagcagcaggttcagctcctcaagttggaaataaaaaagatgaatgggaggaggaaatgaagttagtgatctaccgcctgggcactttgtcaagggtgcgtgaggagagaggggaaagccctttctaaacacagattatacaccaaaggcaattaataattgtttaatccttctggagagccatttgttgtggtgatattcacatgactgtctttaacaccatgacaccaggagggtcttacttcgccagccaccaagctgggggcatcatgctgggtaattgtctgcaggtgcatttaactgaaacctttctctaagattctggagttcacagcacacaaagaaaataggcatagcatcattccagtctgtctactttctgtgactgaggtgatttttttctggagctaaatctgtcttttccacttgttctactctcattcactcactggctaattcaacagatacctacttggctcttactacctatcaatcactattcaaggcactcagtaacagcagtgaaccagagtttccaccctcagggaacttacagcagaagagcaggcaggtgatgagaaatgcccctgagtaaagttaaacaggaccaggaggatggggaatttgtggggggcaggggagctggaggaggtgcatgatattgtagtctatacatgatgatcagagatggcctttctgaaagggagacatttaaacagagatctgatgaaagagaaggtcatgagctatacaaatatctgtaaagagagaaagccccacaggtgtacagccagcaagatggtggaggatgcaggaggttgggtgcaggggaactgttgcaaatcgtagggccccagagtctgacaagctcaaggcaaatcctatggaaagatttttttcttttagctgctctgcctttgttggtgtacccctcatttcttttttcagcaggccgtgaccccttcttggcaaccctggaagtaggtgcaaagatccggaggtcaaagtgggcttagcatgtgtagggaacgtaggcctgggagggggtggatcactcagggccttggaaactttgcatggattctggcttctgagtgaaatgggaagcactgaaggttttggacagaggcaggatgtgttcagatatctctttcaccaggaatgctgtaaacagattggaggggaattcagtggaagtgaggagccaagctggaggttactgaaggaaaccaggtgagaaagaggagaacttggattagagagtgaggctagagtgcccatggccaaggtggaggtgataaaaagtggttggatttgcagtatgtcttgaaagaggcatcagaatttgctactggattaggtgcagtatgtgatgaaagagaggagggttgagggtagtgggaagattttttaaatatttcaacttttttaaatagtaaaaaaaaaaaaaaaaacatgactttaaatttactgtcttaatcttttttttttttttttttttttttttgagaaacaaggtttcactgtgttgtccaagctggcttctaactcctgtgctcaagtgatcctcctgtctcagtcccccaagaagctgggcctacaggtgtggacctctgtgcctagcttcttaaccatttataagtatgcagtaaagtagcattaagtccactcacattgttgtgtgacaaatctccaggacctcttcatcttgcaatagtaaaactttatacccattaaacactaattctcttcccccaaccctctgatcttagcaaccatcttctcactttctggttctgtgatcttgactgctttagatactttgaatgtgtggattcatacagtatttgtccttctatgactggcttatttcactttgcataatgcacttgaggttcatctatgtagtctcatatgacaggattttcttctttttcaagaatgcatcatagttcattgtgtggatataccacattttctttttccattatccattcatctatcagtggacatttgggttgcttccacctcttgactattgtaaattacacttcactgggtatgcaagtatctctttcagatccttcttcaaattctttcagatatgtagccaggagtgagattgctagatcatatggtaattgtctttagctttttgagaaacctccatgttgttttctataatgattgtgctattttatattctcaccaagtgtatacaagtgtgacaatttcttcatgtcttttcaatacttactctttctgtttacttgatagtggacattttaatggctttgtgcagtgacacctcattatggttttgatttgcatttcttttaggattagtgatgttcagcattttttcatatgctcattagccatttgtataacttccttggagaattatctattcaggccccttgcccattttttaatcagtttatttggatttttgttggatgaagttggggaagttctttatatttttctggattttaaccccttatccgatatatgtcttgcaaagattttctcctatttagtaagttgcgttttcattctgttgattgtttcctttgatgagcataagtttttaagtttgatgtagtttcatttgcctagttttgcttttgttgtctgtgctttttgtgtcatatataagaaatcattgtaaaatccaatgtcctgaagctttcccattatgttttccactagcagttgtatagttttaggtctcacatttaggtctttaatccattttgagctgatttttgtatacggcatgaggtaagggtctaagttcagttttgcttgtggatattcagttttccaaacaccatttggggctgctcatttcccattgtgtagtcctggcacctttgtcaaaaataattcagccatatacataagggtttatttctaggttctctattctgtttcattgagctagatatttgtcttcatgtcaatacatacaattttgattaccattgctttgtagtatgtttctaaaacaggaagtacgaggactccaggactaagagattttgctctcttgaaccaaaagatggacagattgccatttactgaggtggcaatgactgagagacacaggtactctgaagaatataaggaattttcttgtgccatatgaaagtgccgttagaaaaataggttggtcattttctgacatcaaaagattttttccccaaattgtctgagttgcagccaatataaacataggccaagtttttctaaatcagatgtgtttggagagggtggaatggctgtcagaatgggctgggcttatagggtgacatacaggtccaggcagagtgagccaaccaacatcacttgcaagattgaagaaggctcatggagttagatcagtggaagagaagatcctcatagaagaggcaaaattctctgtcttagggacaatggcaatacttgggaaaattcccagaaagtgatagttttagatgattgtcttcttggagaccgatgttggggaagactctgaggctgcttccagatgcagcaggatggagaatgactgtcagttggcaatgtccacctttggagacagacatatcagtcactttctcacttcccctgactcagctggattctcatcttctctggctcagaggggagtatcatcaagtacagctaacatctttgagcatataccatgtgtcaaaaactattcagcttttcttactctttataagaactcggtgaagtaggcactattattattttcatttgaatgttgaggaaactgcaggattgacaggttaagtagcttacctaagacatggtgagtaattggtacagccaggactggaaccctggccacttgactccagtgtccaggctattaaccaccataccgccaaagagtggcctcgtaccagggcctcgagctgcctggggcttcaggagcttctctcatctatggctgtactagtctgtttcacgctgctgataaaaacatacctgcgactgggtaatttataaagaaaatgaagtttaatgcacttacagttcctcatggctggagaggcctcacggcgatggtggaaggtgagaggcacatcttacatggcggcagggaagagagagaacttgtgcaggaaatttccctttataaaagcatcagatctcatgagacttattaactatcatgagaacagcacaggaaagacctacccccatgattcacttacctctctcacctggtctctcccacaacacatggtaattgtgggagctacatttcaagatgagatttgggtggggacacagccaaatcatatcaatggctaagactccatctctgtacagggggctgggagattcacttggcaatttttgttcctcttggcttcaaaggactcaatctaggatcatcacaaaatgtatttattgtccaaaactggagtgcttttgagagcaaaaaggactatgttaatatttaggctaggactacaaacataaaccagtcttgtccggagcaaactggaatatgaggtcattatacttatggtcagttagtaaatgagatcttagcctcagtgaaagtgaaattttactggaatgggcaacctattgaacacacactttatccagatggcttagatttggatcttttaaaagagtaacatcaccatttgaagtgttttcttcttcattaactatgaagccctttcccatatgggtttatcagcattgtaggaagggctttcatggaaccatataaattcatctctctagaaacgaagaattctaacgtccatcctcacttctgccaccaaaattagaaacatacataggtgtcgagctttctgcttggtgaaggtgcagtgacccctctttttttcagcatccatttatttctgctcgctgagctttctgtctgcattttcatctacagctctgttctttattgatagtgtttgttttagacttgtgagctccaagagggctgagactgcacactttaaatgggctttactgtgttggcacagcactttgcaaataaaggctttacaatttatttaacaaacatctagtgatggttactgtgtgtgaagcagtatacatagcacatggaagatactcaagggtatggcaaaaaggatttctatttcccataagtttatcagcagtaagaagtaacactgctaatgtctattatgtatagatgccatcttatctgtcagaaactgtgctcggtgtttaacatacattctctaagtctgtgccactgatcagtgtttctctaagtagttcccctggaacactagttcttgcaaactgttgatgaatgctatgtgtgtcattggtccccaacaccaccctcagatttggtgatttgctagaaagactcatggactctacatctagttgcatttgttgctaaggtttgttacagtgaaaagattccaagcaaaatcagcattaaaggcacataggcaatgaccaacagaaaccaggcaacagctttcaagcggagtcacacgggacacacttaattcccccagggagaaatagtgacaacgagtataaaatgctgtctaatgagggaagctcattagagacttactgcccagagtttttcctggaatctggtcacataggcaccctttgcctgataggttccaaatccctgacctccagaaggaaaaacggtgttcagcataagccatatctatttgtacggtttaggcacgttgagccactcttatcagagaatggtaggaaccttccccaaatcatcattcccaaataccagccaagagccaaccttgcaggctggcctttctagggatagcagtcccacacttgctatgttggctcttttctggatagtatgcaaaaaaaaaaaaagtttcatattcagataattttgaaaaccttaatcaaccaattttaagctgctttctttacctctggactctaaattcccagacttatctggctctctgccaccccccactgtacatcttagaagatttttgctttgtagggaacaaccacaagaagttctcgtggggaaatgacatcagtcctattcaatgtagcattaaatgctgagaaaatccatagcaggaaaggacagtttaaaaatttatgaattatcttttcctttacacttcagcattgacagataagtgttaaattgaaatactgtctcatactttgatcacagaagctaaggaaagcaagtgctgaagccgcactggcctcctttggaaagtaaaacccgagaactccatctaggcttcgagttaatagatgtggtggtctttacacacctgtagtgaaggggtcatctgttaagtaatcattagctttttcatttgaattgtaaattcaaattgtttctcaatgcagtagacttagattacataaggttagagcttaagctttgaaaagtaatttaaatttgttttcagcatgttaaagacttagtcaatttttttccttttattttagtttatttttatttttttcctgaggcagggtctcaccctgtctcccaggctggagtgcaatggtgtgatcatggctcactgcagccaagacctccctggctcaaatgattctcccacctcagtcttctgagtagcccggactacaggcacgcaccaccatacccagcttgtattttttgtagagactaggtctttccatacagcccaggctggtcttacacttttgaactcaagctatccacctgccttggcctcccaaagagctgggattgcaggtgtgaaccactgcgcctggcccaaattcctatttcttgtttgaccaggatgtcttttgtcccaaccagaattagttcttatttattgttacagtcaagatttagaatagggttttattaattatatatttggactagaatttctttattctgcaagtgcattagttttggaatcactgataaaaaccaaaagttgatttccactaacttttccaagagggagctttaaaaattcacctgtgggaaattttatgcaaaaacttgaacaagacatagtatttttctgttagcaaattataattttccccctgattcagggggggtctgtgattgttttcttccctggctgctccttccatttgcatttgcaaagatcacattcctaatcttcacctcatcagaagcctcattttgattttctgctttgctgacttctgtactccgagagattcactagctcttaatcctatcattggcctggcattcttcctcttctctatacttttccatggttcattcatctccattttattccttctagaatgtatttttttagaagcaattaccaattcttattggtttgagctatgaaatatttcttctttggttgcatcttcagtgtggttttcttctgactgtcattgtcattcacttgaacgggtgaaattaacctctgcctttgaggcccctatgtttactcttcgccggtgttgctgccagaagcttaaagctggatctaatcacttccttgctgaaaccattgatgcttctctgtcgacttcaagatgtgttcagttgggacattgccgtctgtttccttcttcagttctcctttcccttctactccagtccttacaagtgacatcttctgttcctgcatgctaaaatgcccgtgacttctctaatgcagctctctgccttggtgcctttgcgtatccatctctactgaggaactgggatgacttcagcatccggggtagatgcctggcatgaaccagaaaggatatcagattagatctgtaggtgatggtgagaatggatacaggactgtttcagtcaagtacctacctctaaacaggagggcactgtggattttaggattggagatcattggtacctgtgccatcctggggaggtgggaagaaccagttcacagatctagttttgagcaaaggaacatggggttttagcaggtcatttagtgtaagcccactagaaggaggcatgtggtgtggggtccaggacaggctgtgagtacatgttctgcaccagacataatttacatggaggcttggggagaataagcttccaggtgaggaactcagtggctgagttgcaaagagctggaaatgagagaagcaagcttaatgactttgtacgtgcttcagtttagtgcatatcccactcttgtgtcctaatccagttatttttatttctgctgaactctgtacatcctgaggatgaagcccatgctgtcaccactttttttttaattaacagtgtctgttaaacatgcatgtgattcagaattagatatcactccccaccctcatgaaatcctctttaaatacttgatttattatttattttccactagaatacttctggatttttcatgaagcctgagggaaaatgagaagttattatctacatcatttttcactgttttaatgttaatcattgatacaggaattggctttcaccatcttggagtccaccccacctataattaattataaatcctttcagtggacaaaccaataacacttctatattgaaccaggaaccagagagcctaaatgcatcccctggatatcatctagtgagtcagaggcacagaacaaaatgtgcttccaaaggacagatgattcttcaaagagagctactgttctttaaatgtcacccatgtgttagagccttttgttccgctctgtttctgcacgctccatttctgaagtccaggaagccccaggctgttgagtggaaagagtagaaaggcgagagtgagaaggcaagatgaatctggaggggaagattcatgttttctgatttctgagggtccctcctgatcagcggggtgctaatgagatcagagacaggggatgtgaacaccacgggaacctgctggctttcttccactcacagcgccagaatgttcccaccagctgggacaaagcacagggagagcatcaaggaggggatgaaaaaagagatcaggaaggaagagaatagtgtgcatgagctcacgcgtgggtgagaagaaggagaaacagaggcaggggggtacataaaaatcctaccctctagctatgtccttcaggagcgggtctatctgttgttgtttgctacttttcctatgctcttgggagcttatcagaaacttcccctagatcagcagccgcaaatcagcagcaggaagccctgtcacatgcaggtgtcattgtatcatcataaaaattacttcccagggttagtaacttaaaatgaaagtcaggctcaagggtcatcaggtagttagtagatcaagaagatttctacaatgtagtacatctcttttctcttggcttctgtgatactaagtttcctggttccgtttctgtctctcagaatacttttcccctaaaggtgtaaagttctctccttcatgtacttctctttcatgaacttctctccttctaatcttaactgagccttctccaagttccttccctatctcattatcttccatttctcattatgttccctcacaatcttaaccacacccgtagcttcacccatcactttctgcaggaaattgcctgtctaccacagaactctcccctggaatttagtgtaggcaattgtccacttgaatcatcctcaaatgtgatgtgatgtgatcttccccttggtgcatatccaaactgaactcaacacttaactcgtgccctgaattttggcaaggaagttatcaccagctttcactctttgagtgcataacctttcactctgtttcttatactcagggactgtagtgtgtgttgcagtctcttatctgactctcagaaataactttgagtagagcagtactactaaaacacaaattcaccaacttttctctgctggaccttcatgtcgttctccctgagtgagtcccttttgcaagttattaatatatgtcacacagagcctgtttctcatatttattgaccagactaaggagagaacatcgtaccctctaacccagtggttggcacgcttgagccagctcataccagctttcgtgagaccgttgttaatgtctctttctcactctgtcttcactgtagcttgatatcagccatggcaggattgtcttcaccatggcaatgggcaacaccaaggattgtcttacttcttcacagagctggtggttaagttacagcagataactgccccaccacacccattatgtcctgtgcagttatcgatgatattaactttctctgcttgaggcactctgataaaacttcactgatttatctcatttaatcccaatagctacttcatgagaaaggtgccatcattctatctgttttacaggtaaggcaaatgggcactcagagaggtaagatctgacaccgtgtgtctgagagcaggtccatgccatcgaagtagatttgtagcagaaacctggctgggggtatttttccccatattagggatatgtctgtctccaattcatgtccattctaagacaatgctactggtaactgtgatggatcagactttgcacgtttttctttcttggaacaaacaggatttggaagctttgacgttggtgttacagatcatttaccaaaaaaactgctcataagacaggcccagttttctgtttggatgatagcttctcatgatggtcctcatgtgttaattgaataatatttgaactttaaattctttctacaaatgtttgactaacaatctccccaaaatagccctattggtaaccaaccaagtagttgtttcattgcaataggagtgtaatgagagacaacagatcctaagttaatgagttatccaagacctttagttgcaaatcctttagccaaatgaccatacccatgggtgtcagagcaacagtaattgtgaattattgctatgtttaaaataaaacaattttggtctagattagattttgtttataaacctgaataaatattcagattgccactatcagaaaaaaaactcattgacccaatgagcattcaaaaaagtcatttttcctcctttttactttttcattcattaatttaatattcaaagaacacctgatttatgccagccaccgttccaagtgttgagattagagggatgaagaatataggcaagatcttagctttcacggttcacattctagttagggaagataggataaaaaataaataaaaccagaatttcggggcgtgatgagccctagggaaaggaagtgatagcagaagtatgcagtcagaggctctgctgaaacagagctgacaaggtgtttgagcagagaagcgagcgttcataaggaaccagccatgcagaggtatgcactgagacgcacccagtcgagggaacagtttggagactccagcaaccttggagtaatcaagaaatagagagttggtcgtggtggtagaagtgaaataagggagataggattgtttagtgaataaatccaagaggaaagcaggacccagatgatacagagtctcagaggttatgagttgggatttattctaagtgcacataggaagcactgtagaattccaggcaggatacagactttcccatctgtgcttaggagtctaagctgcactctttctttcttcaagtgatatgggagtgacttaaattctttgttgcaaaaccagtgacactgttatgcaaacatgaagtattgaactatatggaagtatttatctgtttaaacattgggggaagagacttttaaaatatggtttatatgctcggtggttcggtaaaggtttttctcctgctcctcatcccccagccaaccttctccaatatattcagccatggctgactttggaggataatgaaagccacaacccaggaacttcctgatggagatggaactgtttcacatcttgattgtatcctagttgggaagtcatttcatagatttgtaagatattgccattgggggaaaatgggtaaagggtatataggatctctgggcactatttcttacaactgtgtgtgaatcaacaatgatctcaaaatagaaagtgtaatgagagaaaaagctctatttaagtgttttattaggtaccagacatcatgttaagtattttacatgaattatcacgttatccttacaagaaaattgtgagttctagcattgccccattttaaagagaaggcacctgaggctcttagaaattaagggatttgcacagttacccagctggtaagtggtgaggccagaatcattccagatggtctgtctccaaagctgagattcccaacctcagccctatgggacacatgtctgttctgtcctcattctgatgggtccaatctggaggtgactgaatcctgaatgtcaggaggcagcagagggtggggccagttctagagaaggcacatcacctgtctctcctgcaggatggtctgtggccattggcgtaggccttcgttgacaagccaagcctctgacatctgaatagctacgctgagaaaggtagaccttgtctttccaccttgggaatcacagtctgatggcaggcaggggctttgtgccatcaggcaacccaaaatcagggtaccctgcaaagtcacctggcagaggtagcagggctgggtccacctagaggcagggaacattcttcttcacacaaagaggccttcccctcaccaagctgagctttttaaaagtttaatctatagcccctgagggagtgcctctttctaatccctacaaagacccttataggtcagcagtgtcctgtattgactgatccccgggatgcattggatttttaagctccgagattatcccagcttttacctcttttttaaataaatatatatatatagtatatatgtatatatgtatatatatattatacacacacacacacacacacacatatatatgtatatatatatatatctttaagttactgtgctaggcatgcctggaagtctccccacccctaatgcatttttattttaagatttgactggcattttttagattctcttgatgtgtttgctacatcttttttttctttttttttttcatttttatttatttatttttattatactttaagttttagggtacatgtgcatctttaggcaagaatttattaggatgttatggttaatataatcatggccataacttcctaatgaatgcaaatggggaaaataagattttattaaccaaagatggtgaccttaaaaccattatatcttccttgtgcttatggagaacattttaggagcacgcctattcttaaagtgaattccgttatctttcctcatgctaagaatggaagggggcttaggctgagccaagtgacatgttgcaagcagttgtatgatgtcaccaagtgctggccgttggtgtctcagccacagtgggaagctcagcacatggattaagggccaacctggggcgaaggtgattaccttcttagaagacacttggtggagatgtttttgagtgtcatgactagggaggagtgcgcctgacttctaatgtgtaggaatgctgctcagtatcctaccgttcacagcacagcctgccccccaccccaataaggaatttcctagccccaaaaatccataccatcaagaataagcgtacagagttaacatcatgggactcctgagtcagagcaacttgttttcaaatcctacctgtgtccttggatggttgaccttaattaactttctgaacctctgtgtcctctcttctaaagtgtgtctcatcattatacctattttatagggtactaagagaattgaggtattgcgtgccaaacccttagcacagcacctggcacagagtaagtactcaataaatagtggagattgtaactcttactaatctggtggtggtgtcctcctcaaagtaaaataacaaggcaaaggcttcaaatcaagctgcatttgaaaagttgcattttttggtatcaaagtcctccaagatggatttatttttctattttatgattccgtaaaaggcttcctataagacttgtttgttgggggtgggactccctctctggtgctgctagggcggggtacctgacattagtcgcacctgcagtggattcgacacattaaacctcagagcattgcgtgagtgtggctctagaaagccgcctcaactgcccaggtttcttagcgatcagtcatcttgatcaaagtaagaagcagccagtgtccaaggcaaaatctgtgtggtcgtgttgagagaaccaggcacattcgccacaagatacctgtgccttctgccattaagcaggtctgacaacgtgaaagctggctgagctgagggagttgatgagctgtcaacctcaggggctgctcagcccttcgggggtgctttgcaagcctggttgccctccaggtgtcattttgctaggggttgacagagcaggctactgcccttctgcaaatactcttaagatcatgtgagttaatacacaggacatgcttagacaggggctggcactgttctcagtgttctgttagcaattattaccattattttcacttagatttgtcattatgtacacacagctgcctgtggacatgtgcaggcacatccatgtaatatattaatataattaggaaagtgggggcattcagtactttctaggtatacacatgaacagacacacaaatatacataggacgtgcagatgtaatgggatttaatgttcccaaactcttgcagtcataaccgtctgcccagagtcaatcttagatagagagccagcaccgtgaggccaagagaatgtcttgctcctggatctggctggtgttcctgagagaaggacaagacgccgcagtgttcctttgacccaaagatggaagcaagacagataacactccgaagtgtggtagcaagccaagcaccctggagttaggggcttaaatccaggcatcaggtggttatgagtcctgtgaccctgtgcaaattagcctccccacctggggattgggaaccacagcgaagtcacggagctgctgtatggtgcataagaaagcgtatagctcactgcttagcatcatgatcgttccttaaaatgagattcagggctcatggtgccaaggtcctcttggaagcctcatgcacagagtgtcttcagacctaagattgaggaacctgtttgagaaagtttcaggtgttcttcctcaccaccatcaccatgagcaaaatggattattcactggccatatttctcctttttacctcagccaacaaggcacgcaggatcaaatgtgtggttctaccataatgactctatggacaggatcccctgtggctggcatgctgtcaccatctcctcctccttttcttttttctctgatccttgtttttatctgcttgtacttctgccttattgtgcttagttgtgcaagccaccgcaaatccagtatggattgatgtggggtataaataaatttttaaaaagttgaaccttgaatctgttcaataattctccaggattttgcttagctttactgtgctgcttccaatttcagactccctagctttgcctattggctgactgtaaccataaagataactgattcctgtaccaagcctaataagatcaattaaattccttgtaaaaatggtccctactaggggaaatgctagatgagatgctaaaactcatctgtctaaaaacaagagacaagctctttcttggattttttctttttctctttctttctttctttctttctttctttctttctttctttctttctttctttctttctttcttttttgcagctgatcagtgctcctcatgcattttgaagcttctttgcccaaggtgtctgtgacagatggctcgtgaagcagcaggaatgcacaaaacctctgctattatttttaataaaaaaatactgactctagaataaattgactattgaaaaggctgagaattcagtccttgaaactaattgtgccaagtatgggcacattataacttctccagcatggactatgtggccatgatggtaggcttggcaattaaaaagacaagtggagagatgccccaaactgccgggcctcctgctccatcctccaggtttgaactacggctggttgcaaggagtgtatttgtgcttgcattagaaaattaggaacgcctgcagaaaatggctttcccacagataaaagactattaagtctcttaaatgctggaaaatgtcttcatgagcatattcagtgatttggcacttactccacatgagaacgtccctaccatgatgtccagtaaagaatgggctacgtgtcccgcagacttgattacctccctgctccagcttggctctttctacaagggctgtgctggcccaaacatcaatgtctcatttaacttttgaaaatcgtcctcttggcatctagacctgttgttttcctggcctgctaggataaatacggaattctagggtgacttttattatgctcttttcaatattggtaataaagtggcactatgctgtggataggactgggttcacatcccaactctgccttttcctgattgagctgctgagtaactcttctgcctcctgatttgcaaaataaggatactggcttttaattcctaaggtggttctgaagatgacatgagacaatgtcagtaaaatacctagcactaagcttggcacatagttggcatagaaaaggaggagttggcagcttgattatggtcaaatctaagaagatttgatgcagacccaacttcctagggccactgaggattaaataggtatatataaattagctcaataaaagtgattatttttttcttgagacagggtctcattttgtcacccaggctgaagtacagtggcaccatctttgctcactgcagccttgacttcctgagctgaagtgagcctcccacattagccttccaagtagttgggactacaggcgtgtgccaccatgaccagctactgttgtactttttgtagagatgggattttgccatgttgcccaggctggtctgaagctcttgagctcaagtgatctgcccacctcagcctcccaaagtgctgggattacgagcatgtaccactacacttggcccataagtgattttttaaaaataagtaaatatttacaagaaattaattccctgagatcgtcaggacccaaccttgtcttcattttaagtattgtcagctcagagttctaatgaggctacaagagcattagagatagactttcaaaatattaaaagaaaaaatttcctaggcacctccaatgaaaaggatatgttccctgacctcaagaagtttccagtggccaggcacggtggctcacgcctgtaatcccagcactttgggaggctgaggcgggcgaatcacgaggtcaggagatggaggccatcctggctaacacggtgaaaccccgtctctactaaaatacaaaaaaaaaaaaaaaaaaaaattagccgggcatggtggcggctgcctgtagtcccagctacttgggaggctgaggcaggagaatggcatgaacccaggaggcggagcttgcagtgagccgagatcgcgccactgcactccagcctgggcgacggagcgagactccatctcaaaaaaaaaaaaaaaaaaaaaaaatagttcccaggcccctgttagacttcatgctccctggctttccctctctcctacaaatattagaatttgttgctcgcctgctatatgttggggcctgcatgctgtgtgttgtgaggagggcaggcaaagctcattgcccttgggatttgttacctggcaagaaagcaaacactgaaccagtaatgataagtaatgactgattttgaaggaaccatacaggcacctaggaatacagaaagggatttccttcctgagttgggggatggaggaaggtttctttgaagaagtagcatttgagcctgcttcctcgagggtgagtaggagaaaagacagtagggcttcatggacaaagagacagaatatacacaggcgaagaggagagaaagcgacggtgagcttgaaaggttcaaagaagccgagacagctgcaactcaagtagaattcatcgtattttttttcttttactaaaaatagaatgacagaataagaaatttatataaggagtattcaagcagaccccaaaggccaaagttcatggatgaggtttcctctttcctctccgctcagcttttaggtttctttctttgtcccacccatcttcgttccctgatggtaggtccatgatgtagaaagtttacaaaagaaaatgtctcagggaaaggttcctccatgaatctgttaggaagaaaaactccagtgaggctgcacaccagcagcactaatcattttattttatttgtggctgtgtagtagtattgtgtggcgtatatgtaccaccttttctttatcgtgtctaccattgatgggcatttaagttgaatccatgtctttgctattgtgaatagtgctgcaatgaacatacatgtgcatgtgtctttataatagaatgatttatattcctttgtgtatatacccagtgatgggattgctgggttgaacgctatttgtatttttaggtctttgaggaatcgccatactatcttccacaatggttaaactcatttacacttccaccaacaatgtataagcagtcctttttctctaatacctcaccagcatctgttattttttgactttttaatattagtcattctaactggtgtgagatggtatctcaatgtggtattggtttgcatttctctaatgacactgatcattttgaagaatttattcttgcatactcttggttaaatgcataaagtgataaattaaactgagtctttataagcaagtataaattagtggttatttgggggctatttctgatttacacaataacgtatactaatcacattcattaagatgagtgaagaaattgatttagctggaaagcatagctctacagaggcatagccaaagtctggctatataaaaacatttttaccaccaatattttcaggcaaatgtgccaataaaaggtatattctatgtgaaattgcagcaccctattggaaatggcctgctttaacagtcctggttcctgcttattaagatgcaccttcttaatgtatgcaataaaaattagactcaaagatatctagtgatgtttagccagcttcagtgactggtctagaaataaaaagatatgccagtaaaacccgagtgttgcaaatactgttactgatgatgatcaagaagagaggaaggcactctgtgaaagattgggtacacagtgttctgtctgatatgtggcttttttggcatcaaatgtgcactgcggaccattggcacttttcagaggtggccaacacataggtgccagggacaattaacagagacgtggtggcaaactcattaacgcaagaagagaatctgccattcagagacattaatttaacatgacaccaacaggggtgtttgtatgtgcgcgttgtggtgtcagacattctgctctaattgagttaattaaaagttaatggcacagagcacatcgtgacgctataaataacaggcacgtgaccagtccttatactctcatttgaataaacctttagctcaccatcacattccacttctgaaggattcattccacatcactgcctctccttccacctttgaagagggtgagtgctattccatttgatacataaacaaaaggaattggaaaagataaaaggaggcttgtgtgctatgtcataaatatcacccatcattgccagccttgtacttaaacttcttgctgggaagggggaaaatgtgtcctcctagccagggctgtggtaggatgtggggagagcagggaacctcctgctgctcatggtggatgggaggccggctgagggggacagtcactaagaagatgagttggaagtaagattgatataaaccttatggatgggaaagctgttttcctctctgagcttcagtttctcatctgtgaagtggagctaatgagaatctggtatccacgtcattgaatgcttctcagcatgaaatgggagaaatctctaaaacacttgacacaatgttgggcacacagcgagtcttccataaaggttagatggtgctgcttggaaagtctgtctcctgagcgtggggagaacagcccctcaggtatggctgtacccacctccctttctcagcatccttgtttgggtggccagtggagttctcgacgttcgtttttaagtgttggtttggttgattacattatgttacaaatgcatccaaaaaaggaaatgtgcgacatagtacttacatagattacaggcagagaaacacttgaaaatcattcacttaagacaaagtcaatagaagacttctcagtctcaaatttttttttattttattattatacagtaagttttagagtacatgtgcacaatgtgcaggttagttacataggtatacgtgattttgactgaggaaactcgcttcagtttgcttaaaactgaatgctgagccttctagccctgaggcaaagaggtatccatggcagcttacctacctttcatgtttccagcaccatgaaccacagcaccccttcaagtgaaagaagcaaacttctttgggggcctaaaatcatgggagaaattcagattgctcatcgtgcaaccaaatgaacatcattcttgagtgattctaacaattgaaagaggacaaaaatgcttcttacgtggctctctcggaagaatttctggtaatagtcaaagatgaggactttcaaactttttggcaggttctcacagtatataatagttttttttttttgtaaccatgtacccccaatacacacacacacacacacacacacacacacacacacacacacacacgctctctcaaaacaaagtttacaaataatacttagtctatgtggtgctttgtagtttctcttctactgtcgcttgttacttaaaatactggtcatgacctataaattgattttatgatctaaaaatgaattgtgaaacctggtttaaaaaatgctgatgcaagatgttaggtaagaacatatttctgcaaaaatacttaagtggagggacaggaatgagtggggctaggtgtccagtgttctggaaagaattaaattttttattagtatctatttctcatatttctccccagcacagtcagttctgcgtggcgcagccatcctaccaaggggagtctgtgggaaccaggacacttgattgctttttagctcagtcttcgagggagtgctggagcaactctgtgcatcggaatcacccgggatcccagcaggtctgggagggactgagattctgctcccaggtgatgctgatactgctgctccccaaagtgcgttaggccatacactgaacagcaaaggaagagaaaaatgcaaagttggaaccttgtgtttcctggcctccaccgacagccccatccagtaatgcctcctttctccttcaagggcatcttattgtctcattactcacatttagagactgattatgtcatttagtaagccttcgattgaatatttaaaagccacttggatgaagttaaaagtcagcaaagaatgtatttgaaaagcatgcatagctcatagctcctagaactgacagtgaaatggatgcaccaggtcttggggggcggccatgtatcgggggagctctgggctttggtagcaggaactggtggagatctttttatgtgaggccattggactgaagcagcatcccatgtcctttggcccttgcagtagaccctcacatttcagggaaaggatttaagaggccccttggctcacaggtccactcctcagccaaggagaacagggcatcttgactgacccaccaagactttgttatgacatagtgaccacggttcagtttccatgcaagggggcgtgcatgcggagtgggcagatacagccacagcacatgggttgctgaaaactaagtggctttgagaggaaggtaagtgcttttgctaaacaccaactctgtggaaagctcattaccgatacgttaacttcatcccctcgataagccagctgttctcaattggggatgactttacccttcaggggagaactggcagtgtctggatgaatttttggttgtcacagctgggttggggggttgggggtgctcctggcatctggtaggtaagaacatatttctgcaaaaatactgaagtggagggacaggaatgagtggggctaggtgtccagtgttctggaaagtatctattagtatctatttctcatatttctccccagcacagtcagggatgtggctcaacatcctgcaatgcccaggacagcccccatgacaaagaaattatccagtacaaatgtcactagtgccaaagctgagaagccctgcaaaaaacttgcatgatagtgacggttttctttattttcctcttttttttttttttgatgacagaaagttagataacagtcacaagatcagaaagcgaataagtggcagagcttgaacccagatctgtggggtaccaggacaccctgccttcttgctgtacctctcaatactggtctcttgtgcctgcctgccaaggaacagaggcagtgggaggagtcactcaaagagtcttatgagcctgataacaaatgtgtgagttccctccctttgctgatcagatttgttctgttccattccggagtcactgcaaactaccaggttttaattcaaccgtaacctgtgggaaggcttcacgtctgaggttacctggtgcagctgtcttcacgctggcacactgagaagttaccaaatgattaatagccgtggagtttcccaaaacatccaggtggaagacacacaactggcttattgtcttttaatattcagtcatataaattgaatataagagggtaacagcaggcacccctggagacctgggcatgaggtttagcttcatgcaatcccctgtaagtataatttccccagaccacatggggtaatgggcctccatgtctctgatttgcccatggggggaggacattaagtctgcacagctgtggtgtaatcagatgtgtagggagactctgagagccagaggaatctcttttccatgctgtctcacctgaaatgcttgtcaattaatgtagacttgtggtagacattttgtttgaaaagaagaaatttcattttctttcaaatattatatggtgcaggtgaagcacctggggtttttctaattataccgtgagccattgggaagtatgaacatattttacacattaaaagacctggattttgctggagaccctagagaatgttctcattggagtccccctcatttaccttggaaaggactgtctgaatttgaaaagaaatctgaagcaggaaaaacatataaagaaatatgaaaaaatggtataactttcaagggaaagggtttccttaaaaattcatgagatgggttataataaatgcactagaataacttgtaacaaaaataccaacagtgtttctttggcagatgtttctcaaatatttggggtggtttcaatggttttaaaagctttctcccaacgcttttatgttgcctatttggaccaccaattgagtaagaatttggctaattagtgtaaattcattaggctttagcataattatatttcaaaccaaccagctaaattgatatgatgttgtttgtcctgagaatgactaaatgactgataggaaatgggatatattctttgaaactcgatattcttagagcttggcaaaccgtctggtgttcaaatacattttgttatttgaatgaatacatattagctatggatataaacaaggagggagagatggatgggctgagtgtgattatgccagaaaaacaggagtcgagctcatcgcaagacctagcagtaatttttaggaatcaagtgatacaggtgttttcataagttctcagatgggaaacaattagtgaaagcaacaattccacctttttgtacaaaacatccttttgcttagttggttgtctgcttgctcctcaaacattcggaacatttccaggatcagtgaatatataacagcgatgttttgttttcagaaaatcaggctgatagtgttgtactgaactcaaatctgccttttaggaaatatccatttcctcctggttcttcctcttgagatatgcagagatctaccaaccacatcacagaatggaactcagatcattaaaggacagattccttgacttggttcataggaatggtcttgactcctccctagccaccgcccactgaatggtttgatataaaaaaaacaaaacaaaacaaaacttaaaatatgatcttcgtgatgtggtttggccaatgtagaggattaaaaccattaccactgcttcttctgcttatgaggcttttgactggcttcctcttttctgtcatccaggttctcaaaccccatgatgaacggtgcaggcagggagagtggcagagacagcaggctgctgccatggcctcaatcccagccacttaagttggcttcaccattttcctgcccatgtgtactacaggttgacggctagagacactgtgaacatcccactacttgccactgaggctgaattttttaaaaaaaataatgatagcagaaacacctcagacagtctttcatgcagagactcaatttaacacttcagaaaatttttgttcttatgtcaagatcctaaagttcctagatagattccaagatagaagtacccaacctattgtggctctacatccaatttccattttttattagcatgtgattttcttaacatactgccattatcataagttggacaccccattttcaaggcaactgaagtgaatcagagttatagatagcagacatagggtataaattgctgctgcccaaccctgaatacattttttttcatccagtatgatgctctcctgataaataccacctgttcaatgggaatttaagacaggttgtcattttagcagtcaaactttctgttggatcacactgagtttatggtcagcttgaactctcaaatctttgtttatgaatttttatcaatctctgacttttccaacttggtttggccaatcgctttttgaaatagaactttatatttaacttcatcaataacatatgtagaaatatatatacttatatgtggatatatacatcgtatatatgtatatatagtatttgtgtgtgtacatattatacacatgtatgtgtgtgtatatgtatatatgtatatgtgtgtgtatatatatgtatgtgtgtgtgtgtgtatacatatgtgtatatatatatatgccctttaagactaatgcaataacttttaaggttctttttgattgaagaaatatatgtaattaatatcaaatcatatctatggcttgcagcttacccctctgcctacccctaatttctaattcctagagacaacacccctctaaactcctttggctggttttttttttctggcatttgtgtatgcatttctcaatacataattatactatcatcatactattataattttcacttataaacatttatttctcctattaaaactaaagatatggctgtcaaactatgcacacatttattatccctttatattctaggtttatgttattgtggctataagaatctgctgtaaataattatatgaaatacgactctgatagaattttctttgtcacctatcattttgtttttccaggtgttaataattatttcttcatttgtttagtgttctatgtattttttattaaatcctatgccaaacattccaacagagctgtgagatacttgtcaatgtctttaaatgtctcaagtcgtctgtttgtttgttcttattttcttggaatttgtttttcttggaattctctgtatttctgctctagtttcttcctctaagcctgcttctcagccatcaccctgactggccatcaaactgggaactctgtttgcctttgtcctgtactgagtctcctctttcccaaatcctttctctttttccttcctggttaacctctggattatgtgtgtatttcgcatgcctgaaaatcctttttctacttttagacttgcaaatttggctggatatagaactctaagttgaatatatttttcaatagatgatgaacttggaagattcattatctaattttctttcagctcccttttacataactgtcttctcttaaaaatacttcgtacatttcttcaactttatcttatgaccactctgttgttgtattattgtttaatctttgccatcataatttcaattttaatggttttttttgttctctcaatgttcatttttatagtaatctttgttttgtgaatacagtatcccctcttagctcttcaagaatatcatttacaggtgtttgggttttaaagattcacctgttttctgttgcttctaaatttctgcttttttttttttttttttttttttttggtctgtgtcatgttagaagggttgttcacattctttgtgaatctttgctgccgttgtcctctgagtgaagcactaaaggctctttaggagttttgcatggacgtgcatgaaaactgatgagcctcaaaatgggtgatggggttgggactccaccatcagtatctgtagttattttcggttttttgtttatttctgttttttagatggattctcgctctgtcgcccaggctagagtgcagtggtgcaatcttggctcactgcaccctctgcctcccagcttcaagcgattctcctgcctcagcatccctagtacctgagattacaggcgcctgccaccacgtccggctaatttttgtgtttttagtagagacggggtttttaccacattggccaggctggtctcaaactcctgacctcaagtgatcaacccacctcagcctcccaaagttctgggattacatacagaagtcactctcacacacatactcatatttgccttaccatttgtgcaggaaatcaataccattactacccaagaccaaaggtttcactggatttaagcactgacatgaggccaagaccatagctccttccatggatatatggtccactttaatttttatgaattctaccctaagaagggggaaatgttaattgaaattgtagccattgttaacattgaatttatcacttaatggcagttacttattttaattataacatctgtgtccaagtcagtgtgttcattgttgtattcctcagaaagtcttatcaggaacccactcccactgtaactaacacagataaagtcttctgctggcatcatctcccctcttcacactccagggaatacctaaaaaatggaaaaggtagactgtgccctttactaactcttaaggcaaagaagtttaagtaaggacaaacattaagccaatatttccgatatggatgttaaggttcacagcacaacaaacatcacaacctgtggctgtcttttacctcattcatggaggcttatgaagtacacttttcttctggaatcctctcttttccccacctctcagggcttcttggtgaggtccacactcttcactcaccattcctggtctcaagtcgggatgtcttgtcctaactatcaatgacccacagttacctctacctctcagctgagccctcagcctattttctttttttctactcatgttctgattgcaaatgacaggagttatgactgttgttgccccagatctcatcatctacttaaacatcgtcatctgccagtattctcagccttgcttttttttctcagtgttaagaatttgttagggaggagctggtgaaatcctgaagtgcagcagagacatgcatgcctcattctttgctaaaacagaatgccttcagaagcaagtaccagaaaaccccaacccaactgttgtaaacaaagaggaaaatttatcatttcacaaaacacaaaggctgaaggtgcagggaagctccagggatggttaattccccacctccgcagcatcagggattgggttctctccctcttcctgctttatcattcagagcccggctggattatcctcaggctaattcactccatgtatgcagaatagctgtacagctaccagtgtcagaggcaggcacatcggcttataggagaaagagagagcagctctccctttctgtgtgtgcgatgatttaaatgccctctccaaaactcacgttgaaatttaattgccactgtgatgatattaagaggtaagacctctaaaaggtgattaggtcatgggggctccaccctcatgaatagatgaatgctgttatctcaggagagtgtttgttaccgcgggagtgggctcccggtaaaaggatgagttcggcccccttccccttgcaagctcactcatcatatgatgcctttcacaacattacgatggagcaaggaggcctcgcctgttgtggcccctcaatcttggacttcccaccctccaggaccatgagccaaataattttttttcattagaaatgacccagtcattttatttaacaagatattatgttgtcatagcataaaatggactaagacatcttttatcaccactttcccagaagttcccatgccccacacatgtgctctcatacctcattggccagaccaagtgaagtgtctctcagtcacaggtgagggaaatgagatgaccatgaatggcaaattaatcaagctttactcatttagagaagtttagaggaggataccttctttggccacatgactgtatgggaaatggtggacactgacacacacaggtgtatatagatacacctgcccctatgtgcaccactgacacatggatattaactcagtggtaggaccagagtaaacccctgatcatagtaattgacataattataagtgcagacattaactgtactgcagtttgtctttagaacagtggtgtatatatacctatactcatgttgtatacaaccttcacaatatgtaggagaggaacttccatggaagtatgaacagaagatcaactggacagttacgctgctggtgagctgtgtgtagcctgagggatctggcacatccttagttcttttcgcacaaatgctgctgccagttggctcaagcatttcagggcagttgccacagttgttactacagttaccacattttttccaaaccagcagtcagcatacacaattggataggtacttctttccaatctgtgaattatttgatgtcatatgagttacagaagttcatcccgggtcatgtttaaggatatataaattacatgttgtagacaaagtctacgtttctacgtttttttgacagcacaagtgacatgaagtgaaatgcacatttcaatgggtgtcgcatcctggtctcaatagttttagtgcagacattcttcctacacaaaaatgttgtgaaaatttgaattgatcataatgtgattgatgttgagaaataggatttatatagtccatgaactactattgggtataaccacttgaagctgggcacaggttcctaaggagtgagtgtctgaggacaccacagagaggccagagctgctctgctcacctacccagttcttaggttctacctggcattctttagctctctgttgttaaaggtaaactctgccacaagccaaagaccagagcagagagatgggaggcttgtcaaagaagcatgaaggtgcttttatttccttctgaccagacaacttgctcagccttagcttcagcaatcaactacatctgtaaagacgcttttactgttggtgttttaaacagaaaaacaatgacttcataatctagaactctctagaacctccttttctattacaaaagcagctgcttttctctcctagtttttggaaatgtgaggcttcttagaaattcaaatgttgtgtcataacctaacatagtttgcataattgcagagaactcaccagatgactgttgtatcttatgaggcccctccccagaactcctggagagacctaaagtggggggcagatcctatcaccacagctttgtattacaaaacttcattaaatatattatgcaatgcattactgctgtatgcatcataaatagacacaccatccttcatgtctcaaatattgattatctaaactatcccacatcatctatttggacctagggatatgaagatacaaagatgcagtctgttggcagaataaaattcttaaacagatcttagaatagtgtgagttgttcctggaaggtacagagtgccatgggaactcagagaacagattcccaccccagtaagaattctgggatcactccaccccaaaagaatgagggttatgttgtccttagtgggaggtggtagttgtggattaggtcctatcatttcacacactgaccatctctgcccagtaccctgaatgagtgctccatgacatcatcctctttgacctctggccaccttcccttctcctagccttgctcctcaccaggtaatcctagacatatggacagctcactatcaagaggaggattggtccactggagaaccgttaatcccttctgcactttggggatgatctcatctgatttgtctgtcctgcttcctcaaagcccctaaaatgcatttctatgctaagttaaacagaattgattgcggctagatttactgagtcttttgaaatggttctattattttgaatgtaagaaaataatgtactacacctcctgagaaatagatcttctgcaacattttcattaatctctttattaaatgtaactggtttctctttggaaattaattactgaagtagtattgagaattttaatttccacaatataccagcaagagatactgctgtttctttatacactgttacacagcagggcaataatctattgaaataagcccaaaaagggggcagcttgtaattaaaacagtataacacgagtgtttgatgactctcttagtgctaaaatggccctgtcatgctgtgtttgggtggaataaaatgtatatttaggaaacagctctatatggagaagtcgacagactcaggttttacagtctgggatgtggctgtgtttcactgcaataatatgcccacgaggaaatacggtttgtttttggcatctgagaattacaaccattgctgcacaataggaagcttcttcccttagtaagccacccccattgtgaaatttaaaatatttaaatgatgaagcagagagcatcaattatcaatgtcggtatccatggaaaagacatgagtatgcaaacacctgagtgcacgcacagctcacgtgtaggtgcaagtccacgaatggatgcggatcctgtatgtgtgcatgaaggccctcattgacacagattcagcactcaataactctccctcacgcttagaggaggcttcatatttttcaagacacgttcctatctgtcatcttctatcctcccagacgtgttttctcatgataagaattatttacacatcatttacatttacagatttgctttttttgttgttagtgtcaaagacatttttgcagatgctgtgttgctcttctcttttctccttcctcactctcttctttcctgccttccctccctccctcccttcctccctcctttccttcctccctcactcctttcctttctctttcccttcctccctccctcctttcttcctccctctctccttcccttcttttctccctctctcattcccttcctccccctcactctaagtgctaagtatacagccatgaacaccaccagctccctgcttttagggagcccaaagtcctgcccactcagcatataaaatcctataattgcctcttcttggaaagcagtttattggttttgaccactgatacatgtacctttgaggtctatgccctatccccagaagctcctcaaagaaaacagtacaactgaatcacatattgtatcctttctggatgaagtctgttaactaaaacttgctcatcttcttgtatttccagtaatgtgggtgagtcttacggataagtgatcagggcagatcccaggctggacttctccttatcctggcttaaggccaccagcaacattcttgtgttggatctagacaccagctctaccgcacattgaggcagagttcataaaaaaaaaaaaaaaaaaaaaaaaaaaaaattcatggttgctgttagagccccaatcctgcataatgggcttttatttaaaaaaaaacaaaacaaaacaacaacaacaaaaaaaaacgctgtacctagaagtaactgtccagaaaagaataatataatgcatacccaagatcataaatactggaaatcatacaaccgctggtttctcaattacagtaagaaaataattcacaatactcaaggggaaggtagcacttgtgagccagcattatttatagaaacctttcttttatctttctttgcaaagtcttttactagaattatttatttaggataattagagaaaaattctgtaatttcaagtaaatattaactacaaatcaattccagtaaaaatgctgctgtccaatcatctgtgtcactgcacttgggagaaaacaatttatgttcaagcctctttagctggattaatctcttcaaacctaagtgatccatatgaagatcttgtcaccggaaattacttttgatccaatacatctcacatatcataatggtaataaacatttgtcttgtgccttacagcttaaaaagtgtttttcatccattatctctcttaattttcatattgatttttagaaaattaatttgttcaaccagtgtttgggtgcttcttgtttgtttattccacaaaaatttatggagtacctctctcagtcctcaccactggggatgcaatggcaaataagatgaagtctccagccataaagaaactatattctagtgagggagatggatgataaaattaaaaattgtgcaagtgcatgatccagtgtcagggaatgataagacctgtgtagaattaagaggccaggggttagatctggacaagaaatgcttgttcttgctacataaagagttaaaggctgagcatccctgagtaatgtgagactgtgaaccaggaggacagcgttccaggcagagtgaatatttggatcatgcctcacatatcgtactgcagttagcacttactacttaataccacacgggtattttcccatgttgttcaaacttgaatttttaaagtctgaaaaatattccatttatggatgtccttatagatttatagatatccagcgttgcagtccggggctcatcaaattttttccactccttactgagcttcagacccaccaggctgcagagagacatctctagcaaatcataatcatttgcgttaataggtctgtgtggcccctgaagatttcataaggtggaaaaactactcccaattcatggggattgggctggacacacttcagtagctttccttgaaaactggaggaaaggcagagctgtggcagagtcaacgtgggaaatgtggtctgttgagtggtcctaggagtttcaagaacaactattctgtgcagatcagtcagccctgtggggattttagacgtggattgtactctgagagctaatgatgagtttgctggaaataatttttccatttccatttctaattgttaatatagtacagtgagctcggtaagcacaatctgctcagataacccaatctgcagtgtgactggtgcctgtggctggtgcctacacaacaggcttttgtttcgtaacttcagcacttgttgtggggggaagcaccacaaagctgctatccattgagcagtctttcaccctagttttggtgcatatcacttctttaatcaagcaaaatggctctaaaataatatcaatttttttttcttttttaaacttttaggtgcaggggatacatgtgcaggtttgttacgtgtataaattgcatgtcacagaggtttggtgtacagacgattttgtcatccacgtactaagcataatacccaataggtagtttttttcaatcctctcccacccccaacccttcaccctcaagtaggccctggggtcttttgttcccgtcttagtgtctatgagtgagtactcatagacatagtagtgtctattagctcccacttataagtgagaacaagggcatttgcttttttcttcctgcaagttcccataggtggcagctggataaagaaaatgtggtacatacacaccatggaatactatgaagccacaaaaaagaacgagatcatgtccttcatggcaacatggatggagctgtggaccattatcctaaacaatatgaattcttaagaagccaacagggaggcccatttaaaagcagccacaaaggggtacataaaagtgaagacaggttttaatgacataggtttcaagttaactactgtttgttgatctcttgtggtttccgtgggaggggcatttcaatactacataggtatcgtgtttttattttcgtaactacgcagcgaggtaagtttagttatctccacaagcaacatgtaagaaaattgaggctcagaggggtgaaaaggccacccttgatcaaacagttggtactgaacctggtttctagcctcacatgcaggacctcagagctcttaatgattcacccatactagtctatcataggcggcagtgcaggttttgcctctgaccacattgcttacactttccatcttcctctccaccacttacctggggttaagctctcttccagcctgcactatgacaacagcctcttcaagccaatcttacaccctctcgccttcccccaggccaggccgtctcctccatcccaacaccaaggtccctcaaaggaaagaccagtgaagtctcaaccctgcttaaaagcctcagtgacaaccattctgctgggtgggattgctggcaggaaggtggccttagggaaaggctggtttcagccaaggctggaggtggagagaatgttctagaaagcactggttgctggaagggtttgtggatcagagacctctcagttagctcaggcccttggtacatgctcttctctctgtttataatgttcttcctgccactcattatttggctcctaccctgagtgatcccttgcctccctcacctgctagagaccctctgccacaggcttcagttagttattccagcctcctgaaagcacttaccacagtttgaacttacctttgtgaggttatctgattagtgtctttagagctctctaagtaatgtattccttcaagaaagggattctgtctttccccccagagaaacccccacatgcagcacagagcctgatgtgtgaaacttgctgaatgagttgaaaataataagctaatgattttataaattcatttaaaggatcctcagcttctactgcaatggttctcaaacacctggtggcagggggggtgtttattaaatatgcacattcttgggccccacgccagatctactactaagaacctccatgggtgtgaactataatttgtaagcaaaatgtataagcaagctcccaggatgaattttgatttggataagagtttggggacttccttcttagcacacaaaatccagtctttattccatttaggtgtgttcaaatggtgtcatctcagtgagccctcctctgcccctcttatttaaaattccatacttccagccctgtctgacccggcactccctatagacacatgctttatttttatccagagaacttgtctgtcacttcccactattatacatgagggcagggatcgttggtcactcctactatattcccatttcctagaacagtgcctggtacacattagacatccaatacatgtttgaattaatgccaagtttgccccatagagcatttatgatgttcaaggccttaagcagctgggaaaggagagatgctgggccacataacttgagataatattgacattcttttttgctatttttcttttttccttttgattagatgacacttgagaaattaggtcagccatcatactttctgtccaaatggctgttgggtcatgtccacctaatagaaaggcaattttggctgctaatttcctgtctgatcagattaattgaattcagacagtgagcacagagccccctttcagagtaaagaagacagcactgacattagtgctcatgcaggcttcttagtttttctctgatgaggagctgtgttttatttccttgatcttggaattactgagagagatggagaagatgcaggggagctcagaaagcgtgtataggaggggcttaaggagggggcaccattttcctcctggcattagtaaaacctcaggagtgagccttatgactctggcttggaagataagggggggcctgctttgtcacttgtgactacaggattaatgacttggttatacgtcatttctgaacccatagtgtctgtcgcccactttatgggaattaaaccttccattcagagcaaataagttccccggatgccgggcacagtgggtagcggtgcagggaaggaaagaggggtgagggaagggtcacaaatgagccatgaaaactgccctgaagagcttacaaactaatgaagcactttcgtttttatgctttatgttctataatagaaaaaatcgaggtggcttataatgaagactacagattaatgatggtcatttaaacaattataacagaaggaaaaaatgtacaaggaaaggagttaattagaacctgaacacctaggccaagactgatttacaggatcatagcacatcaggattgaacaggcttatgaggagcactcagttcaaactcgccccacactctcaggctgttgtccgaatcctttcaagggacagcccaatccatcccaatcactccaactctgagaacttctgcttgatatatttcatttatcaagctgatatctgtttttccctttggtcctagccctatccattaggagccccccaagagcagccctatcattctacaagatggcccctcattgaataagttgagggtttcctcttgttctctgtcttctcttcacctgtgtctttggtgtttcccatatgacttgcaagcaccttgagccagtgattgcctctcaaacacctttgagttgcagaatgtatgagttcattttcaccctgctaattaaaatatacccaggactgggcaatttacaaaagaaagaggtttaatagtcttacagtttcccatggctggggaggcctcacagtcatggcagaagacaagagcatgtcacatcttgggccaggcgtggtggctcgcgcctgtaatcccagcactttgggaggccaagtcgggaggatcacgagttcgggagatcgagaccatcctggctaacacggtgaaaccctgtctctactaaaaatacaaaaaaattaccttggcatggtgacaggcacctgtagccacagctactcgggaggctgaggcagaagaatggcatgaacatgggaggtggagcctacaggagccaagatcaggccactgcactccagcctgggtgacagagtgagactccatctcaaaaaacaacaaacaaaagcatgtcacatcttacgtagatgttggcaggcagagagagtatgtgcaggggaactcccccttataaaaccattagatctcatgagacttacaatcatgagaacaacatgggaaagacctgcccccataatacaattaccccccaccaggtctctccaacaacatgtgggagttcaagatgaaatttgggtggcaacacagccaaatcatatcacagaactaccacaatacctgttacaaaatgggcactcaataaatactggataggtggattcattggtacctgtcttcttaaaagaagaaaggcaggataatcaatgagaggttttctcactcatggttatgaccttgcatttggatggaaagtcatctacaaatatgttttcaccttctcagggcaggctgaacaaagcctgtctgaaggttgtcagataactatgttctccaaagtatggggagtttattaaaaactcagatgcctaaaccatactccgaacctactgaataaggatctctttctgtggggcccagggaatctgcattttaacagattcctaggtacaattcagtttgggaatcctacaaaggctttaaaagggcaaagatttcttaaagtgtgatcagtgagaatccctgagactttttcaggggcttcatgaggtcaagactattttcataaaaatactgaggtgttttgtgcgttcatccctctcatatctcatgtatatatcatggagcttccagaggcttcctggtgtacatcattgaaccagactcaaagtagcagataagagaatccagcggattcccttaagtcaaacgtgaaagccctgcaatagccactctttctactatattttcttttgtttaggaaaatacagtttttaatttaaaaatatttttatgttaaaaagctatgagtttatttttttagtaatttggtaatctttttaggttttgtagaaatataaaggatcctgaaaccaaaaaatttgagaagtttgtttgctattgggcaacaaactaaataaatgtatttaaaaagtagatttcctatctttattcagtgaaatgctatatcaagtagttgatcccatgtcaacttaatttgttaaaattatgatttctattgataaaaggtctcatagttcctattctccaagaaggccaaggtgtttttgcagtattgcagcatgagcaggaatcaggcgctaagtattgctttcctttaaaaaaaaatgcattatatttcccagatttctggcaaatttgcagttattcaattttaagtagcgggaaccaaatccatctggatttttaaaaagtacaaccccaggaattttgtgatcatagatatgactcctttatctctcattcccaaagcttaaaccagatccagcttaaagtcatctgattttcttttagctcttccccattcaccatgggctccttaaaccaaagataccttctaagcaaaaggcaccttctaagctccaagacaaccctctgaaatggggaaaggtagcagtattgtggtaaaggtttaatgaatggcttggaggacgtgcaaagccaagccctgacttgccagtttccatggtgtgaagaatcccgttatagttggttttgagttgaagctatcaacccggcatcactaaacacggtaatgggaagggaaacatacaacaggctctggaggagacagcaagaaaaactgtctaaatccgttctctctttcaaccatccagagtttactctggatcctggcaatgccggttgaggtggcattattccagggtagtctttcatatgtcagcagagaagagaaggatacaagtgtggccaaatatgttagaggctggagcaaactccttgagagcatctgattcgcattctgtgaagaacctgtattcatagcaagaaatgaggctgaaaagagaagcagtgaatttagaacatgactaccttgcctggagaggggaaagggcaggatgttgaaccttagtctcataatcagtcttatcagaataacaatagccagcatgctaagcctggatagaaatacagaaagcacacagcactctgcctgccttatactgtagtagtgacatctttcctttttatttatttattttttattgtaatgggtgctcttttgggaagaatgaatcaactacttttgtgcaggttcgtctcattttaacttttttttttttcattttgtgaatttgaattgaatatttagtcacaggaaatagttttaagttctctgggaggccaaaggtaagaattccatgtcatagatacaaacgagtctaatatcagggctagatttattctgattaaatcattgtaagtcagctgtttttatagatctgaagtagaagagaaagtaaatatttcatccccgaggatttgttagtagagatttacatgcctccattccactcttgagtttgaatttaaaatagtcacaatgccgaggggctcctggatgcacgcacaaagtaattgttttacaattctgttagacaaaacccatagcacaatagctgcaatgcaagtgtcagaggttagggggaacattaaaatcattcaaacgctgcacatatctgccgcattctggaaaccgctgctaaaaatgggtattaaatctcaccttaaaggtcaggggcaatttacccatctttattaatgagtcgaaattatcctggaaggaaccggctattaaatatgtggagttgagacaatcggctatacatctgggaaaaacatcattagcttcctctctcacaacatgtagtgacacacatttctagatggatatgagatctaaaagtgagaagcaaaccataaaacatacctaaagataatataggcgtagctcagagatatcaaaggttgatttcagaccaccacaatcaaaggaatatcacaatgaagtgagtcacatgatttttttttttgcttttccagtacatatagaagctccatttatactatactgcaatgtagtaagtatgcaatagtttcatgtctgaaaaatgtacataccttaattaaaaatacgttataactaagaaagtgctaacaaacatctgaatctttttgctggtaaagagtcttgccgcaatgttgatggctgcagattgatcagggtggtggttgctgaaggatagtatgcagggtactgcagcagttttttaaaataagacaacaatgaagtttgtaacatcaaacaaggatttcttttccaaaatctttctctgtagcatgtgatgctatttgatagcattttacctactgcagaacttgttccaaaattggagtcagtcttctcaaaccctgctgctgctttgtcgactaaatttctgtaatattctaaactcttttttgtcatttcaactatgttcatagtagctttaccaggagtaggttccatcttgagaaatgtctttctttgcttatccataagagcaattcttcatccattcatgttttatgatgagatggcaggaattcattcacatcttcaagccacacttctaattctagctctcgtactgtttccatcacatctgcagttccttcttccactgaagtcttgagcccctcaaagtcatccatgagggttggaatcaacttcttccaaacccctgttaatgttgatattttggcctcttatcatgaaccaagaatgttcttaatggcatctagaacagtaaattctttcccgaaggttttcagtttactttgcccagatccatcaaagaaatcatatgccagctatggcctacaaaatgtatttcgtatctcataagctatagttttacaaaatgtcttttgaaagtcaaaattactccttgatccatgagttgaaaaatagatgttgtgttaccatacacaaaaacattactcttggacatttccgtcagagctcttgggtcactaggtatattgtcaatgagcagtaacattttgaaatgaacctttttttcctgagcagtaagtctgagcagtgggctcaaaatattcagtaaactatggtgttaacagatgtgctgtcatccagattttgttattccatttatagagcaagattaaatttcagaatggccaataagcatttgcttcaattttaccccctaaccagagagtctgcctattctttgaagttttgaagccaggcattgacttaatctctagctatgaaagtcctacacggcatcttctttcaattgaaggctgtctcatctacactgaaaatgtattgtttagtgtagccactttcatcaacgatcttagctggatcttctggatatcttgctgcagcttctatatcagcactcgctgcttcgcctagcactatgttatagggatggcttctttccttaaacctcatgaaccaacctccgttaggttcagacttttcttctgcagattattcacctctctcagcctttatagcactgaagagagagcactttggtctggattaggctttaccttaagtgaatgttgtgagtagtttgatcttttatccagaccactcaaactttctccacatcagcaataaggcagtttcacttccttgccattcatgtgtttactggggtagcaagttttgtttccttcaagaacttttcctttgcattcataattcagctgtttggtacaagaggtctggctttcagctatctcagctttcaacatgtcttcgtcattaagcttaatcagtctaggctgagtggtggctgacacctgtaatccccgcattttggtaggctgaggtgtgcagatcacttgaggtcaggagttcgagaccagcctggccaacatagtaaaacctcatctgtgcttaaaaaaaaaaaaaaacgtagccaagcgtggtggcgcgcacctgtaatcccagctactcgggaggctgaggcaggagaattgcttgaacccaagaagcaaaggttgcagtgagccgagattgcaccactgcattctaacctcggcaacagagcgggactccgtttctaaataaataaataaataaaattttagggaaagcttaatcagtgtagcttttgatttaaagtgagggccatgtgtctcttcttttcacttgaacacttagagaccattgtagtggtattcattggcttaatttaaatattgtgatatctcagggaatagggagtcccaaggagagggagagagatgggggaatggctgctcattgcagcagtcagagcatacaccacatttatcaattacatttgccatcttttgtcttctgcggacatggctcatggtaccccaaaacagatacaatagtaacatcaaagatcactgatctcagatcatcataagagacataataataatgaaaaatgttaaaatattgccagaattaccaaaatatgataccaaaacacaaagtgagaatatgttgatagacatgctcaacgcagggttgccacaaacattcgatttgtaaaaaacacaatagctgaaaagtagaataaaagcaaagcacaataaaatgacaatgacttatctgtgaataggagaagctaaaaatgtaacgttggaccagagagggctagtaagcaaggctccaacccaaaaaatagtaaataaaaatataagtcactaaaacccctgtctatttgggagatcataaggttataaaacaagtgacaacaggacagaaaaattttgcaacatacatgccagacagttactgtccttagtgtaaaaagagctcctgtaaatcaacaagaaagagacaaataggaaatggaagaaagttggcaaagaaataagttcttccagtgccttgagagaataagttttcctttccagcaaacctggacaccttaggggcttctgaacacattgcattgcttcctcattcagggctgctgatgggtggattttcatcaaagcatattttcatcctgttattctattgagcaattgacctctgtgggtctccatggttgataggctaacatgtaacctcatcatggtatttgatatttaattaaatgagataatttgtataatgctctagtacagttttaggccatggtaaactccgaattaattctgttcttcactccttatttatagcattgctgagaaaattaggtgagattctgtatttagaagaagaaaagttcccacttaatgatggggctgctcaataaatgttggtcctcttctctagaaaccctgactcattcagcacaatcccttagatcttcacagatttttaaatctttaattagggctcctccatcctggctgaatgtttgaattacctgtggagttactggatgataccaatggccaggccctaccccagacaagttgaatatgaactccgagtgtgggacccaatgtattttaaaaagttccacagaatggctgggtacggtggcttactcctgtaatcctagcaatttgggtggccgaggagggtggattgcttgaggctgggaattcaagaccagcctggccaacatggtgaaaccctgtctctactaaaattacaaaaattagctgggcgtggtggtgcacacctgtaatcccaactacttgggaggctgagacatgagaatcacttgaacccaggaggtggagtttgcagtgagccaagattgcgctactgcactccagcctgggcaacagggctagactccatctcagaaacaaaaatttccacaggagattgtaatgtgcagccaggggcaatatctacctgaaatgtcctttagtgttcttacagtggtgcctttatccctgaggtgccttttcccttccaccttgccatcatcggcctctctgtgtattaaggtcttagtttgagctggaaataaccttctttttggaacccctgcagcatttacatcctttggtcttagaatagccttttttggtaataatatctacttgtaataatatctttatatccagagttgtaagctcctggaggctggggatataattttattaatcattacatttttgtaatgtgtgtttcagcatttgacacatagcaagttctcaaaaactgttgaataaataaatgaatgtaagtgaatgaggatagacatgtatctttacacaagcctagagccaaaccattctctgtgagatctgaaaccaagcccctgtagtctgtgtgttatcaaacacagtagttagcttcacagacagccttattaactaactcatcccgcagttttcaaagagcatgtatttcttgtcattcatgaagttgttagttctggggaagtgttggactttggtaaacaccctctctttcggcttctcacttggattttcaatcctgagcaaagagaccactcaggagaagaatctgagtagtcaaagcagagagttggtactagatggcgctggacttactagctgtttgactttgagcaaattgcctgttagaccataaaatccttatctgaaaaatgagatacgatactaccacctgtttcacaggtaaaagtaaaatgagaccactcattaaaatatatttactctagtgccagctacttagtgaactctcaaaaaatgatggactccaggaaataaaaattagattaagattaaagagtacaggctactgtgaaaagaattgagcattttttagtggaaggagggaggaaactaacatttcctaactaccagccgtgtctgaggctgagaacttctctggtcaactcagtgcagaaaaaaatggcaaagtgtttaaatatattacataacataacatagcgtaatataataatatagtaaatataagtatagtgaatataattactttgattacataagtatgattagtaataaatgatagatataaaatagtgttaatataatacaaaatactatagtataatacaatataatgtgtatgtttctttttaaaaccttttcagtatacgttgaaggaaacaaagacccaagtttaatagggaaatgatttttgtaataaagtgaacaaactggataggttctcttgagctggttacagctgttttctgactgaattttaattataaaagatctagccagcttctatacacactctccctgcacaaatgttaactctggttcagacaccttttctgcacccagttattctcactcataatttctttctccttgggtttttgttttattttggaacggctttttaaccttcagaagtacattttgtctggaggaccagagtatcgatgtgatcctacctgtagattcttggcaagagagaaaatgttcttattaatgcagaaagtcctacccagaaggaagaaaacgtctcacctagaaaaaagtcattatgtagttttttctgggctcatggtttcctgaagagacctggtcctagtcaatttctccttggtattttattatttttgtccatttgaggtgaaatccggaggaagtaattatgaggttgttttaggggcacaggtggcattttcatggattggctgagctgactgcctgcagttgatttggggatggggtctactttagggtttcactgagtacaggtggtcacagatatccacaggttccaaccagtgatggaaaatattcagggaaaaaaaaacagtaaaaataacaccataaccataaaaaaagcaatgtaataactatttacatagcatttacattgtattagctatcatatataagtaatctagagatgatttcaagtatacagtggatgttggaagggtgttcataggttgcatgccgatactttgccgctttatataagagacttgagcattccaggattttggtgtttgtgggggagggatgttgaaaccaatatctgcgggtaccaagggacaattgtaactggattctagagcacattctgagtttgttggcagttttattaatcatatttgtattaaaatgcataacgaattatagaggaaaaaaaataaactctactcattgtggccaggcatcacagagaagtgggacaagggtgtggaccaaagaaacagaccaaggagcgtgggcgaactggagggttcctgcccatgtcctgcccactttctgttccaggtttcagaggagcaaagagccgttgcccaagaaataatggctcagccatctttaccctgtctcaaatgcaagtctctaaatttgttcctcctccttgtctggcaagtctgagcaacgttcctgcttcagctctctccccagtgtttgaggcatgaactggattccaggtgatgacttacccaaacacctcaaggagtttcgcctctaggacctgggtggaccttcactcttcccacatcagccccaggcagacctctctgcacgatgccagttgcatccatattacagctgacatttgcagttgactttactttgacaaatatttttccatttttatggtgaacccaaagagttctatcctcagggcatctgctagcccctgtggtatgtttgtgtagaatttaaaaggcatgctccctctggtcagaggcagctttacagatgtacaaatttgggtgatagaagtttccgttgtcaaatttaaaaatatatcctattcttcacacctgtaatcccagcactttgggaggccaaggcagacggattgcctgagctcaggagttcaagaccagccttggcaacacagtgaaaccctgtctctactaaaatataaaaaattagccaggcatggcagcatgcgctggtagtcccagctacttggggggctgaggcaggagaattacctgaacctgggaggtggaggttgcagtgaaccaagatggtactactgtattccagcctgggcaacaaagtgcgactctgtctcaaaaaaaaaaaaatgtatatatatatatttatatatatatacacacacacatataaatatatttacatctatctatctatctatctagatatatacctcatattcttgtgagtggactgaggctcatgccatgtggaaagtgaagcaagggctggatatttgattcctacttgtccccctgccatgcccgtgctcctatgtgtattataacctgtaccccatagatggttcttgagattactcctcctttcatctggaagataatgttcatcttttttagggccaccttcatgagcgcatgctgaaggtacccatgtaaaaaggccataaatgtttgaaaagccttcaggtactttataggccatgttcattctgcaaatgtcagtggaatgttcaggaagtccaacgtagagaaaggcccaggatggctagaatgaaatcagagatatccagtaggacctgatcactggcagaacccagactggggccagctgatgaagccagagaggcattcgcttcagggaccaaaactttcattcagtaagagcgggggtcctcaaccacgggccacaggccagtactagcctatgacctgttaggaacctggctgcccagcaggaggtaagtagcaggcaagcaagcaagccaagcttcatctgtatttacagccactccccatcgcttgcactactgcctgagctccacctcctgtcagatcaggggcagcattagattctcatacgagcatgaaccttattgcaaactgtgtgtgcaagggatctaggttgcatgctccttatgagaatctaatgcctgatggtctgtcactgtctcccatcacccccggatgggtccctctagttgcaggaaaccaagctcagggctctcactgattctacattatgatgacttatataattatttcatgatgtattataatgtaataataatagaaataaagtgcaccataaatttaatgtgcttgaatcatccccaagtcatcccctcacctcctcctggtccatgaaaaaattgtcttccatggaaccagtccctggcaccaaataggtttgggacctctgatcaagagtgatagcattgtaatgtaacatttttgaaactcaaaattaatgcatagaagtccatgagaagtaaaatgttaaagacaggatcaaaatcaatgcagaaaatccataatgagcaaaatatgaacatgttttaaaaagagggcatcagtattactgatttctttcgtttgactcaggctccagtacagcttatgttggcactgtgatgtatcctgtctgtatttaaaatttttaggtagtgtccatcatgacctttttgcagtaattgcgatttttaaaaatattgcgttaaaatagtacatatcttgattactgagttttttggtgcctcctttgagatggtgcagaaagcaagctcctcactcatctcctctagcccagccccaatagctaactcactcttagcgcctgtccttgagtgctgtgtgagccattgtgttgcaccagcttgttttaagtcccaacaatcttgttccatggtgtcttttaataatggaagagcaaagaggttaaatgactagcccaaggtctacatgaggtggaggaggagggaatcaaattaggcataaagcctattgcttggatcatgtttagtaacaaggagacggaaggtggaggatatgagaggctgatcaaggtcgcaggagcaagtgcagggcagagacagggtggcagctccctgtgccttctggaagccatcccccaagctgaaggagccacacagagccagctgtccaggcaggacctctctgcggtgacattcacatggcagagttaccaagaagaaagcttgtgtccccaagacttgtatttgaaagttaattgcttaaccttttcccaaagaatcgtcagcaaatattgcacacacccacaaaaattattttgcctttcataaagcacaagtggacatgtctttatttctctgcaaaacgagccgctgcagtgcaatcacttgaaatgtagggtctgaatgaaaattaatgctgttgatgaaaccagcagtctaaaacattacaggatattagactgaaaagacagtggtatttgcatccttttgaacattcgcctggatttgcataatggagatgtcacttatattgcaggagaaaaatcaagttacctgggctcccattaactgcctgctcgctacagttcccgtaaggggttggaacaccacctttttgaaatagaaaatgtgaaactcctacattcaccaagtgagtctttagtgaaacaggagtgaaaagaatcatgggctattgcttgctcctggcctacaagaaccaaaaaagacacatttctgctggaggcgaagaccaggaagaattcactgtctgcatatgaatgtgcgtgaacttggttgtcaggaaatgaacagtacataacccaacctgggacccttttggcctctacagcttgaaattgtaacaccagcttcactacccggttatattaatctcatgtatttttggtatctggtgacagcttctttctgaaaggcttctgtttagggcggtgtgtggtaactgtgggtgtacatcacaatcatcttggatgctttataaaaatgcagatgcccaggctccactttagtgtggaacccagatattgatattttttcagcactcttaaggtgattctaatgtgcagcctgcgttgagaagcactgctctaaaagatctctgctgcattttatccttctcttatttgaggctgttttaatggagtaaacatacaggattcagcataatataaatttaatattaataatgccagggacatctaagggcacattcaccccaacagtagaaactcagaatggggacagtctagctggaccatttatcagctgcttgggcttgggtacgtggtttagcttcttggtgtctcagttttctcactttgaaatggggataataatttcctttctgatcatatgtaaggatttatgacaatgtctatcatacagttagcctgtaaatgatacgttctattttatgtaaccattaaaacaatttctttgtgggctgtactttcatccagctggatggattttaaccaagtgatcccacctctatagccagcacccagattaagaagcagaacaagactcttcctcttatagccccttctaatcaccagcttctccccagagggaaccactcttctgacacttaactgtacagattagattggcctgtttggggactttctactgatggacccatgctgtgtatactcttttctgtcaccttctttcagtcatcatggttagtcagatgcatgttgttgttgcatatcgtttgttcattctcctccttgctgctgtgcaatataccattacgggaactaaccacattcaattctattttaattgttagtatttacaatggctccctaactgggatctcttttcaaacaattcactcttcagtccctgatatgatttggtgctgtatccccacccacatctcaccttgaattgtaataatcccctcgtgtcatgggaggcatccagtgggaggtaattgaatcacggggggcaggtttttcccatgctgttctcatggtagtgaagaagtctcacgagatctgatggttttataaggggagttcttctgcacacgccttcctgcctgtgaccatgtaagacgtgcctttgcccctcctttgccttccacggtgattgtgaggcctccccactcatgtgggactatgagttcattaaactcctttttctttataaattatgcagtctcaggtatgtctttattagcagtgtgagaacagagtaatatattccctcttatcgaatgacttctacacagtgtgaatgagatcagattcctcttcagtgcggaagaaaactagacctcttggtcctgtgttcagggcctttctcgggctccaaggccctcgttgtgactgtccactgtccatgcacgtgcactttttttctttctgaccatgcatcttcactcagggccgcctttcaccttgcttttcctgactgttctctctgcctactgcctagaatgtttttttcccatctctacgcagggaacatctatacatttctcaagatctggagttcagtttgtcacccgtgaggagcctccttccacttcgcctttgctaatccatcctgtcttttgtgcactcatgcagcatgtcacgcagacctttgttaaaggtcttatcaaatggtatttgacagtacaggtctatttctctatgagactacccgttgttcaaagcggcaagctaccaacctgatctcattcatctttgcatccttcatgctgattatagtgatcggctgttctcaattaatgaatggaagaattaatggataagtggataaatcacttaataaatcagaaatcttttagactttgctgctcttcctcgaagcataattctggttagaggtcacgtagtaaatatattcagggggttctacttcttcatcttccagggagaattgtcgcttttctcattcaacttttcagcttattgtacccccgctttgtaccccacctcactcccagcttctagatacctgaggtttggcgacccagctacgagactgtcccttccttccaccacctgatagtgcaaaattgggacaaagtcatcattaggcagcgtagttagtagcaagatattagaagtcctcagaatagcatttgcgttttcatatactactttgttaaccctatgcaaaaataatccaagatagaattttagtagatttatttccacagagaccaagatagttttcttggtggccgtcataactgtttgatgtaactaaaaataaaactagccctgactgctaataactcaaaaccggtggagattagagcaagggaaatgtggttaattcaactccagcttgctttgacctgaatttatgccaactgggacttttgcctgaattattcgggaaaatgccctgagctgccccttaattcatcttgtacgtttggtctcttacatattgaaaaagtgtgttctatgattcttttccatatagctaatgtcatcttgaccaggtcagagttcctccaagttgtttttaacatacaaatttatcacatcacgtttcatcatgcctgctcccaatggtcatgagttattgaatttgtataggagagttaatttgtaatgtccttgaggtatcatttttcactattggcctatgttggccacctttgtttacatttagttcagaaagcactaatttaagaagtgtcaggttgtaacaaaacataagatcaatgcagttagtttctgttcagactttaacaacttggtatctgtcaactgaagcatgaacatagatatgggcaaaacccaattaatacacagttgtaatcacagtgggacttagtggtactttctcctttgcacagtgggactcttagaagtggcttcattaatgttgcatttgtagtttgagttctgctcttcttctcatattgcctagttctgggcctccctgtcctctgtcctgtggccacttttccatgtggggacttttggggcctgatggctttttggtacctctgctgtcctgctagctgccaagaactctccattactccccctttgattgcttgggacacatttttaaataaagcagctttgggccacagcgacaaaaagtgtagagccatctttttgttttgcagcctctatttctgttttgaacaggtcttttcaaatcaagcggtaggagctatacctctcccagatgaggcccatcacacactctcactaagtaggcaatttctttggggtgataaaaatgattacaaatatttgaattggaatcgttgggaatctcattaaaaacaacaaccatgatcaggtgacattgtatttgtgaatatcctcagggtatgttcagaaaatcagtgttataagagcttgaacgattatattagtttagcttgatagtgctctgtttcttttctctttacacttgcatggcataatatattaataaaaattaagaaatttttagtgaaaccaatgaatttgctttcagaaaacagcattttacaatatctattgggtaattatatcaaatactcgattccatggtttctggtattggataaatgactaaatttgtaattaaacacatcttttggactaaagttactaaacagatagttgagtcaattacataacagcaatgggcattacattagattttatcacaacagtaattactgtgtgatgttagattctattttgaattgctctttctaaagatgggttatcagcaacagaatatgcattgggcttttatgagcggtctttgcactactcatatctgataagggccaaatcctatgataagaggtcagagactggtctggcagtaaagagccttcattaaattatttttaatagtaagcatttattgaagcttattacgttagaacctgaagagtcacagacatgtaaccttccccatgccttctggggtccttgctctaatttgggagatacaacacatagagaaaaaggtacatgaggcagccttgccaccggaagaaaatggcactcaaattcccagctgtcatctgggaaaggtcaattgttttctttacaaagccaccttcatagcaagactttatccatgtcagcagtctagaatgtcgtcatctttatagactcagaagcttgatttggtgtctatattcagaggttatttctatctcagggatagtattttactaatcaaatacataacagatatatacataaaccagaatgaaaacatattatagtgagaaatgtaattattgattgaactggatatttgtcttttcatgtcaacttattcattcagagcaggtgtgggaaaacaaattttagtcatgaaccgggttggaaagtattaaaaacgaggatttggtcatcttaacaaagtgtttctcagctacagtttcttcccaacagagtgggagctaacaataggaataacaatcagagccataatctctaagggcttcactgtttaccaggaattatactatgcccttagcatgtattatctcatttaactcccatgataacttttcatacaggtattattgttgcccctgtgagcaggaggagaagattgaaaaaaatcaataactaccccaagttgtgtagctaggacatagcatcaaggattccaagccaaggattatctgacttctgtttataaactatttttcttttagaattttttcctttcttttctaaaattgacataaaattgtagtttttactgtgtacgacatgatattttaaagtatctatacattgtggaatgattaaatctagctaatgaacatatgcattatgtcacagttactatttttgtgttaagaatattttacattcactcttttagcatttttaggaatacaatatattgttattcattgtagttgccatattggacaatagttctcttgagcttatttttcctatccaattgaaatgttctatcttttggccaacatctccctaacaactcccaattccctgcaaccaccccagcccctggcaaccaccattctactcactacttctgtgagctcaacattttagcattcacatgggaatgagactatgtggtatttgccttgctgtgcttgagttacttaacataatgtcctccaggttcatccatgttgtcactaatgataagatttcctgtctcatataatatatacatatatatgtgtatgtgtgtgtgtgtgtgtatatatatatgtgatattcatgtattgatggacatttaggaacaaattgaacaagggaagtgaatgatctttacactgaaaactataaaacactgataaaagaaattgaagaaaacaaaaataaatggaaagacatcccatgttcgtggattgccggaataatattgttaaaatgcccgtactacccaaaatgatccacagattcaacataatctatattaaaatatcaatgacattattcacagaactaggaaaaatcatcctaaaaatcatatgaaaccacaaaagaccatggatagccaaagtaatcttgagcaaagagaacaaagctgtaggtatcacactacctgacttcaaagtatactacaaagctgtaacaaccaaaacagcatggtactgttataacaacagacacatagaccaattgaacagaatagaaaacccagaaataaactcatgcatctatggccaactaatttccagcatagttatcaagaacacacaatgggggaaaaaaactcttcaataaatggcatttgggaaaccgcatatccatatgcagaagaatgaaattggactcctatctgacaccatatataaaaatcaactcaaaatgaaataaagatttaaatgtaagacttgaaactatgaaacaactggaagaaaacatagggaaaagttccatgacattggtctaggcaaggattttttggacataacctcaaaagcacaggcaacaaaagcaaaaataaaatgattatatcaactaaaaaacttctgcacagcaaatgaaacaacagggtaaaaagacaacctatggaattaaaagaaaatatttgcaaactgtacatctgataaaatagaaaaaacaatgaataattgaaaaatgggaaaaggaactgaatagacagttttctaaagaagacataaaaatggccagcaggcatatttttaaaatgctcaacatcactaataatagaaatgcaaattaaaaccacaatgagatatcacctcatacctgttaatatggctgttatcaaaaagataaaatataaatgttggcaaggatgtggagaaatgaggaacccttgcccactgttgatgggaatgtaagtacagctataatggaaaatagtatagagattcctcaaaaatttaaaagtagaactatcatatgattcaacaatctcactagggttatatatccaaagaaaataacatcaatatgtcaaagagacgtctgcacttctgtatgtattgcagcagtgttcacaatagccaagatatggaatcaacctaaaaattcatcagtggatcaatggatcaatggataaactatttttaattgaaagaattaaaattgtatctttatgagcctattgatgtttcagagaaataaactctggtcattgaatgaaatctctgtgttgcagaaacctctataagctcctatgtacagataatctcacagggtaaatttctctgactagctttccacattcttagcattcttttctcagagaacatgtgtatagtccttgtatagggccataattttcagatacacttttcccactcttctttgtgcttctctgtccttagttgcttttctcatttaatctttataatttccctgtgatttaaattatactttcattttacagatgagaaaattgagacacttatattcacatatcccactctaggtcagtcagtagcagagtcggatgatgcattctgttgttagtgcctggacaattaagtaccaagaaatgctattgattataggagttcatggtagggaagaataaggctgataagtaatgagtatagtttaagggcagacgtatttggaaaggggagaggcataagacaggagactaggaaatggtagacctctgtagtttattagtaatgtctgcctcggagtgacttggaggatgtggtaataaaagcatctgcatgtacccttgtggctataagtttcagttaattagtacaacacaagtacacacacacacacataagtggatctcagccatctagatgggacacagagtttttatgacaggcagggttaatgatttcataatggtgaacttttgccaatctcactactatttgaatatttcacaacttgttcaaattgttaagtacaacagcagattgcatgtacacccaataacacgggtttatgtaatgtacatgggtaaatgtacatcttccaagggagaaagggtgctctgtgtttccagcatgatggaacccagtttcatgatggattggcatattccatagatgaagaataattactggaaagaatgcagagccattggggactttctaaatagaggaatgatgagataagatatttgtttgggaaatcgctctgaagaagatggaatgaaggagagagggacttctggaaggctgtggatctattttcattttaataagcatggggggagaagggtaggagagaggatggtcaacaggtacaaagctacagtcacataggaggaataagctctggtgttctattgcataatagggtgactatagttttcattattatattgtgtatctgaaaatagctagaagggaggattttgaatgctctcaacacaaagaaatggcaagtgtttgagatgatggatatgctaattacctggatttgatcattatacaatgtatacatgtaccaaaagctcacattgtaccacataaattattaatacaataattgtacgtcaattattatgtgtcaattaaaaaaacaaaacttaaaaaatagtactaatgggaggtgaagaaggtgtgaataagggcagaaagactgagtgggacgcaagtgaatgtaacaaatgctgttctcaaatagctctaacttatctctcatgcaccagagcactcttgtttctcactgaacactttttgaatgcctctttcatgttgggcttgggcactgttctcagtggtctttgtagttagatgtttttgccaaaatgttggaaagagtccttgatatatggaaactgacaaagacataacttcaaccagtcaaggagatttcagtgtcagataaggctttgatgtgaacatgcctggcacatagatggttaatatatatcctatggatgaagaaacatacaaatgaccaaaggaatggaataggtagactaatcgaaggacattcaagatagacttctaaatgcccgaaacttttcaaagtgagatccagacctttcttgaggaatgatgtttctctactctgatctgtacagttggtgaaaataagaaagaagatggaacccagcacggcagctcacacttgtaatcacagcactttaggaggccgaggcaggaggattgcttgagcccaggagttctagaccagcctaggtaacatggcaaaaccttgtttctacaaaaaaaaaaaaaaaagaaaaagaaaaagaaaaaaagaaaaaaaaattagccaggtgcaggggtacgtgcctgtggttccagctactcaggaggctgaggcgggaggaaagcttgagcccaagaggtcgaggctgtagcgagcaatgatcgccccactgcactccaggctgggtgagagagcaaggccgtgtcaacacaagacgagacaaaatgagatgagacgagatgagaaaagaaaaagaaaagggaagaagtgagggagggaacatcagtgcaggtaaaatattatttttcttagaatgaaaccaagccagcaagaataataacttttgaaagcagtatttctccctgtgtagcccttagacaataggcatcaaaatttcttgagtgtatgtgacggattcctaggccctacctcaagcctgcaaaaataatctctcacagagagaaagggaactttaagcaagctcctcatttccttttgctgcagtaaaaatttctaagaatcagtgggttagagcttcctaagcacttaaaaactccaagaagtaaggacctgttattagaggtaacaagtataggctaatttgatttccttagaaaaccttcaaaacagcagtgtcacagaatcactcttgattaaccactggacttggaaaggcctaaggttgagaggctcagatggccccagagtaaaagccctcagtatgcctgcttcactgagcattacatgagactgttccagctctgtgatgatcaaataagaaaagcttgtgaggattttcactcttcacaatgtgatgtcttttccaataacagcattaatagagaagtgttatctttagggcatcttccttgctttatgtattttgcaataaatttatataatttttactgtttctgagtgtaaaagtaatgcatgcttgttttaaaaattataaaatactataaagcatgagtaaaaataaccaatattcctaccaccaaaagataagcaatgtcagtatatctcctttcagacatttttagtatgtacatatgcatataattttaccaaaatagaatcataccatatacactgttttgcaacctgttttatctaatctgaatggagataatatctttctgaatcatgtatattttcattttttaatggctggagaagataccacagtgtggatgtttctctttgttttattattcccttattttggatgcttgcttggattgtttatcaggccatgaaaaaaaaaaaaaaagatgaattccccagaacattataaggaaatctagggaaagacagcactaccttaccttaaactttctggctcatgtcacaaatcagtaggtttggactcctcatgcttgcagcacatacactcttgctatcctcattctctctaggaaccaccattcttcccccaagtctccatcactcatctgcttttccgtggcatgtcattcatcctcactagagatcatcttacttccctcgattattctttgttcattccacataagtgtattgagtacctcctctgtgtaggaattttaaaagaccctagctttatttagtgtttgttaaagcatctcttaacctcctctcattaaggatacagattcatgataaaaaccaaacaccttgaccaaaaggctaacttggaaaatgccagttgttattactgcaatctcaagtaatgaaaattcatggagtttatataagttattgcagcataacactttatcccaacacttagtggctgaaaacagtacataatgatgagctcacagcttagtgagatcaggcgtctcctcatggcttagctctgctggaggcctcaggctgtaatcacgatgctgaccagggctacaatcatcccaaattcagatgagggcaaggtctacctgcaagctcacttgattgttaacagaattgagttcctcataagttgtcaaatgagagcctcagtttcgtcacaggagtaatatcccatcacttttgccatattctgttcattagatgcaagtcactagttttagcccatactcaaagggaagagattacccaagagggtgagtaccaggaagctgggatcattaaagaccatctttgaagtcaaggatatgctcatagagctgatagacagtgataaaacctcagcaactgaccagaaaaggtcaacttagaaaatgagattttgtagtttaaactcctggaaattcatagatcataacatttcaacttacttttaagttgagtgacatgaagagataggtcaaaatatttacatttgctaaatgtgtacttactgttctttatatagagctttgcagcttacaacatacagttctgtgtcaatattttcatttgattttctcaaacctggaagggaggaatggaagatgttatctcaaatttaaagacaaatgaactgagacctgacaagttaccagctgagtaggttacatctttctgccagttcatgtgttggttcaacaaacgtatacaaacaaatcttatgtgcttggcaccatgccaggcagggtctggggacgcagtgttggacaacatgaatgtagttctgccctcccagaacctagtatcttgtcaagatgagacgttaatccaattaaatcttacataaaataagactgcaaactttaatattttctaatggttgaaaaggttatagatcatgatttatgcagtttatatatgcaggtttacatattttaaaattatccagctgcattcttaagatttgtacattttactgtgtatgtgatgtttttagaacatcctgggaaggaaagctacatagcgctaaggtagttcgttaaagaagacgtggctgagagccaggaaacagggatttagatttcctcttcaccaagtggcacatgtgtcctgaaaatgttaaactgtgggcatttttaatattgcacatgttgaactgatacatataactttctggggttttttttttttttttttttttttgagacagagcctcactctgtggtccagactggagtgcagtggcacgatctcagctcactgcaacctctgcctccggggttcgagccattctcctgcctcagcctcccaagtagctgggactacaggcgcccaccaccacgcccggctaattttttgtatttttagtagagatggggtttcactgtgttagccaagatggtctcgatctcctgacctcatgatccgcccgcctcagcctcccaaagtgcagggattacaggcgtgagccaccgcacctggtcagggttttatttcagaaccgtttatttccccagtacatttatccactctacctccctctctgtgattttccattttcaggctgtgccgtgctggttttacccagtaccttgtttaatgatggagctcatcatttcggagtttttctctccgtgatgctgccacatgtgtcagggctgtgtggctgttacagaggaagggtctcgtggggagggagcagtgaaactggtggagcaagcaaggtcggaccgacagactatcttctcggatgtaagagaggttgttctagggaagccgtgttcctggcgctgggaggctttacgaagagtttttgaaatctccagcttgaacgttagtgtaccttattatggctatacttggtctcaggatgccttctgccctcttattttttccttctttgatgttcaaaaatttacatcatttcctgtaatttttttttctgtaaagttttggcagacacagagtcaccactattcattttacaaaaatacatttatgcttaatttaaagaaataggcagggagaggggtgctctggttcttgttttctggcagatacttaagaaaattggaagaaatcactttgaaagatcaatgagacttcaataaagtaaatttaagaaaaaaaaaaaagagttaaggaatgaagtaaaacttgctagggttaaaatcccagctagtccattccttacctttcttacctgaaaaatgaaagtggggatcgtccttacctcatgttgttgtgagtactacgtgatgtaacacacagagaatgcttaacagagttctcagtgtagagtaagctaacaaagttgacagctgttggcctcatgacatcatagaaaatgtgcctaacctaaagtcagaatccctaattttaagccccgcttttacttcccggatattcatcctttattggttacttttaacctcctgttgcttcagttttctaaatctgtaaaagggaatgtaatactgacattatagataattccatggcaatcaaatcatggaaaatatgtagaagttcttggcacagaatagcagctctgtaaatattagtcgaatctgacttgtaacattaccaggacccaacatttatgtcaagaaggcatttttcacactgcacaaatggggctccttatattctagaaaataaatatcatgaaagtcacaacataaatgtcctctcacttcttatcccttaattcagagctattcaacaaagtcaattttgggaaaatgttgcaaacatctgatatttaccaggaattaggggagaaacagtggatactaccatggttcctgcttttaaggagctcatagtctaagagtggagtcagataagtcaacaagattacaaaataaatgccagaagaggaaaaagtgggagacgccaaggaggcaaggagggacaccaagcccagccacaataagagtgggaatgtcagagcaggtgacacagtgaggttgctttagcttcatgtgacagatatctctaactcagactgatctaaacttcagtgagaaaataaatttcatcaaactgggaggtcagaggaagggcagacttccaggtgcagtcactacagttgctcaaaaatctcatcaaggtattcggttcttttcatgtctctgatctatcatggctgctgtcatttccagtccaacagtagctctgtttcagtatcatgatggctccagcaattgcccacatgatggcatcagagagacaaggggcatctcttttatctgtcatctttgggaggagaaggaaggaaaagagaatttcctatgttcttttcagcatgggccagtgttggggccaagggaaagcttccccttcaccttccgaaggttcaccttctgccctctgaaaaagaactaatgttaggaagatgaataggagaaaaggcacacaaatttatttaatgtgtattagcctagaaaatcaaaggaggatgatcacgcaataacccagtaggtccagatgcttatacaactttcttcattggggaatgagagattgagtcaatgtgtctgtcaatttgaaggggagtaaataacttttagggggaatgaataagcccagtgctgagacaatggttagtaaataatgttctctttgggaattgaacaggattggagacaaagtttgtctgggctgtaggtgtgatgtttaatttccaggctctttgtcataataggagttttaatcttctggttaatgaagttacagggagggggttgaaggccatttgttccttttgctgggtatggtttgtaggtagataaggaaacttcaacgaacagccttatcctgtgctttgggagtgaaaggtgattgaaagatgaaggaatagggggaaggtcagagaaaccttgaggctactgcttcagtttagcatatctcaaagagccatattttggagtgttgtgttctgatccccaataccagaattaaatcatctacccacccttaaactacaccttggcaagggcacaggattctcatgacaggcttagtggggcatcttgggtgacaggtgcattgaggggttgacctccacaatgaccagggaaggttttcccaggggatctcagactttgcctatctgataggatgaattgggctttttctagtctctatgtgttagaggtagacagagaaacatcccagggtgtgcaatggtattgagcataaaatattttaattattcatggaattccaagtacttttatttgactagactatgggggtagcgcagagtccaaactagtaataggagataaggctggagaggtaggtgagggctggattatgaagactcttaccagccataagaaatgtgggttttatcccacagaaactgggaacacgctgaaatatttgaagctgagaagtacatgaaattggatgtgtcagttccatcttgaaccatccactaaatggaaaggggagtgaggcaagattggaatcttgggaaaaaagactgtgttggtaattttagaaggagtctgaatgggaccatatagctggttaagtgggtgggttggggaatgagaaggagctcaaggtgattattctgtttttttttctgggattttcaagcttccctagaagtctacataaaaatagatatgggaaaatcagaatctaagagctggctactcagatttgatgtagttaatacagaatgactatcaaataatagatatttgtcctcgatacatatgggatcttggccagctggataaataaatgagtattgttttaataaatgcccattggaacaggttctttactgaaaggaggaataatgataatattgtgttgtacgagagagtgtggatgagatatttataagcaaggcattcagcaggtgtcctgtgggttaatagtctgggagtaaattcatgttcatgtcatgtaataaccttggtgaagctgctagtaagagtgaattaggcttcagtagcaaactctctccctctctcccccacctttcctctctctgtctctctcccgtatgtgtgtgtgtagtgtgtagtttattaagtctttaagtattttattcatagcagaactttcccacttttcatattttacaaaggagcattttatttaagctccaagtatgtgtaattgcaatgagccatatacgcattccccacagaccgggaagctttgccacctaaaacagaatgctctcaatgtaagcccaggtgagagttctaaggggctgtcctggggggactctcctgctctgaagggggccatcctggtctaggggagctgtcctggtttgggagttggtggggctctccttgtctgagagctgactcatttgtaggcatcctcatttcagtgtcagaaggactgtcctgctgttgatgacttcactttacttaagcatggttcaatcagaagcaggggagtgaggaaattccttaacatatttatcaacatctgtttctaggcatccagctatgtacaggaaggaactgttgaccacagaaagcatcctgcttgggcatttctgtgcaatgtctctttgctggaaggaccatttttaatctacccgtgtagccagtatgtcctgaggtttccattctaatcccaaaatatgtatatgtcatggcacttttggagggttttgtctttctttgtacagcgttgcggtattatcataagaaaagtctagaagttgcaattatatcttccaagttggcatcccagttcttccacgtagcagctataaccttgatgcagtggaatacaggcgacatggcatgtgacttggagccagatgggagtttgtatcttagtgctgccaattaatagccatgtgatcccgggggcaaatgatgttccattttctttcatctgtacaatgggattaatactacttaccttaggatgttggtgaacagatattatactgtaaagctacctagtaggaggccaaacgcataatagatactcaataaattgtagctgtcgcaattattgacctcctggactctgtgtcctaatctacaacataggaataatgacagtgcctaacttgcaggtttggtgtgaacaatacagtgatcattctaatctagaacagggtttctcaatctcattcttggcactattttcatttgaggctgccctgtgcactacagaatattcagcagcatccctttactgcaccccctagatgggtgtagatacctgtagcattctgcagcccaggttgtaataaccaaaaatgtctcccgacattgccaaatattccctggctggggaaggtggggagctaacgttgtcactggttgagaactactgttccaacatatagaagaaagtattctataaacaagggtaggtaccgtatctgtgctatggtttggaggtggtttgttctggttcccaccaaggcttatgtagaaattggatccccagtgtgggggtgtcgggagcggggaggctagcaggaggtgtttggcttataggggcagatgtctcacaaatgctgttctggagtttgagtgagttcttgcttttgagagcccagattcattcttgtggggatggattaactcccctgaaaggaggctgttataaagcaggatgccccttgggtttcattcccttggcatgtgcccacttcccctttgactttctctaccttgttgtgacagctcaaaagtcctccctagaagtcagcgccgaatccttgaacttctcagcctgcaaacctgagctaaattataataattctgtaattattcatggaattccaagtacttttatttgactagactataggggtagcacagagtccaaactagtgataggagattaggctggaggggtaggtgagggctggattatgaggactcttgcaagccatgataagaaatgtgggttgtatcccacagaaactgggaacccaccaaaatatttgaagctgggaagcacatgaaattggaaattagactcttctttggaaattacccagtctcaggtatacttatagcaacacgaaatgggctaagacaatcagacctatccgtaaagttgtggaaagaaatgcagacaggaaaaagaaaatcatgtttgtttcctgagcctctagatagtaatgcatacatgagaatagtggaacaaattaaacctctttcggcatgaataagctcttcaaagttcagctccacatataagctacagttgggtggggctgtcaattttcaggaaaaacttgtggtaacaacacagggtttgcagtcacttctgctataagccatggtgtcctgggaatgtaagtggtaacgcctgttccctacccccgtggctgaggaacaccagccctgccctattcctctgtgggtgattgtggcgataattctagttccctggaaagcacacatctgagattcagcatgatgtatcttatccccagcacgattattttccccctcattttttcttaagcccttctcctgggaagataaaggtcaacttaaacctgagctccaggcagtgctacctcacttcctcttcactgatcaaatcttaaagcaacaggaatgttccagaattcctctaagtgaattgcacttgtctgtagttgtgtgggcagttctgaagtagctctcacctcacattttaaggcaattttactaataggagcaccaaatccttcagggccaggaaagctctatttaaccatgaatttcctcccttggggtttcgttatgtttggttacaaagtaaaataaacccacactgcttcagagtctggagaggcacaggggcatgatttagctatgttaataatagaaattgaaaagtattttaaaagataacacaccacctgtgccttcttttgattgtgagactaaatgaagaagaaattttttccccggaaatgttactgctctgaacagcattttagcactattatcccatgataacatcagagcgggggagtaattatttgccggtaatatgcgtgctgccgttagctgaatatggcagcacttccatgctgagatctatgaagtatagattatacatttccatgctcattcaaaatatgtattttttatgattgatgaggacattgcagcatgccaccttcataatttgcatttttaaatggttctgtgtgtaaatcattggcgtgtattacctcaatcagaagccaaataactaattgtaaaagctctaaaatatgcttttcttaaatatgttgtgcgggaatcagagataaatataccttaacacatttttatatttcattactattcaatatattttttttgttgttctaacaaagaaaacctccagcttttataataccattaccgtcaaattaaagactagccttcatctttccaaacatatattttgtgctttgctcaaagccaggaatgacctggctcatgaaggggttcattagcaagatgcttgaaggaaaggaaaaatttgctagttgatcgagaaaatataaatgatgaggctaaactcatatttgagatgttctagattttcctggtgagatttcaaggtccaacacaggattctaatattctcagaagatctcctacatgaattccttcaaacttgagaattacatttactctccacacaaagggagtaggaatttttcagtataaggcaaatggcaacaaaaacacactagagattacaaagccaacgtcactattatttttaaaaggctttatgaaaacattagtgctgagcctgggtgatttatggcacagatccatggaaagaacctttcctaagcccacatttcagctagggctttgcctgggagaaaaaaggaagcccttgcttctggaaggctcccctcaccgccgtctccatatgtgggaagttcagagctgaggtaaaatgaggaaggagaatcaagaccctggaaacatatgcccaagagggagcctgagaatctttgcagaagttgaagttgaaacagaagtttactaagatgctgaaacttaaagaatgaaaaccatcaactagaagagagtaggggattcgggaagcctccaaagaattcacaagaacattcagatgaagggaaagagggcaccaggtcacactgggttggttgccgagggaaatccctccccttgtgtcctaaatcattcccttgtcaccttgttatgcctcagtcctcagaaccactccttactgtggcttggtgcttgtccctccatatcgtaactctgttttatattcttttgactttcctgtttcttctgcatgtacatgagcctcattagcattgagcttgtgtctgttttgtttgcagcgttataccgagtgcttgcctaccagtgggctccaaagggatttttgcaatgactaaggtggaaattgaatttgggagtactgggatctttgggaaaagatctatatcgaagtcagatttatatggtgagagcactgtcttcagcagatgtcctttgagggtccaggtcagtctctggaggcactcccctctctcccttcttttttttttgagacagaatcttactctgtcacccaggctggagtgcagtggcatgatctcggctcactgcaaccttctgcctcccagcttccagcaattctcctgcctcagcctcctgaggaggtgggattacaggcgagtgccgccacgcccagctcatttttgtatttttagtgaagatggggtttcaccatgttggtcaggctgatctcgaactcctgacctcgtgatccacccaccttggcctccccaagtgctgggattacaggcgtgagccgccacgcccagccccctccttctgaaacttggaatgtcctgttgcaatccttagagcacctgtactcagggtatggaagcactcatgaggacatgagcctcagccttctggaaaagaggacttttcgcttgctataactcccatgggattttttttttttttaactttgtctttgtggacttcagaagtccttccagacaaatggctgctttatttgtgaggtagtgatttatatccctggcagaataatcctgggtgaaagtggctctccctcagcataaaggaatagcaaaacatttatgaaagggagacagagcttcagatgagtgggtacaaaagttccgcacaatatcaatggttgaaagaatatgcatatattaattaataattccgacatacttcttttataaggtcccttatgaaagatagactattttccacatttactgtgcattggaagtgacagatgaaattaatatgcttcataaattgccatcacagagggtcaattaacaagtgaactaaccttgtgaaagtcattttgaaagactagttatgtctgtaatattccctgtcaaattaggtaaaagtgggaaaattagatgcctgtcaaataaatagcagtctaagatacggagtaattgcatttttgataaggtaaattagtttctgtgattgttgcttgagaacagaaaatgagtagtggaaatagtaaagatctgaaaattctgtgtgtgggtacatgtgtgcacatacatacaaatatatgtaacagatgcatatttgtgtggatgtacacacatacgtacagagaggcagagaggagaacactgaagattcaaattggaagtaagacaggtccacactccttagctaaaccatcacctcctcttccaccaaggctattgccttttaggtccttcacacgtacctggccagctcccacctttctgcctttgctcacttggcttcctttttagttatgtctgcctctacttcattccatcaaaatgaaccctggtgcttgtacaatgggttggacagtgtttgggccatgcatggaccagcacaatagtgtctgctgccctagagctaaaattccctccaggagagaacaataacctaggaccctgaagctgagattcttgcaggtgacttgcttctgcctgcaaaaggactagagaaaggaaccctcctaacaaacccaactgagccagtttggaggctgaaggaattaatgtagcagtcagatcacatggctgttttcacccaatccacctgacaggaagttccagaaagaccacacaacacacacaaagtactcccacataaaggttatcctcttccaggacagatgtggtgggagcctccccacttccttcctgatgtaaaagttccatatggagttttactgctctcctgctcctctgacgtctcggttctgttcttcaaaactctgccatgtctgtgatgaaattaaatccctgactgggtctcaagttcctacttgtcatatgaatcagtagagcttaaaattcatctgaagtcttggttgtctgtccccattcctccatgacctcctttggggcttggagcaagtcaacttcttatcaggatgtgtgtcccggtgtgtgaaaggaggctgctttgcagcaaggagattgttaaaaaaaaaaaattaaaaagtaaaagtcgttatatttttgtgtataccagagcccagctacacatatgtaatgtagagaaaatactttctctccaatcctttttcttcctctgagttttctccttataccttttaattgtcagcgaattcccaaaggcatatgtactgaatctgcatgtggattttgtatatacatatatattcacaaatgcatatgctatgatttgtgattcccattttacagagtttaaaactgagtctcagtgaggggaagtaaactgcatgcagttcatgcagttactaacaacgtgccttgttgttctgtacatagcataggaggttgaacccaattagtctgactcaaggcttgtactctctatgatatccagaacgctcttttcttcaaagccaattttattccagcttggacaaattctacgcatcttcctaataaaagaagaaccttgccaggtgcagtggctcacgcctgtaatcccagcactttgggaggccaaggcgggtggatcacctgaggttaggatttcgagaccaacctgaccaaaatggagaaaccccgtctctactgaaaatacaaaattagccaggcgtggtggtgcatgcctgtaatcccagctctcgggaggctgcggcaggagaatcacttgaacccgggaggcggaagttgcagtgagctgagattgtgcattgcactccagcctgggcaataaaactccatctcaaaaaaaaaaaaaaaaaaaagaatcttgggagacagtgtgcctccacttttttgtctattggttgtattacaagttctttttcattttctgcccttgattgcacaatctccttctctccctggtctgcccagtgcagacagatacagatgagccggctcagtctgtgtccatacagatgcggaccagctcacagtactgctcttatgtgagctgctcagagttctgtgattgaaggacagggaaaaactgccaactaaagcaatagaatcattggatggacactggccatattttgcaaatctaaaagctgacagctgggtctcagaaaggacaggagcaagttcagttctggggatcccagcgagcatactgtctcttaggcagaaccaatggaataagtcctctccaaccaccttcaattcatgtgccctttgtttcttggttcctgttgccaggagagagcttctgattggcttaggttgtatcataaggccacccttcttgggcaggtttggaggaaacaacactgtgactgacacccctgccaggtctacagggaaacacagagaggtaatggccaaagataagcagaatgctgctgatgttagaagagggacaggaaagctagcaagtcacaatctataggcatctcccacaccatgtaattacataaaataaaaccacaaaagctcaatcacttgtctcttgcctccaaacctaaattgcaaatctccatgcaaaagtcagcaaaaataaaggcagcagcttgtgagtgtggggaaggccaggagaatttgacctcagaaaatctgcacttaaatcccagtcctggcaccatagctgtgttgccttggtattagatacaccattccaaagcccgctgtaaagcataagttttcccagtgcttgcagggagtcactagaaggatcacatgagatgcagcttctacaagtgcatggggaatcagcacccactcagctgaatctgctgtagaaaggattggcatcagggttgcagatagcaagtgaagctcatgcacatgctcatgagtttgcaaactgttttaaacacttgtaaaaatctctcctgagccatttatttaagtagagctgggaacattgaataaatgacagccctttcttaagggggagtctttgaattctgagtgactggcagatttcacagccattgatattttgaaaggtgcattggtgacttgaaatccttgagagcagttatctttgaaattgtggattctgcaaatgtagatattgatatccaactcaatatatgcagctttctctatataccattcagcatatgttagccatctgtcataagcatcatgcccctaaactttcagctatccagaaatctaacaactgccttttcagtaaggttactctgtgctaataattgaataaagcaatataagattcagccaaatagagtgtgtctgccatttttagaggttctcaacccaaagttgaagggccccaggccatggtagatttttaaaagaaattttgacatgggcagtgccaataaatgactctcaagaacccttaccattgtaaaaaaaaaaaaaaaaaaaaaaagggaggtccttggtattaccaatttaaaatgtgagcattctagagggacaaaacctataatgaattacaattgccttttttcccattattttagttaatgttgttaaacaatagtgtctggaattggctaaggaagaacagttacttgaaatatgtgctgttttgaataaactgatcctgtcttaatgagcttttatagggttttatgcatgacttactacccatattacattgctaaggtaacctacttaaaactgtggtgcaatatgatgtttttcagttcatttgtctgtttcattaatgatggaatgtattttccagcacacaaatcctatttatgatcaagacattgttgttctgtatatcaacttaaactcttacactgtgtaatttacctgctgtcaaatctcatttgaagagctgttgtctagcattgctctaatcaaaaatatgccccactgtaatgagctatgcatgttgtgtctagtattatttatttttaataaactttattcactcccaacacactttgggaaacggacaatctataatatcttctctcttcttcttcttttttaaccaactatctttccagctagggtgatgattcacaaaaatgtgatttttttttctttcaaatgtgtcttaatgggtaacagctgattagataaatgtacaggagaaatataaaaataatttggtatttaaaacaagactaatcattaataagacaagcagttttctaaactaaaatggctagaataatatgtgaaattagacttccaggacagagcaccctctgtgatttgaggagcccagctcattcattaaatatgatcaatatgcctcatcatggaaagactattccctgagatggcatgtcagtgtgttaaaaaaaaatacggtatttttttcatctacactctgtaaagacaagcccacaacttcatatggggctcagctgaaggtcagccatctcttccaacacaagaaaagaaaatggcggtgttggacttaatgagacatgattctgtactatacttaataggcgattttactgatttcatgggtacatcatgctgtagttttctctttacatgttgactttacattccaaattccacattaggtgcaacttcattctaagagctttgggatgcttgtatgtgaaacaggttttatgcacagctcttttccaacctattcttctttagtcagtggttcctgtgggttcttgggcctttgccttcctgtcttcagcctcttctctgagcagtgtgatatagccttgaaaagacttgggaggtgggcagaacggagtttgaatcctggctccaccctgtgtgactttggacaaggcacttatattcaactacaaaagggtcacccatgctgacgttacaaagtgatagtgaggaataacagagttacagaatgcagaagaacaaccagcacaatagtagcctgtctgtgtatgatgcttataattgtgatcatcatttatcctaagctcatatgtggaagcccacataagtatggcgtcttaccagtaaactccgctgaatccgaggaagggccttaggccttctggcaaggtaacattcagagtgctgagaatgctgctgcaagtggaatttacttatcagaaggtcagttaattccactaaactctgatgtcatatctagcttgtacaggaggcaaacaaacaaatgctaaacagtagtgcagaaccttggagttaactgtgtgcacatttaaacctcacctccaaccccactgtgtgtacagtaattatttccagtgaaatcactgctttctttccgtgaatgactaactggtgatgatattgtctggtatgatagtaactgcataagacctataggcacatagttcatcaccaatttgtgctttgtgcaatatttgcttcgggggaaaaataaaagaatcaccaaatatgttacaaactctggatttaaaaaaaaaaaacagctctaagaaaatttttaatttttttagtgtgttctcgctatcttggagttatttctagtcatcgggatcttgcatgatttaaacaaggcccttaggtgaccatcaatttatatctaaattattagtgtgcttgttatagtgggtgaatgttctttcagttcatttgctcattcaccaccaggattctacaccaggaactatgctaggttctagtgttatagggaggttaatatatgggagtatatattgaaacacattgtattagttgattttcacactgctctgagaaatatccaaataacccaaattactgggtaatttataaaggaaagaggtttaattgactcacagttctgcagggcttaggaggcctcaggaagcttacaatcatggtggaaggggaaggaaacacgtccttcacatggtggcaggagagagaagtgcagagagaaaaggggaagagcccctgataaagccatcagatctcatgagaactcactgactatcacaagaagagcatgggggaaccacccccatgatctgatcacctcccacgaggtccctccccaaacacgtggggattacaattcggatttcaattcaaggtgagatttaggtgtgtgacacagaggcagaccatatcacacatacacacacatactgaataattgctaccgtaattgatacactggcctagtggagggggaatctagtttgaactatttcatatgtgtcacgagcctggatttccagcatcataaactgggagaaacggggagcgatgcaaaagacagtcagtgctaccgctagagctggagatcagcatggtgggggatgctggctcctaaagcagaagtggggcaaatgtagggtagttggatgcagtcacagatgtgctagggaatgtggtctagggagcacagtagtgagtgctgctgagggtggtaaggggttaatgctgcaggagagaggtgagatgcgtcacaggcagctcattatctgatgcagtctatgcagagtttaatgttagaaataccagctgcgagtgcccacactctgcatggcattctgtaatgcatttgattttactcctcacagctaaggtattagttgggttacttttgctgtaaaacaaacaacttcaaaatcacactggcctaaaacaacagatatttatgcttgtcttccacatgtatgttgatcagctgagcttcatctgggctgggctgggctgggctgggctccaggctgatctgggttctggtggattccacggcttcgcctttcttcttgaacaagcggctacccatctatgagaacatagcagaggggttcctaacctgggctttgatggccccctgggattatttggcaatgtctgcagacatttctggttatcacaactcaagggaagatgttgctattggtatcccatggatgaaaatcagggttgctgtgaaacatcctacaatgcccagaaaagtcacccaccattaattatctggtcccaaatgtcagcagtgctaagactgagaaacccaaaagcccaaggcaaacttctataaacttatcactcatcctgaactcgagtctggaagcccacataaggtaggcatggcatcttaccagcaagttctgttgaaagcctttgctggtgtcacatctgcttgaatgtgatacaagcaaagactttgaatgtggaacttaccagcaagctccaaggtcaaagcctatgcttgtgttacatctgcttgaatttcatcaaccaaagcaaatcatagggccacatctaaagtctttctggttgggctttccatcctggaatccacgtttgctgggggcacttcaagctacatggcagtgagcgccagtcaagtgctgcaagtaagaatccagtactttgggaggccaaggcaggtggatcacctgaggtcaggagtttgagaccagcctgaccaacatggtgaaaccccatctctgctaaaaatacaaaattagccaagcatggtggcatgcacctgtaatcccagatacttgggaggctgaggcaggagaatcgcttgaacccgggaggcggaggttgcagtgagccaagactgcaccattgcactccagcctcagtgacaaagcgagactctgtctcaagaaaaaaaaaaaaaggaatccagtctgccacatcaatgctccccactcccaagtggggaaactgaggatcacaaatacgaagtaatctgctgaaagtcacccagcttttaagcaacagggcggggactagcacccaagttttacttcacatccttctcaggtggactgcactgcttctgcttagatttggcttgtagagtttagccaaaggaaaaaccactggaggaagctgtagtcagcctcagttttccctctgtgaagtaggggtaataatgatacctatcccatagagtaactagaaagattgaaaagatccagtatttgtaacacagtgtctaaaacatactgagcatttaataagcttaagctgctgctgcttttgccattgagaaaagacaagattatgtagggctcatttccagtaaggaaggtcttactgtgttttcctgagtgtgggttgtctagggaaattgggcccctttctcttttctttaaacttttaaatctaatcactccattttcttgtgtctttttggtgaactctagtatttggaggctttctggccttcagctattaattaaagtcatttctactgttaaaactgaattatctgtttttcttcttctaaaagcaatgaaccagggattcacacagactttaggcaatcataatcttctaaggtttgatttgaatgaaagatcccacatgaaacctgattctgtctgctacacgtaagctgttgctttcattctgttactcaaaattggcctaggacatctagaaaggaatctctgtggcacgttgatgcctacttagtggcagttcgtggctttaatgagtctgttacacagtgcaccttcctcctgtggcctacggaaatcgaaggagggatttgcttggtgggttccagtatgtatttctgagtctcagaaggtctgccaggaacaaatggcgaggcactggtattcggataaaagcagttttctctcttagtgaccagacaatggtgctgtctttcttttgaagtcactgctgggattttatgggcatagttgatcgaatcctgtgctagatgctagaaaatcagagatagggaagaccttgtccctacctctggagagctcacaggagtaaaaaacaaaaaaagcaaaaatataataataataattcaatcattattcattaagaaatctatgaaaatatatattatacaaaatatatatataacatatatatacatagacacgcagtaaaatagatgcacctgcaagtgaagcttaggcatgggttgaaggatgagtaaaagttctttgggcaaacatcttacaaagtaatattcttttcttgctgcttgttgtctcttatagaactataatttagaaagatattttgtattgtgatgctcatgtttacctactaatgtaataatttctgttgtcttttaaaaatattggcatgtttggatatcaaatatttgacctctaggattctctttggcattccttccgaaggcgtttattcctcggtgtttctctgccagcaaaggtagcattccggttttcctgtttgagatgcagacacctagatgtcatcaaagccagagacggaaagcagctgcagctatatccagtgagctggtttcttttttgccaacctaagaaggctttgttgttgttgtttctaggcatgtgaaaaacaggccgaattgaatatcggagaacagtaaatcacgactttacgatttacttcttggagagaaaaatatgaaatattgaaatcctcaatatttttcatttagaacaaggagaataagttttaaattactaaacaaaactagtgataaaggagtgtagcgagtttcataaaacatcatgtcatctatgcaaagttgtgacaggaacggagaaggaaaaaaatatgctgggtgaggaagacaggtgacaagaaaggagttgtgaatggcatgaagaatgagaacacagggaaagcttgaatgggctctaagtgaataatcaggtcatagctaaatttcaggggataagtgaacagctcactgtttcagttcttcacctgctcgttcaaaattttcaaaagcccaacgtaaatgaaatgattaatacagcccacagacagtagacgttaggcatcatggaaaaacgaggttctaagtaattctaggattattctgcagcacgtgacacaggtggtcacacctcagttagacttggactgtcttggactgcccgtttgtttatgagacagggtctcattctgtcactcaggctggagtgcagtgtcatgatcatggctcactgcagcctcgacctctcaggctcaagtgatccttgcatctcaacctcacgagtagctacgactacaggtatgccccactatgcctggataattgttccttttttttttttggtagaaacagggtctcattctgttgcccaggctagtctcaaactgctggactcaagtgatccttccaactcggcctcccaaagtgctgggattacagatgtgagtcacaatgcccagcatggattgtccttttcagacccagaccaaagaacaggacttattgtcccaagaccaatctaggaaaagtataagctgtgttgtcacccaggcattgctagaaagtggtaggctggacacaggatgaaacagttgcctgattttaaagtaagagaaatagatcaaaacaaatgacagaaatcagataatcgtctaaaaatgtttattacctatgagagtgttttcttgctcacctcaattagagcaaacaaccactatttctacaagaacagatttttcccccattaaaatattctgaagataattttgttcagatcatcagtgctgcaagtcaaaaaaggaggaaatcgggctgcttgtgaaattctcttgtcattagttccggttgcttattagagtgtgtagaccaagcgcaaggaatgagaaaaagcacacatcaccgtcagccaacaatcagccacaaagtggagcccattagatctctggcttaggctacgagagttggaagttaccgaacagattttagggatggaagaatttaggaactgctgtggaataaacctgagaagaagaaaagaatcccaagaccaaaatcttagtctgaatgtgaagtctttggaaaatgctaagtaatgacaaatatctaaaggaaactgagaccatgtgatgctaccaggtgatagtttaatgagaactgaaggttaatgaaacatttcatagagttcattgatgaagtatggaatacaaatagaaggagattgaaattaagggggccttcctgatgtctcactattttgaaaactagtttgtgctaagactgagctggcagacacagacatcaatctcttgtgaaacaattgtctattattaacgtgctaattcaggtcagatggcctggaattagtgtctcaagttgatttccttttacaccacttcctttgcagagctggacagaaagctcgtggcaatgtgtactttaatggaattaattagtatcacagcaagttgatcaacttggaggcacgtcactcacccttcattggcatcggaattatttaagttggcgcggcctctatgttaactacacagttatttttcatgcaaaatgctatggcattaaagacaacgactaggctgtcatacctcctcatttttttttctggaaaatatggaaatctggaatttttttttttttttttttttgagacggagtctcactctgtcgcctaggctggagtgcagtggcgcaatcttggctcactgccagctccacatcctgggttcacaacattctcctgcctcagcctcctgagtagctgggactacaggcgcctgccaccatgcccagctaattttttgtatttttagtagagacagggtttcatcgtgttagccaggatggtctcgatctcctgacctcgtaatctgcctgcctcagcctcccaaagtgctgggattacaggcgtgagctctgcgccgggccagaaatctggaattttgttaaacacttctgtcttaaggtgtcagcagacaagtttttaaacatgtgaggacaaattctgtgtgactatcttggggccagattcagtccatggagcactggtaggtgggagcctggttcagagccagagtgagatggtgagaaggagccacagaggtagctgtgcaaggccactggagacagcagggacttcagcagggctggctgcagactggaagtcacttaataaaaataactagcttaaggaaaacaaggggctgttactaggaagcccagagccctgggatcgttgaggggggtcaggagcacaaagaggagggaaactgaggcctccagctacagacacattatgtcgatgagattagagcctttggtgttgccggctggtgtctctctggagcagcacttgctaccctccaaggaagtggaaatgatttgcgaggcagagcgtgtgcaccctgcagtgagaccattgcttcagtggttatggagcagccagagaacataaatgaactgctagctttaggggatattactgtggtcttatttctccaaaactaaaacgaaaagttctagtgcactcactcggtgatgattcatttgttcattgattcatttctttcatttgtcattcaaccaacaaattaatgagcacctcatatacactagacactggggagacagagacaaagccatttttacacccaaataattgaggttcttatgggggggtgcagcagtatatacctgcacacagtgtcccacgggccatcatagaggtctctgcagtgagcagggggtgcccagatgaaggatgaactctgggactgtcaagaaacctggcagaaaaggcaacatctagacgttcttttactaatgtattcaggtttaaagattcatccggtctatgactctacagtcattataatgtcaggaccatctcctactttctcagtacctacaggttataattaatcattggtgttcacaacaatgattccaaggccgtcaggaactagaaccaccttctgattttttagagaaggatgacactttgttatttaattgatactgagtgtttatcgttgacttttaattctgagaaacctggcatccccatggaacatactactctgaaaagtactttcatacccatttgtttgattggccccctaccctgtagggggccacaggttactcttgctatcgtgcaaatgagcgaatggaggtggtggttagcccacggtcccagaatcaatcagctacacctgtggcagatttaggattagaatgaagacctccctacttctttctttctttctctttcttttttctttctttctttctttctttctttctttctttctttctttctttctttctttctttctttctttccttccttccttctttccatctttcttgttttctttttttcttttttttttaagagggagtttcgctttttttgcccatgctggagtatagtggcacgatcttagttcactgcaagctctgacccgcctcctgggttcaagtgattctcatgcctcagcctcctgattagctgggattacaggtgcctgccaccacatccggctaatttttgtatttttagtataaatacggtttcaccatgtttgccaggctgctctcaaacgcctgacttcaggcgatccacctgcctcagcctcccaaagtgctgggattacaggcatgagctaccgcgcctggccaaagacctctctaccttaaacctctggaaaaaaacaaaaacaaaaataaacaaaaaataaagcaaaacaaacaacaaactagaacattttattttctacctgtctgaataagcagttttcttcaccactattccatacaaaaagtgaccaccatagtacaggccatcacactctccctgcacccctctagtagattcttcactagcccatacagtttcctcttgttcctctttagtacattctttctacatgtttcagaaggatcttcgaaaattcaaatctgagatagttatttcctcaccatcctcccttacctcttgaccccttagaggttttaaacagccttattaagatataattcacacaccacacaattcacccattgaaagtgtacaattcattggtttttagtatattcccagtcatgcaaccatcatcacaggtttatttcttcttcttctttttttttttttttgaggtggagtctcactctgttacccaagccggagtgcaatggcacaatcttgggtcactgcaacctccacctcccaggttcaagtagttccttgcctcagcctcctgagtatctgcgatgacaggcacctgccaccatgcccaactaatttttgtgttttcaatagagacagggtttcaccatcatggtcaggctggtcttgaactcctgacctcgtgatgcacccgcctcggccttgcaaagtgctgggattacaggcatgagccactgctcccggcctctgcagtcagttttagaacattgtcttcacctcaaaagaaaccccatcactcttggaagtagcatccaacaccccctctttcctatctctaaacaaccaccagtctacttcttgtctctgtagatgtgtctgttctaaacttttttaatgaaaggaatcatgcaacacttgcccttccatgagtagcttcgttcacttagcaagatgttttccaggttcccccatgttgtagttgatgtcagagcttcatcccattttatagctgagtaatattccactgcgtgaatatatcacgttttgttcattcattcactgatggacagttgggttgtttctaccttttgactattatgaataatactactttaaaatgcgtaagtgttttgtgtgtggggacacatgtttttatttctcttggctatttgtctaggagtggaactgctgcatcatatcatatgctcactctaggctgaactatttgaggaactgccagactattttccagttttaatgctgttacgttgcccttaggaaagagatcaaaatgcttaacattgtttacagggacccatctgatttggccccactcacctcttcaggcccagcccatgtcacctttcccacttctgtcactctacttggtccccctggattttgtgcagtttttcaaaggtatgggcatttgctaaggctgtctccctcctcttccccatgaacttccatcagacagaccttctctgaacagccttcatccgcaatctaaatgggatctcgttattatattcttccatgtttcataagttcttaagtgattcttctttaatcccactaaatcatgactccagatgagtttaagaaatcttaagactattttttaattattacaaaccaaaagtctcacactgaacttgagctacaataggggcaccttatctatctgttgaatgaataaataacaatgagagagggggagggaggaagagaaattagtttaagaggcctcaggttgccacgttgggtttgaaatctagatgaagattgacatttcaccccaaatctttaactacttcttcctttttcactgagtaatatagcatatgggttggaaaacgttttctgtaaaaggccagataacaggtactttaggccttgcgagtcatgcagaccctttctgctgttactcagttctgcttttctagcacgagagaagccgtagacagtagatacatgaatgagcatagctttattttaatactttattcacaaaatcaagcagcagcctcgatgtggcctgttaaccataactcgacgacctctattctagagtattttgatacttgataccttcacgctctctgttttctctccccagaatcccatatttccttccacctttgttctcctagaagattcttctcagggaacaaataccttatttagaaaattttccttgacctgcaaaacagaattaaacacactctatctcatcactgaatgaggcatattcttatgttgctgcatgccttcggctgtgttaaattaattgaatatggactcacttacagaacgaagtccacaatgtcccttcttctcatccagcatcaaatatgtgatatgctcagtaaatgctaaactgaaagagaaaaaaggtgacatgaaccaaatggattatctatacaaagtacgcaggcaagcagatgatagaatcaagactttaaaatagagggaaggagaaataagtcatctgaattgatagcaataccagaacacagtattggggataagcccagtgtcagtgtgcagggtctaggtcttttattcatctttccagaacatgagatttttttcctctttttaaccagaatttttcgccggacaacaacaacaaattactttattcttcctggaaatttcttggtagcaatgcctctgccaacatgtaccatacccatacttcttctatcccatcactatcttctctcttacctggggcatattctttaaggggtagcataaatcattagtatctcaaggattggagaaacatcattgtcctaatgattcactaccatggacaccacacttggtgctttttttttttttttttaacttttgaatgagaatattcctctgaactctatgggagtacaatatttgtttatgtgtgacctacaagaatggcaggactatatagttcaaccgaacaaaattcagaagagaagggagatgactcataaattatcagtgggacttacactttgcctggtagtggcatgcttgctgtgccctttgctgcacaatctaggtggtgggtaggactatatttacactttgtctctgcatggcccgcaaacatgcagaagggatgttatgagcaaaggaacaagtcactaagacactttaattctgggctggccaggacacttaagaaagttggatgacactgtgccaggagagtctagaggtcctataacaaagccaaatgctggctggttgtcatgtgccctgtctgtactcctaagcccagaacctatgcatcagtctgcagtgggggtatctggccaaaggagagaaaatggtgcaatatgtgttaagtccagaagaaactaacagaatgcatctcatccggccacagtcatgtctggctgctgaagacctcttttgtgcacaagtgaaagaaaagatgttgagctagggttgtaagaatggcagagggatttatgtaagaaatatgagtctatttccatgacttgtgtcatttataaaggcagggacagatggaatcacttcagtgagctagaatttgtattaagttctacttgctttattttccttcatttacatatgcttattagtaatacacgtgtgagaacaaaatcatatactatcagtcactgccacacaatgaataatcccatgtaaaatatttttgcacacttttgagagtgacaataacttcactgagcttggtttcttcctttgaaacaggcagacaggcttttgctgaatctttaatgcattgtcttttggctgggttcattcaccttcagggaattctcaaaagacaagcgtcatttctttttgtctattgatctgtcctccagaaaaaagggacttctttataaactcaaagcccttagctaattcattgttcatttgttacatttattgaaaatctactgtttgaaaggcacttgttctattgtgctatggaaacaagacagacaaattcctagtcgttgagagcttaccttctagtaggcattacagaccagaaaaatggctgttcagtaggcctgtagcaataagagccgtgaaaacaaggttgggattaaggatgagtaatgagaaggagttactctttttgatcaagaagtcaaggaaggtttctgttttgaggacagacgtgaatgaaatgagggagcaagtcatgaaaactctttggaaaagaaaaaagtcttataggtgaggaaccagcaaatgcaaagaccccaaaataaaaattaacacctggtggctgggcgcagtggcttacgcctgtaatcccagcactttgggagtccgaagcgggtggatcacgaagtcaggagatcgagaccatcctggctaatacagtgaaaccccgtctctactgaaaatatgaaaaaattagcagggtgtggtggtgggtgcctgtagtcccagctactcaggaggctggggcaggagaatggcgtggacccaggaggcggagcttgcagtgagccgagatggcaccactgcactccagcccaggagacagtattgtcaaaaaaaaaaaaaaagaaaaagaaaaaaaattgagacctcttttgtgcacaagtgaaagaaaagatgttgagctagggttgtaagaatggcagagggatttatataagaaacagaagtccatgcttggaatctcagctgttttctagttctcagaatttatgagtgagattaaaagagaagcttcagagtgaaataaaaattagcttagctatcttgaagaacaccaagaaggaatatgtggctgaactagaatgattttggggagagtgaaatgatcaaagttacatccaaggttcacatcaggaccttgcaggccacagtgagaacttagaagacaattgacataggatgattggaaagcagaatactgaaaggccaatttacgtattcaaagatcgtgtggaaacctgtgtggtgaatagagtgggaggacaagagcagaaagagcaactcagaaacaatttactaagctgggtaagagatggtggcttggctgagaaggtaaccagcagatgatgagagatggtcaggttcaggttgtagtttgaagatatagctgatggaagcagctgatggagtggatgtgtataaggagcattgggcaccctgttagcaggctttaggcttctttgactcaggcattgtaccaacattcacctagtagctgatgttgattcctctctcacaaagacagtatcttagtttgaaatgcttaagaaaaaaaaatgtacctgatccaaggggaaaatggagctccacactagcagggataaaaggaaggtggttctgattatttgtgctgctcatttccatgaaggtcttgttcacagtaagcaagtttgtcaaacctatgcctaggtagtcaaatttccctaaccagggatagtctctactgggccttagcaccttccattcagtaataaaatgaggcatcttgagcttccccgaagcacaaatctctgggccactgtatcagaattatgtgggatgagttaactcacagattccggagaacctactaaatgcttgtggttgaatttcagaaatctgcattcttgcagttttcagatgaatcccatgcaaattaaagggtttcttgttttgttttgttttgtttttgagacagagtccggctctgttgcccaggctggagtgcagtggcacagtctcagctcactgcaacctctgcttgctaggttcaagtgattctcccacctcagcctcctgagtagctgtgactgtaggcacgtgccaccacacatggctaatttttgtattttttttttttttttagtagagatggggtttcgccatgttggcgaggctggtctcgaactcctgacctcaggtgatgtggccacctcgatctcccaaagtgccgggattacaggcgtcaaattaaaggtttttgattgtgatgaaaaacacacataaaatcgatcagcttcatcattttaagtgtatatttcagtagtgttaaattttttcatgctattgtgaaacacatctccggaaccttttcatcttactcatctgaaactctatagctaccctttgccccctttctgtgtccttgagagtcaccattctactttctatttctggaaatttgattactttagagagctcatataagtggaatcacacagtatttgtctttttgtgattggctttatttcagttaatataatgtcttcaaggttcacttatattgtagcatgtatccaaatttcctctgttttaaaaactgaatagtgtttgtattgaatgaatataccacattttgattatccattcatctgctaatggacatttgggttgtttctattttttaaccattgtgaatagtgctgctatggacatgagtacgcaaatatatcttttaagaccctgctttcaaatcttttggatgtatatccagaaatgggatgcaaattaaagatttaaaagcattgccttcaaatagaagagattcttgtagaaaatgaattattatgtatctggactgtggtggtggatacaagaacctgcacatgtaataaaattatgtataactaaatagacacacacatacacatgtaaacacacacacacatgcacacacacaggtgcaagtaaaactaaggaaatctggataccagaattgtataaatgccaatatcctgcttgtgatactgtcctatagttttgtaagatgtttccactggggaaactagaaaaatagcacatagtttctctctgtattatttcttacaactgcacgtgaataaaaaatgatctcaaaacagaaaggttgcccttgaggttagagtgtgccactgcaagaggagacccatctagaagggcaaagaattcttggcattgttccgaaggagaaagtggaacagggatagaggccaacccaaagtgctaagttaactctgggtcccaagggacatggcatccccaaccccagacagtaggaccaatgtagcacagatagggaaatggcagggaatgagagccagaaaaacagaggccaactcagtactgaatccccagagtgtgggcctggagctggtactgaccaccttcctcagattgcactggtcctgggaatggggtggcgtggggtccatgacctcagcccaaatcactcctcatacgaaggttggaacaggggacttggtcacatgagccctatgcttcctcttaattctgaatgagtttcagattcctgcaggcagcatcagcaacatgcaaaagacgcttcttagatgcttgagactgtaaacccttatcaggaacataatgcgatgggatgtttctctctctttaggcaaaatttaaggatactggtggataatatttacttaatgattgctatgtggcaagtgttttgctaaatgctttacaaatatttattttctgtgagatggttcctgttcttccatctcaaagatgaggaaattgagattctgagaaggtgactgagtaccttaaacaatcacacagctgataagggacggacttgggccttaaagtacagtctccctgaatctaaaacccacctttggaatctcagctgttttctagttctcagaatttatgtgtgagattaaaagtgaagcttcagagaagaagcagagagtgataacagcgatggctccaaaaataaagctgaggagaccaagttctgtcaggtgcattgagactctttttataatcccaaaactgtagaactgtaaagactagaaaagccagccacactctgtatggtactataatactgatgatgtcctatgtacttaatgtgtgtttctttctcattaatcatcaatgctgagggatgttgcatgtcttagagtttaacagccacccatagctccccatttgtaataaactctagtcagtgtgtagtcactgcctgaacaagttacaatcttaaaataaaaaccttattgatttcttttttaactttgaaattaacacatgcctagaaaaatctagaaagtatagcaaagcaaagaaaaatcactcaataaaaccactgttaatattttagcataatcttgatagtggaatgcctttattttttaaaaattgcattatgtatacactagttttagtcagaatttgtacttcttaacatgcatactataccattagtatatttttacattctctaaagtgtgtctgcaatgcagtgttgtactttctgcagataccatagtttctttcatcaatcttttataacattgtgttgattgtagttttttctatctttaagcaatattgtaatgagtatacatgttgctacacacatacacacacaaccacacacgcacatatcaggctaaatttctacaagtgaaattttcaaagcttgtgatgggtgttaacaaattgcatttcggaaagattttttcatgtaattgataatatatgagagtttatttcctcataagtctgtcaaacactatgaactttttctaattattgtaacaattttataaattgttacaatatataacatgctataaatatatgtgatgcaaatttttttacagttttctgtttattttcatataatattttagttgttgtaaaacctgcatttcagtagtttaatctgtcagtaattcacgcaataaattagagctctaatggtggcttagaagggccttctcccctgtattacttaaatattcaatgactttattcctcctaatacttaaatccatctggaattcattagactatactttaaatttgtatgtatcaaccctaatttttttaagaacatcatgtttgataaaacacattttaacacttacttaacaaaatgactttaaaactgtaaacttaaaaaaaaggtattgcatttatttctattcctctgaatttcacattaggaaaggaaaaagggcacgtaaaaatacaatccccagtaatttctctctgctggctttgttttctaaagtattatatttcccatctttgcacaaaaatccccttaacccttgtacatatccttaatagatctggcataattccatcatccaagagttatataagttctacttgaaccaattaaaatttttagcctgtgtcacctcttgaggcagaggatattcactaggactttactcaagctgcttacataaaattattttgaatatctgcatagatttcttccacataattaaagttacttcaaaagttaaatgtttaagaatgccctgaaagtctagtgtgattgtgagcgtgcatacacataagaaaaaatgttttcattatgtttgatgaaacaaaaattttaaagtaaaatttcaaattcataaaggaaatactgtacctctaagcagagcaggattttcaaagaacatttgataatagtatcaagatctttaattaataacctaacaagtaggaaacttttatcgcccctttgatcgtttttataaggagatataaacaccacatccagtctgtcaagcgggggataaatgaaggtggaggaatgttacaaagggcttaaaatgtcttttccctgggaactctctaggagttggtccgtaatgacatttaacttgaataagtgaaataaaactaagaaaaatagcttgaaatgcaagttgttggcgtcagagagaaacctggattacggtaatagaaaagcaatttcaaaggaataatggctgacaaataggaattgaatctagtatactgcatccacatttgcaggtttctacataaagatctactgggaatgactgatttccttacggagcgggggtggtcctatggggatgattggcacctctctcagattgcccagcctccccctgctcttctgggagactgtcagggtgctgctctttggactacctttgaaatcttgacctgtgacgaggctgtggctggtagtgatgttgccaggaagatggcattccaaggtcaccatactcccgctaaggtctaacaaagctttgtttagtatttctacttgctgggaatttctgtgtacacatgctcatttatctttttatttatttaacaataaaaccgagagtggtattctaaacaccatatgttgctatggtggaaactaaaacctggaaagctgaagtttcttagtaagagagcatgatcacatgacccattttgcccaggacagctttggtttgcacctgttgtttcggcttcattgttaatggtacctacttttattctaagaagattctggtttggacaataaattatgtggccactgtattaatgtcctatggctgctgtagtaaattaccacacagtgactcaaaacaacacaaatcttatcttgcagttctgtaagctgagaatccaacatgtgtcagggtaaaatcaaggtgtccgcagggctaccttcactcctggaagctcttggggaaaaacccatttccttgccttttctagcttctaaaggccacgcacattcctggcctcatggtacctttctccatcctcaaagccagcaacagctgttcatgtccttcacatatcccatcactctgaccttcgcttcttcctccctcttaacgactcatgattatattgggcctagccagatgccatataattcatgctagtctttctgtctgtctgtctctctctctgtttctctctttcttcctcctttctctctctctccctctctctcccccctctctccctatctccctctctccctttctccctctctctctctctctctctcacacacacacacacacacacacacacacacacagaatctccctctgtcacctaggctagagtgcagttgcacaatcacagctccctgcagcttcaaccttccgggctcaagtgatcctcctacctcaccctcctgagtagctgggagtacaggcatgcaccgccactcctggctagtttaaaaaaaaaaaaatacagagatggcagtctctctacattgctcaggctggtctcaaactcctgggttcaatcattcctcccgccttagccctccaaagtgctgagattacaggcatgagccaccatacctggcccaatctctgttttaaagccagctgatcagcaaccttaattccattggcaaccttaatttgggaggtggagagagtatgagaattgtagaccgaaacttcatgaaaagatttatcagtatgtctttgtttaaggcactaaattttagaaaggatatgtagatagagtactcttacccacacatcgtgatgatctaattggaccatgagtatattttcatctaaatctgcctaccaagcctgtacatatattgataatatattcatatgtaaggactcaggtgtaaaaagtaagggcaatgtaagtgtcacattaataaactgggttaggattaatgttatcatttcctgtcttatcacaacaaacattgtatccatggtggaaaatatcacttaaaaaatcttccaatcacactctaccttgcaagattatctgttataaataaacaatatagtatactgacacaaaaatctttgtgggcttatttccatggaatctctgcagaattttgttttaagctttgaacatctctgtggttcttgagacatactttcagactgccttccaggaagattgtatcaagttgagattccactacggtgatccttgtgtttgtgtcactgtacccttaacaattaccggctcttaacttttctttatctgggggcaaatgctggcatgttatttttcatgtgcatttcaaggttttgtgtgagtcaaacacacacacacacagttcctttgtctgaacttacagtcatgtttagctggagagatggcagtgttaagacttgtacatccctgcttacatgtagtgagcttctgatgatcattttatgtttcttgccctaagggaggagaccatccctcatattgtcttatgcccaatttctgcctccaaagaaggaaaaagtaaaaactaaaaggcagaaatgaaatccgcaagcagacggcccagcgccacaccctgggccttgtagttaaagattgacccctgacctaatccgttatgttatctataggttacagaaattgtatagaaaagcactgtgaaaatccctatcctgttttgttccgatctaattaccggtgcatgcagaccccagtcacgtaccccctgcttgctcaatcgatcacgaccctctcacgtgcacccccttagagttgtgagcccttaaaagggacaggaattgctcacttggggggcttggctcttgagacaggaatcttgccgatgcccccggctgaataaaccccttccttctttaactcggtgtctgaggacttttgtctgcggcttgtcctgttacagccctacagctatattctattactagatatttggggccaggcatggtagctcacacctgtaatctcagcactttgggtgcctgaggtgggtggatcacctgaggtcaggagttcgagacccgcctgaccaatatggtgaaaccccgtctctgctaaaaatacaaaaatttgccaggggtagtggtacatatctgtaatcgcagctactcaggaggctgagacaggagaatcgcttgaacctgggaggcagagattgcagtgaaccaagatcacgccactgtactccagcatgggtgacagagcaagactccatctcaaaaaaaaaaaaaaaaaagaaatttggaatgaaagcaatgagattccttcttgtttgtgacttatagacgggttccaatagaagtttctgaagaggtattccagagataacggcagtggcagcatctacgctaaaaaacattttagtgccccagagaggtaattcggagggaaaatacttattcaggtgagagatatcttatctgtctgcaaaatagaaacggagtcacattgtgttagagatgtaactactgtgtgctttgattctgtgtgatttgaaaacttacatctgaaaatcctgtgcacacacaatccattgatcgaatgttgaactatatcatctcaaaaaagctctgtgtgtgtctgtgttttgctttatttgcatattttgcccaaagaagaatcatcagagttaaagaggtcatcaaactgttttctaaatcatttctcttcggaatgactcacaagtccatggactgtgtgtcatgctttgtttctgattctgttgatctagattttgcatgtgttgcttgggtcatctcatattacaaaaaatattggcttttaagagccagcttctgcattttggccttcacccaagaaaccttgtaacacattttgtttttcatcagtacatccctttgggtaagatctcagtgtcaaattttgtcggactaaattgtgtctttcatggctgaagatgagaggatgactcaaatgaagggcaagctgttaatagttcgccatgaagctgaaggccacgcaggctttgtaatttggttcattatgttcttgcatttttaagggattcttttcaaagcattttacgtacagccaattcctattagtgtggtgaattaattggcttgaagaatcattgttttgcgtactgtgacttgatggttcacatttctactggatacctgctcacccaaccccccacagtatggaaagagagtagaggaacccaggtgctgggatgccaggaagggtggacaacagggccctaaactcaaggctgaaactgctctccaacttagcttcccttctggctcctgtggtttttctttagctccttctccatttcaggagttgagccccttttttcctcccattctcaggactcagaagatcagggctaacaacctagtgcccatctaccatgcccccttgaagtacagaaaatattcaggcggtatcttagtgtctccacctttggataaagtatttttgctttaaacaaattagaggtgatttgcatcctctgtctccctcaccatattattcactgttgtcatttgagaattaaattgacaagcgtatttttttttttttttttttttttttttttgcttttcagaaagtgtgtagtgtcatggaaggaactatgtggtagctaggctgatactataatatttcgcagcctttagtttgtggcaggatgctacataatatacagacgctcattgtgtggtttaatgtgtagcttcatgtgtattaataaaaatatataagaaactcattaagctcctcaattcatggatgattttgccacaaatgaggcaagagtaaaaagtagcaatcaatgtaaagcaaagctactaagtaaatagcttagtaaagataatgaaacaaaaaaaatgtaagggagtccatgcaaaaacattcagcaagtgtgagcacagtgaggggaatgtgagtgttacagtcggacctaagtttgagttcaggctgatgacaaatcagctttgacaccatggaccaggtccttaaatttctttgctgcgatgagtatttgttcagattgttttaagccaaatgagacagtgcaaaaaaaggccagacctgtatgggacaccaaatcaatgttagtcctcttctttttaaaaaaaaaaaaaaaaaaacaagtaatcagtttaatgtactctgatattgtttaccactgggattcttcttcatcatttaaggctacagagtccaccagcctagagtccatggagtcagaccaactgtcagctgtaatatgccggagatggagagaaaggacagatggccagagctcaggccaaaactttggattccagtctcttaaagaggcatagcctcttccaaagagggctctctgcagtcaatatcatatcagctacctgtttggcaccaggcattgggtccaggcttcaggatttgctaataaactcccgtcctcatgtggccagacagagaggtagacgtaaattgaattatcacaccaataggtaataacccatgggaagtgttacaaagcaaggaggctgacgccatgggaatgtaagccagggacaccctagctgttctggaggagtaagggaggctcttcttgatatttgggccaagatctgaaggatgaatagcggcagcaaggaagcgtaggtaggaaacccatggttggtaggagggttgtatgtaaaaatacctgcaagaaaggatgtgatgagttggaagaactgaaaaaagatgagtgtaactggataataaggaagaagagggattccttgtaacatgaaatgagtgtgaggaagtgggctgtggccagattacagaaagacttgtcaaagcaaaggtatttgctgtttttcctaagagtgatgagaaaccattgaaaggtatccaatagagggtgacataaatcaataaacattgacaaagacaccctggaagccctatagaaaacagatggtggcaggcagtcatggctgtgcaggaagacccacagggcgccttgcacagtagccctggtgagaagtgacagaagctaatctcaaggagtgttgagggggatggagagaaaaggggacattcaggaagtgaaacaatggatgtgggcaggatatgttgatagagtggctgcggatagaagagaaggtttcatttgaggaagagaatgactcatgagtttctccttccttgatccctgagagaggagccatcctctagacaatatttagagcaaaatgataaacatgcaactgtatttatcatactttctggttgctcaaaaatccttgcctccaatgatgtcaataatattttaattaagttattataaatgtaaaatagttttgccctctctaggaaaggataaagctgggcccctaaaaactggggagtaatatttgacttcagactcagtaccagctttgtatcagacactttcatgtgttattttagttaatctgcaccaagatcctgcaaagtcaccatggtgggctcttattaataacacaaaaaccaggatacggagaggtgcatgctctgctcagggcccggatctggtgtgtcagcaggattcagtatcaggtctcctgaatccaggtccagtgctctttccacagctccttaaagccctccagtcagcctttcacagatgtcccccacctccagcaattctcccctccacctctcccaccagtgcaggtggcatctggatctccctcccatgatcagccaagctttccaccgtgtgagcaggaaaccactagcactagaatctctcaaagtgctggtttaaacataaattcctaaagaatctgattttacccacttccctggatgatccataggcccactgtgataaagctgaatgagttactcctccctgggatatttcatctcaatggaggaaaataattctgttggggtccaaaaatcacaccaaggctaaggcaatacagggccccccaacactcatcaccattctctgtgacctttcccatctctgggacctctccattatactttgttttctgcaatgtttcacttttcaattaataaccaatttccttctacttttgtatttgacagcttctcaaaaagtgatcagacaaaatatgatttttaagcattcagcatgcacagttgaagattagaaggacattggaaaaaattgatgtttatgggaaatgtatgtgtatatttgtatgtgtgtgctatgtctgtggtacatgtacatatgtctgcctacatctgagtgtgtgtgtgtgtgtgtgtgtatgtgcgcatgtgcgtgctgctccagatagacctacaaacatctgtcttcctggcctgtgtacttgggagtggtgaatgagtccaacagccacacagtgaaattcctagcaggtggcaagactcagcctcctgtttggagcttattttattttcctatagctgaacctgggaatacagttcccaaattccacaagacccttggatttccatctccaacccctgtgtctcagtacaacatcactcaaacagtaatgtgcacccgaattctctagaaacaatgttaaaatgggtttcctctgtaggatctagacaggaccgaggagcctgcatttctaaccagctcctgggggatgccaatgctgctggcttggagactgacctttgaatagcaaggtactagaacacacagcacagacattggtcagatgtgtaattgctcggagttcaggctacctactatggaattagttattaaaatcctgcaacattggataactgtttctagctgtcatttgttgagtgcccctctcatctgcctccacagtggactttttttttaatatcacaccttgttattcccatgcaggtcaaccattgaatctaagaatagaaatcctcatgtctgaaggggtggtcttgaagtaggcaatgagggcctgggtggtttccatttcctttgagcaagtatttcattgccttctgccatgcctacctatttgtttttctcacagtaggtttctaccaagtggcatctcacttctaacataaagaacaagcatcagaatgcctccctttgaatgcatatgaggttgttttgtttttagaacccaaacacagccacttgaatctatcatgtaattcaaaggaaacaagcattattccagtcttttcaaactaaggttttgtgtgctttgggtatttcaattaggaagaaagaaggcaggcaagaacgttattgaacatttattctctgatactggaggatgcgctggaattcaagagcctgacttcagaaagtttggcatttgctaactgtgggtctgaccttcgtatgagaacagtgatgaaaactcacgggaatgtcagattttgttacggtatgtgattgggtggataaggctgtatttactaacaacttcctcatgcatatgcatgtgcttaattttcatccacatcattaataagatgattttaaaactggatgaacctctgcataaaacacaaacatttcctattatatattttattcagtctactatgttttcctctgtggggatcaagcatgatatacttctttctcatctctgccttcccagggactcataggaagaaaatgtcttcattcttcacttggtttagattgttctacgcaaaaactcttgtatggacataagccttaacttactccattcggagttgagcagagtcctaattctttgacttgatcttataccattccccactcctaaattagttccaattagttccaagttcatccttacctcagagtctgctattgctattcctgcggtctagaaatcattttccatgtgttttgtatggctatctctttccactttcttgtcattcaagcctcagctgaaacattccctcagcaataaggttttctccaccatttattttgaataggtgtcccctgccacacacacacacacacacacacacacacacacacacacacactttgtcaatcatactctacccagtgatggaaatgttctacatctgtgttgtctaatatggtaactactacctgcatgtggctactgagcactcaaaacgttcctagtttgactggagtactgagttttttcattttaataaatgtaaattgcaatagccatatgtggctagcagctacagtattgggtagtgaagctttcgtattcaaacctgtctcatatccttcatagccctcatctgtgactgaaattatcttgttcatatctttttctcttgtttatcacctgtctttccatgctgggttatcttttctgctaaccactggataccagggtgttcagcgtgatggctgacatgtagtgagtcctcaaataatttttattaaattaactttaagaaaatcccacttaacagcccttcactgtttttagagaccattccaaaggtcttgacttgtgttgatattattgtcctctgaaaagtctgagtcaaactctgattagttttgtaacataaaataccattggattgtctgtttgcataattggttttctgagattcagctccacattctgtattcatcctaatcaatggtgtctccttagtttctgtctttctttccattgtgttaagatggatctgttgtctgcccttcccagtttcagcatatttgaatatttggcaaatgtgaattctgattacctatcctacttgtagcttatgatactggccaagtcttatagaatgtagaatcttaggattcagatccaagatatttgttatctttaggcacagtgtttttttgtttctgttttttttttttttttttttttttggttgagttaaagtcaagtccttggctattttgggaagatgaaaaaccagacctatgttattacataaaattgcctcagagctttattttgattgatttcctttgttagcagtattctcataatagcttaaaaaaaacataaaagtataaaatttcactctctgtgagatctcctttgtgtgcagatattacgaggctctgttcacttcattttttcttattacatgcattattttatctgcaccagaaatcaagtatgtatgtctgtgtgtgaatttgctggtaaaaggatgaagtaatgttaaagaaaaaaatttaaaaattatctacccacacatacctggtttcattttgctcactgccttcaaattctatccatatttgtaggtcatgtatgatgatgctcatgttattttgtgtatttttactcaatattctaagtagatcaataaagtttaaaaattattgtattgtaatatgttgttacacaaacattccttcaactagttcccttccactggatgttcaggcagatgccagtgtaattttattttgagaaataacaatgcagtgaatagttccaaatatgtagtgcaaacttatataggatcaggagtggtataaaaacggaacaaaagtatgagtctttcgtggtttctgttgaattttgccatgcttttgaaaaggattatactggtttacaataccatcaggtggaatgtgactctactgatttataacaagaatgtttgtctttcatttttctaatttgggctcttttttgacaatagtattgataataactgtagcaacaatagcagcagttaatattcttgagacatattatatgatagaccatatttaaatgctttagaaatattgtttatagtggttaaaaaagtgagctctggaggcagacttcccaaggtcaaatctggactccaccatttatcttctctttgctttcattctctcctctgtaaaaagatccaaagggttgttatgacaatcaagtgagataatatagtatagagctaaagtaagcactggataagtgtttgttattattcctaataatgagtgtttttgttaaccccacttacagatgagaaaactgagatccagtgtcttgctcaaggtcacacagataggaaagagttgtactaggattccaaatgcagatgcccttttctgatcaaaatactcctatgcggggaccaacacttatatccaagaggaagtattactcttatcgctgagttaaatcaaggttgaattacgcacagaaaatgtgcgcataaggtccccgtgattcactggaaatgccatgacataattcttcgtttccaagacaaacaaaaaagttgtttttttatgctgccttcttcattgagatctgaaagtagttccctatggaagtgattcatggtgttgtgaaatcctccgaaattgtaaacagcctggtgggcaggaatcccgaggtctcattcaggccccctgcaaattctgagttcctagcctgaggaaagcccccaacaaatactgacctgactttctcctaaaagattgccataaacacttttggttatctcttaatgtacttggttcataactgcttagtcaattatttttattagcataacattccttttaagcataatgatattgggaaaacagaaatgatacaagcgtaatttcttggctatgactgtttatgttttgagtttttttgttttgttttaactttctttgccgatttgatgaattaattgtaaatttcccaagggggatctaaagtgaactgatctttgccttttattctggaatgttcaatttctattctagtcccagtgactatcctctgagaccaaaatttcaatattgccaagggctcataaaattgtcgatataacctactttctctagagaaccttatttgaattttcataatgaattaatatcttctttctcccccaatctctttgctcaaatagctatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggtatgtcacattggcttacctttagcgtaatggcttggaaagaggcacactttgatctttgtggattctagggactgtcttatggctgttccaacttgtcagctcgtatcagcgtcgacttaatacttccctgcgtagaagccaggttggaaagctaaagtgcaaagcttgaccgaggtgttgcaagctacggaaatctctttcattgtctctgaagatcatcctccaaggatgactgccatctaagtctctaaggcatggccgatgttgggcaccatgtaaatatccagcttacctttgtgaaagtccaaggctaaactttgtgctatagcagggctttgatgagaattgggtccccattacaaactcctcagttctttcttttcacagtggccttttaataagaactattttagtaaaataggtaggacttcttcccttcccttagaagatgtgcatgaagaaatcttttgtcttcagtcagaggaccaaaaggaggatgtttgatatctctctctggaaatgcgtaaatgcatgtgcctactgttatagaagtcactcaaggttactatagagctcccgctgtcttttcccatgtttaacctttctatcagggacggttttagaatttagagcttccttttttgccccaatacatacaaattaaagtatcccacagccagcagctgaagtcactcctaagtataatgcttgagaaaatgaaagaataaaacagaaaaattcctcttcggctcactttgattttcagctttaaaatacacttgagtgaaaaaaaacaccatattaagagtatcatattaagagtatcatgatactcctagattatgcccaaataggtaaaatagtgattcgtcagaccagacaggagatgagagcggcttttactatttttcccccttttctgaattgatgggatctatcagtgacatgtagatacatgaggctctggaaatgttgccatggtaaccttcccagacaaccaggtggataattgtatgcaagatgcctaaaacctcccgtcagcttcaaggagctgggtctttatgcactgcatcagatcccccaagggcaagagcgaccctcttccttcccagctttaaatgcgctccgtaaaaatgaaagcaaatgcactgcgtgtgtgctggagggtgtttaggggagtgttggaggcagatggcagaggagcaatgacaggtctggagagaaggagagagggcaggtgaagggaggtcaggtcacttcagggcagacaatccacgtggcccctctctgtgagctgcttttgatggaaagatggcttctggtgagaaacaccctagaatttcggtttgatgtttacagaaatcttcttaaacgagctgatgtgcagaacacatttggagaaccaatgaggaaagcgattaaagaggccaaagtttgagcagaacagaaaaatgattcccaattgctatctgtggtactcgggccccatgagtgagtgactagaattcagatgggctgggaaagtgttctaaatgtaaatgacagtgcttacattcgggatggctgtgagcttgcacatgtctttgtatattatgtgtgtatatgattagacggtgtccaattttcctcccactgtgcctgtccttaaagtttagaaaagaatttcagatacatgtaatattttttgatacatgtatatacatgtaatattttttgaagaaagagttctttttgcacattgaattctttatgcacatgttattttgtgtattttttatgtatgttttttgtgtattttttagatagagttctttatgcacattgaatttcttaaatcacagagttattcagttagagacagttctccagcaaaacataaaccacctcaaatatctatttatgattggtattatcctataaaaatacataaagactcaggtgtctgtatggattcattgttttctttctcagcaccctctgggttggactataaagcacgcagtgaaatagaatcagtcagatttgggatccagaatgtggaaatgttgcaaaagactttcaaacaaaaagccacttagattacttagcaccctgtaagagagttgcaggcaagatggcccccgaagcattcatgaggccagtgggaatctgatgaagaagacggtatcctctttccaacctcttcttcaacttaaatcgtttacaagtaataacaaaccctaactggctataaaaatgatcgtctcttgtatttccattatgctctgctcatctgtggctcataggatcccatgtgttgtagaaattattcgacacccactgggagtaagggtgggggtaggggtggggtttgggtgggggtaggggttggggttgggggctgactctggaaagagttccatgattttccatgctctcacaaataaaagatgggagtcagtgcataacctgccttcaaatcatatgctctttcacctgtcccgctgaattcatggtgaacacagccatcaggtatcatagcactgcgtcgagtacttactgtgtgccagcagccatatatgtacaacatcatttcatccatgatcccacttcctgccctgagaggtggctaccactatccctatcttacagatgagaaaactgaacatcaaagaggctcaggaacttgacaaagttacctggctggggaaaaggcacaatcagtgtctacgtctccagcttcaaaatttggtgaatggttgattacttagctggtaagaggctgccacatctgccttaattctctgcaaattctggccacatctgcactggcatcatgctcaaaagactagtccgggtctgtctacaatagcccgcatttcttcctgggccttgtgtgagctacaagaaacccaagaaccagctgggtggagtggctcaagcctgtaatcccagtactttgggaggctgaggtgtgtggatcttgaggtcaggagttggagaccagcctggacaatgtggtgaaaccccattgctacgaaaaaaacaaaaattagccgggtgcggtggtgggtgcctgtaatcccagctagtcgggaggctgaggcaggagaattgcttgaacccaggaggcggaagttgcagtgagccaagatcacgccactgcactccagcctgggcgacagagaaagactccatctaggaaaaaaatgaaacctaagagccacgtgacccactgggtctgctctcttgtttccatgttttacaccacagactctttgcaggcccagctgggggaagtatttgtgcagttctatcagatgaactgatttagatcctcacagaaaatgactagttcttcggatgaaatagccaggcccattgaatcacctctagggttcaacggtgttaagtgttgaggcctttgtcaccactcatgtcacttttttctgagcctacataaccaaaggcagcttcatggggcacagcctttgtggcctcacacagccaagggaacagaagggtcccatgctcagaagggcctggggcttggtttagcgttctgctgtcaccatgttgaaattcttaataattgttgaacaaggtgtctgcattttcattttacactgagcgtcacaaattatgtggctgttcctgctcacagcattgtagcctagagctgtgtttgacgctgtgctcagctatttaacacggtgtgatattgggcaagttactgaaccttctaggaccctctgcaaatggggatagaatataacagtagctaccttagagaagtatatgtgaggattcagtgagacaacatgcttcacccagtgcttagggaacagtaaatgtacaatgaatgcctttgtattgttaacagtgcaattattatttttattctggaagagtaccctttagcaaaggtaaagcaaagagacacatgagttgtgtgaagacaaattcatcttccagcaaaccacgcgtcattttcatgtccccatgtgttcgaatgccctcggcaccaatctatcacaaaggaaggtcacccatatttatctgtatgtgcagacaggagaccattccggctgctcagcactgaactccggggtattgttttggtgaatcattcctggatgaaggaagatcagcagaacataatggtctttgactttgcagatcgtgagctgttgcttttgcagagccacagacattgatttatgaggcccaagccaaggctctggctgctccttgggggcatacagatctctgtgtgagtttggtgttttctgatggccaagacatggtgttcatgagtagggggtagagggtgagaactcttgaaattcctggagggcactaattccaaggccccatcatgtcttgttggcatcaattcatgggtgttttgccctctggtggtttcctgggcacctttgagaatggctgaccatgaggaatggcatgtcaggctcccacagaagcaggccctgagatgaagattgaggcctgcctgtggtttgcttgagaggtacagggacagataccaggtaaggtgaggtacagaaaaggaagtcagacaacttgaggtgcattattattattattattattattattatcactattgagacggagttttgctcttgttgcccaggctggagtgcaatagtatgatctcagctcactgcaacctgtgcctcctgcattcaagcaattctcctgcctcagcctcccgagtagctgggattacagacacctgccaccacgcccagctaatttttgtatttttagtagagatggggtttcaccacattggccaggctggtcttgaactcctgacctcaggttatccgcccaccttggcctcccaaatgctgggattacaggtgtgagtcactgcacctggcccttgaggtgcattattaaagcagctcccagagtgggtaactgcagctttatcctttttggggagctcaaggaaatgacattaaacacatacgttagagttatctcagctaaggggcaggtagctagaatatctactcccccaagtctgataatgagacataggttcaaagctgtccccaaggatggggggctttaatttccaggcacttgccgccagctgtgcgcaagggaaacctgggatccatcagctccaatatcctgtcctcttgaggcctcggccttccaacaacatcaggagctggctgtaggttgtgttcgctctcctggcttttagccaccccaaatggcagccagggcagctgggagaatggcagccccccaccctggacgggtggggcagctttgagaaagataggtggtgagaggtcacagaaggaaagaattagctcccaaactgcatgactgacaaagatgaatgtggcatttacctaaaggtgcacgttctgtgtcctgaaagatgcacattgcttaggcatgtctgatccttcttcttgaggctgttgaagacaagcagagattagcagttacgtcctcattgtctaacttctgaaagcccagccactttccctccctctctttcctgtcttagtccctttaatttttttttccatccagtatgcttagcaagcatctactctgtgctggcgctattctaagctctgaatgtgcaacactggacctggcaggtgctgcttgttccctcctggtattcatagctgaggagggaggatagcatccaataaatcagaaagaaaattgcggcaagtgctacaacatagttgtatgggaggctcatctcgggaggggccaaacctagtcttgtagtgagataggaggccgctctgaagagatgatgtagggagtttttgtcttttatttttcctccaggatccacctgagttccttttcaagacacagttcctttaatttttaaacacatccagccattccagacataagaaaaagccagccgatcaagtcgcctttgggactaatggctatcctgagagctcagctttgcttggaagttgctattttccaaaacagcttgagctaaataaagatggctgggatagttgatagttgatatttgacacctagctcagccgatggtgttcaggttgttgctatggcctggtagtaaagtcccttttctggttactttttacttgttgcagtaactgtgatgtggcttttcaacccattgactgttaatttttttttgctgatattttcagactttcatgctgtaggttcctccattctcaactgccccaaccaatcctatgtgtttctggaatatcaggcatgtggctatttcttttttttttttttttccttaggtagatatattttttaaaaaataaataaagcaattctgttcttttcaagtgaaagaaaatgcagtcactctccagtgccaccatccagagataaccacagttgacattttagtgagtgcagttctggggttctctcctggcatctctacacagagagatgcaggtgcacagttttacagaatgggagctctatgtgcttttccgtaaatctctctcttcactcctcagggtcctatggacatttttgtaaatcaataaacatcaagcaacatcattgtttcaaacagctagagtctggatctaccatcgtctccttaaccaatttcctatcgatttaagttgttttcacttttctacacttccatcaattctgcagaagagagctcatctcttcccatgtttgtgacaatttctataggatatatttacatgagctggattaatgggatggcggatatgccctgttatgttttgatccctattcaggtgatgcttctaatcagaggattttagtctgtatcttggctaagcttgttcatgcagcaggatacaatagtctttcttttcacacacaaacatactgatggatatttttgtttgtttctccagatgacactcagtatctacaagtttttgtggtcatttcactagctgttttgtagatagtggatggccttgctatggaatccttgctggatattgtggtggaggcagaggaatgcagtggttgagactggcccctttccttaggtcatcactggaattttagtgaagaagtgctgcccagggatggcatcattaacatgctgcagagcccttgagcttggaggagacagcacttgagttatggtacaattcactgtaaatgtgttttatggtcgcctaaaatgtgtttaggtgaccataaaacacgttttatgaaagagttgcataatccaatcagagaccatttcccaaaaggaaaattcacagctaaatggaatgaaaagtattatctgaacttcactagctattgactccacctagtcgttcaagaggaaagcgaatgcttatacattgttagtggaaatgtaaacaaatacaactgtatggaaaggaggatggatagttctcaaaaaacttagaatagaactaccatttaatccagcaatcctgctactactgggcgtctacacaaaggaaaagaagccactgtatcaaaaaaacacctgcactcatggttatcactacgtatattcatcaccacaccatacatacatacacacacacaatggaatactattcagccatataaaagtataaaatcagccgggtgcggtggctcacgcctataatcccagcacttagggagggtgaggcaggtggatcacgaggtcaggagatcgagaccatcctggctaacacggtgaaaccccgtctctactaaaaatacaaaaaattagccaggtgctgtggcaggcacctgtagtcccagctactcaagatgctgaggtgggagaatggcatgaacccgggaggcggagtgtacagtgaaccgagatcgtgacactgcactccagcctgggcgatagagcgagactccgtctcaaaaaaataaataaataaataaagtataaaatcatggctttggcaacaatgtggatgccattatctttggtgaaataactcagaaagtcaaatactgcatgctctcacttataagtcagagctaaatcatgtgtacacatggacatagagtgtggaataatagactttggagactcagaagggtggaagcgtggcaagggtgtaacgtgtgagaaattgcttaatgagtacaatatatgttactcaggtgatagttacactaaaagccaagacgtcagcactctgccacatgtccgtgtaacgaaactgcacttgtactgttaaatctatacaaataaaaaagaaactgaatctttgccaagttgctcctaactatgtctgaaggtcctctggtgatatctcacaccggctcagaaccaagacagtcggctcccttgtcatagccattgggatttccctcctccatatcccaggcccccaccctgatgggcaccattgcacatgtcaggcccgccctgatgggcaccattgcacatgttaggacccttggctgctggctcatgggagctggataccaaagcatctgctgggacaggagagaatgcctgaacccctttattctggtagaagagtatctaaccaaccaacagaactgtatgtttcttctttaatgtgaataactgtgaaaacaactcttttcatttttatttatagctctctctccccctaaattcacacatgcatctctggggctggagatcagctcaagagatggacaccccattgtttcctgaaacactctcctctctaaccatgaagtcttattcctggactagcctatgtatctgcctctcctctgcccatcacccatgctcatatcattcacattagacctttgtattctgggtgaactggggagatgtggcccttgggttcactttgattacttccttgtaaaaataaacgcttaatagccctgcccactaattttttggatatgatattttaggcccaagccgggagtcatccttccatcactctatatttggaagagggaaggatttgtggcatcaaatatttaaaaataaaagtaaaaatattaaaattaattgagtaacttaattaaaataatagtttaaagtggcagcagggcaaaggagcatttgtagcttcagaaatgtagtgatcattctacagtcttttgaaaagataaacctgacaggaatttctagcgaaaatgaaaattggtgacggttgagcagctgcaaagcaaaagtgaaaaagtccttgagttgtcctagcacagaacgtgctcaccagcgccgttggatcctatccctgataccaaaggatccactgtgaatagcccagcaatttttagcactgcagctgagtaaaacagagtggcagatccaaatgtcattaaacatttataatttcggggaaacccttatttcaaatcaattcttcataaccatttcctcagtaaattcattcaacaagtatttatcgggcagtttctatgagtcagataatattataggggctggggatatagcagtgaccaagaccatttagaactctattcttaagacattgccaccttcctgggaggagaaaggtgccaacagaaatggataagccagataatttaagtttcggataaaataaaacaaggtacattgttttattgacataaggtcaagaaaagtcctctctaaagaggtgatgttgaagctgagcccagtgaaataaaggagcctaccaagtaaaggcatggagaaaggatgttccagacgcaggggccaggaagtgcagagacctgaggcaggaatgacctgagggacggtagtaccaggtgagacagggagatgggcaagggcaagggcaagatcgttctgagcatgagtcaacaaactatgggccatgggccaaatgtgtctctctgcctgttgttttttaaataaagttttattagaatacacatgtgccccttcattcatgtattgactatggctgctttcgcaccatattggtagaattgggtagcggggacacagactgtatattccacagaggcaaaagtatgtaatacctgatcctctgcaaataaaaagtttgcagacccctggcttagaactccatacattttgattacattttaaacttagtaggaagcccttgggtggttttaagcgaggaaatagatatgattttactgctgaaaaatgacttgtgctattctgtggagagagaaatagggaaacaaggcatttcaatgttctaggcatgagaaaaccatggcagctacggagatggagagaagagatcacataaaatttttacagcaagtgtgtgacaaatcggaaaattctaaatattgagtcattttatgatgccagcttattataactgatgccatctatgtggaattacaataatactgtaagccttaataggtttataaattttctgcaagtataaaccagaatctaccttcagttctctttctcagcaacacagttaagaccaggagaactgaatggttttctcttcatccttcaacttccaacatttagcagagtcccaggcacaaattatccacccaataaattccactggatgaacaaatggctccaaaggccagaaagcctgaatcccgataaactgttttttaattcaatttttaaataaatggttgtatttattgaaaatgtattcattctttcaacaaatacctttagagtacctgccgtataccaggtatgctgtttaatgaggatggggttggagggggtgaatgcatgaaacagaatggatgctgactctgtagagcttgcagacgaaagaggaagtcagtaaataaagcatcactgttacacaggggaacgtcagttttcaactgctacacaggggagcatctctctaggattaagggagggagatgatgcctgtcccagggtaacacagcagtggtaatcagctgtatatttttctagcactattatgtactggatactggtccaggttccacacctaccttttaaagcagtccttacaaacgtttgacaattgaggaaacagacactcagggaggttaggtgactccgccgtggtcacacagctggtgggtgatgaagctcagatcgaaactcagacctgtatgactctaattcttgtgctttttcatttcatccccatccacaacacccactgtcctttaactatttcacccgtgatgatgttgcaagtaattccaaagttgctaccttaaatgtaagagagcattttcttacacagatgagtgagtttatttattttcatgtgtgtgtgtgtgtgtgtgtgtgtgtgtgtgtgtgtgtgtgtgtgtgtgtgtagatgagaaagagaaagagaaaaccaccaaccttccttagtcattttatagtagcccagcttgccaggtaactccacgcagcccatccttactggtggtaacctcaaataaagccagattctccccctagcggtagtttgagagatgctcaacaactcgaagattcataaagcatgctgagccatccatcagtcaagacaggccacaaatgtcagaaaagattgataatcagcagggagcttgataaagcagcttttactgcagcacccttgctctaagactcccatcccttctgagaacgcagtctagagctgctgcttccatttatctatacaaatacctttgaatcacttcaccttaatatatatatacagtaagatttttttaaagccctgaataatttatgtatagaatcacctcccttcttaaccaaatggaagagattcagtatgctaagttcaatgggaagagggtatataaaatccctttcaagtatatgtcttataaaatataggtcatgaattgagtttttcagtatcaaagaaaaaaagtttaatagacttacagctttcttgctttaattatgggtgcattttttaaaaaccaagtatagtacccaagctattttattattcagaagactggctcttttcaaagaagtgtcaaaagtttggtttggggaattcttgtgttttctttcttgctccagttttccacttttctttagtgtgtcaccatctttatctcctatgatactagtttataaaaggcttctaacatggatgccttcctcttggaagtgggttggggttcgtgtttctatagtcaagctctgtatccttaaaaaaaggcctgcttttcagaatgatggaggacctcgctggcctgtttccctggcccatcacatccagactccagagctgctttgccatctgttcctctccttccttctcatttctgcaattttaccctctatctagctgaagaggttctatgcttgttggctcacactaaagtcataagccagggctagaggggatgacttgaatagtaacatgtgtgtacatatacgtgtgtatgtgtctgtacattcacatacacacacatgaaatcagcttcggtctgtgatgcaccattcaaaaatgtctgcgtagattttcactagctttggaaaccacgtttgatgtggtttaactggaaatattgacccacgcaactaaaactcaggtaacccaagagactactactgctggcagagtcgtgtttgctgatttcagacaccatggagcagtggtccaagtttgaatgattttgttcccaggagacactttgggttccacactggggaagaagagggtacaactggcatcgagcgggccaaggtcaaggactggtaaacatacgtcaatgcatagaacggcctccacagcaaagaatcatttgcctcaaaatgtcagtagtgccaatgtttctccctaaatggagaaaatgtggagttttagttataaagcccaaatgtaaagttggcaggagagatgctacaaattgtaggcattggttggtacctttttatagtgagccacaggaacccattcctctaagcaggatcaatggacatggagctcgttttaacagtgagcattttgcgagtgggagatgttgccaggccctctgctgagggcttcctgtgtgttatctcattgacttgccacagcaggctagaggcggatgctatgatcatctctatgtcccagtgaggaaactgaaacttcaagaagctagaaaacaaactgtccagcagagcagaagcattttcctcaaaatccattctgctgtcctttagtaacagacctcagtataccttagcagcaggtgtccgtatgaagactgtattgctcagcctccctggcagctaaatgtggtgatgtgaggaagtactgaccaacaagctagaagcaggggtctatgttagacttctaggatggattctgaaaggagccacctcacctaggaagagtaccctgtattctcctcctaccacctatttcttttgctgtctggagtagcgatatgatggctagaactcaagcagccaccttgctctgtgacacggcctcaagggtagaaaatatgtgctaggaaggcaggacaaaacacagaataagacctgattctgttgcctgcggaatgccatggcagccctggattgcttctctccagaattattttacataagagaattatgaacttctgtcttatgtaactcagtgttatgttgaattccctgtatttgtagccaaatctaataacagctgaaatatgcagcatcactcaaccagtaaaaattagagcccagactatatgacgttgagtcaagccacgctttttaaccactgtgctttgctgcttgagacataagcccacttacacctctgtatgcctttcatgcaccagttttcctatggtaatcagaaaattgagtctttattggaacaaaaatggtctttgtctcctctgttatcttagagttccttccagaaagcattctaaggcctctttgacattagacatttttattaggttaaaaaaaaccccactgccttatgatgggaactttcttagtgtagttattttgatttcctagtattactgtaatttcagatcacagtctagtactaataatctgaagagattccaataatgcacaccatgatggggctgccatttatgtcagtgtgctggcttcgtgtccacattccaggggccagagaggaaaactttaaagggctctagaaggttttcagagaatattaatttttttcttgccagtgaatcaagttgaagtgcatcatgagaaagtacctgtgagttcatcagggagatcaatgtattctgacaagggtacagcacaagggttgagatggctgattcccatctccaaaagatctggttttcagctatgtttccactgtgattatgagaccttaaacatgttatcttacctctctgggctttgagtaactcttttgatcatgaggctaataacaatgccccaaaaggatggctgtgaaggttctgtgagcaagtagatatcaggctttgagcaccatgaccaacaaaatgccacgtgggtcacaaatactggcagccagcaatggcttcttttcagtggtgctagttcaggagggtcttagtgtcgtcacccagcagcttgcaggagttggaaagactctagagacccatggagctgaattctagtcctggctccttctcttatcagctgtgttaatttgagcctctatttcctctactgaattggtgataatcttctgtggcagcactttgtacgagtttgaattgggcacattcgaaatgattcattatagaaatataaataaaattttatttgtgcacagaattagaaacagtgtgctctccaaattttaaatatttgtcacaaatttgcaatttcagagtggttgtcaggattctctctctcactctttctcagttttaatgagatatcattcatataccatacaatttaccaattcatccatacaaaatttgtcattcggtggtttttaatatattcacagaattgtgcgatcattgccacagtcagttttgaacatttctattatcccagaatggaaccctgtagccattagacgtcgttccttatagtcttaggacaccacacatatactttgtgtttctataaatttgccttgctgggcatttcatagagagagagtacatagtacgtgatcctttctgcctggtttattttacttagcgtgttgttcaggtttcatccatgttctgtgtagcaggtaacagtacctccttcagttctattgccaaagatagggcttccttttaaaataaatttgctctcgccataggaaatatcgctttagcttgtgcagatgaatatgcaccattcttcgtcaagattagtcttgagttatgcaaattctgaattatctgagatattcgacaatgtaccacgtacggaaaatacatctgtgttctgtgtaccttgcagttttgttatgagaattaaatgagataatacacgtagcagcagggctcaatatatgggagggggttcctcaagaaatagagccttctacaattttagttggtttgattgtttcatggtagatctattttttatctgctttttctataatctcaacctttttttttttggatttgggcatacacatgcaggcttattgtatggatatattgtgtgatgctgacgctttgagtatgattgaatctgtcacccaggtagcaccatagtacctaacagttaatttttcaaccctttctcaccagcaccctccgctagtccccagcgtctgttattgccatttttatgtctaagagttccttatgtttagctcccacttataagtgagaatgtgctgtttttggtcttctgttcctgcattaattcaataggataaaggcttccagctgtatccatgttgctacaaaggatatgagttcattcttttctatggctgcatagtattctgtggtgtatgtgtacattttctttatccagttcaccattcatgagtacctaggttgattccatgtctttgctatttgaatagtgctgcaacaaacatatgagtgcatgtgtctttttggtagaacaatttattttattttggatatatacccaggaatgagattgcttgttttaagtgctttgagaaattgccaaactgctttccacagtgcctgaagtaatttacattcccacgaacagtatataagctttcccttttctccacagcctcatcagcatctgttgctttttgactttttaaaatagccattccaactggtgtgacatggtgtctcattgtggtttcagtttgcgtttccctgatgattagtgatcacaatttttcatatgttttttggatacttgtttgtcttcttctgagaagtgtctgttcatgcctttgcccacattttaatagggttatttgtttttcgcttgttgaattatttaagttccttatagattccagatgctggacttccatcagatgcataatttgtgaatattttctcccattcggtttgttgtccatttactctgttgatagtttcctttgctgtgcagatctttagtttaattaaatcccacttgtcaatttttgttttccttgtgattgcttttgagaacttagccataaattatttcccaaggccaatgtccagaatggcgtttcctaggttttcttccaggattcttacagtttgaggttttaaatttgaatatttaatgcatcttgagttaatttttgtatatgatgaaatgtatgggtcatttcattcttctgaatatggctatccaggtatccagaaccatttattgaacagagagtccttttcccattgcttatttgtatcggctttgtggaagagcagatgcctataggtgtgcagctttacttctcagttctttattctgtctcattagtctatgtgtctatttatgtaccgtaccatgctgttttagttaccgtatgcttacagtagagtttaaagtcaggtaatgtgatgcctctggctttgttcattttgcttaggattgctttggctatttggggtattttttggttgtatatgaattttaatagtttttctaattctatcaaaaatgatcttggtagtttgataggaattgcattgaattcatagggagctttgggcagtatctcatctgtttttgtgtttatctcactttaaggaatctccatctatgaaaattccaactgattaaataaaaaattagtcataagtcccctctaacagacctgctcatcaagtgtctccaagatgctgtttaaaaaaatctggtttcttccaaagtgtcaggctttcaggagcccaccagtgattcaagttacataccccttcataaatttccacgcacatccacatattcatgaggcaatctgagacctttacctttgtcagcctgagtacatttctattatggcaatgtcacagccgcgtgtatgagctgtaatgaaagacagcttttgaaaactcctattctaaggtctttcctgacctatttcagcaaaatgtgtaagtgaaagacatttagacaccttttgtctttatctctttttgccctaggcaattaggtgccacaacaaatgacatttttgctccttcagcaagccatcatggctcacctcataggtgggagacaccaggatgaacactttcaaattctttatcccattccatccccccagtgagattgggtattactgtctccatgtttcatgtgaggacacagaagctcagaaaggtcaacacccataatcagagggggaaccatgtaagtctgcctttgcctgacctcaaataccatcttccttcaaggatactgcatttcctctgtctcattgtgggttaattacttcttagtatgcctgcttttcctctatgataaggcacttttatacttattcggcggtctctaacataagcattcagtcctgctccccagccaaggctgtgcatataaataggaaatgttgattttattgcttatgggagatgcaacaggcaagcatcaaaaactgtggtggggtttcagctggaagtgtgcacgttaagaagctgctctaagtcatccctgtccatggggtttttccttacagcatgagacagtccggctatgccttgtcctaattgcaactcaaaggataaggtcaaactacattttaaaaagggcaaacatcaccaggaggaaattttctagagttagaaaaactgtaaccaggaatctagagatgacatttatcttttaaagtatcaatcagagatgcattctgtttcaggcaacaaaatagcaatcagcacagcttaaacatcacaggttgattttcctcgtatttctagaagctgggagatgggtggctgcttcttgtgcttcattgacttgatagttggcatctctgtgagtctttggactttcctttgtggctccaagaaaaagaaaacatataaagcagtatttaaatatgtgtaagcacatatgtgagtatgcatgtgtgcaagtatgtgtgtatacatgcattgtgggctagggaggaaggaatttggaatggatttggggttagcctgtgagtggtcctcacactgtacccaaaagttaagagaccactaaatgaagaagaaaccagcatttcccaagcttttattatgaatttgagaattagttggtggtgagaggcatcactgaaatggtcaattggttaaataagagaaggaatcaaagtgaaactggcttctttactggcagaattttgagagacttcaagatgtgaataggcatgtcagtttccaagatgatgtcacaccagagaatctgttatgagcaggatgttccgtcagcctggcacatgggaggtggcagatcctttggaacggcagctctcagatcctgagctgctaggtatcatgggatgctgagtgggcgtgctcctcctccatagaggagttattaaagccacagagttaaagtaaaatggcccgagagcaagacaatgaatatcagagagggtcacaggacatcaagtggacttgtgaccttgggagtgtaagcacctacagtggacagaggggagtttgtgagcaattttgggataggagccatgacattaatacttcttgaatctcattccctccacactcacccctccaatttagctagctttctctgaaaagccgatactcaaagaataaaatgtttaccgaatgaattaacatgttatataaatgtcaacgcaagaattttggagggtcatttatttcactgcttctcatggggaccaagcatccatctaggttcttggtaggaaattgactatctgggatccttaagatagacataataagtccacatacaaaatggcagacagattttctgcctgtggatctacccagaactgttggtagctgtgttttgggtttccaggtagtctctccctcactttcctgttgactagtaagtgcctggctttgatgtaactgtactgtgcaagatacagagccatgattttcatacatatcacctcatttcagccttgcattatcccgagaaatagataaaggagttctcatttacagataaggacctgaacctagtacacaggaaacttacctaagtctcacaacttcccttcacatcttctctaagaccatgtgaacctgtctatataaaatagagctcaagatggaagaggtgactttaaactcataggtttttaccattggcccagaggaaaaatggagctggaactccattacttggttagtctagggaccagtgaaagtagagtgataatttgggacttttatgaatgtttcttttatagatgtttgtatcagccactgttctctagggaaacagaaacaatgggaagagagtgtgggttggaggaggcagacagaaggaagaagagagagagagattcattgtaagaaattggttcttccaaacaccacatgttctccctcataagtgggagttgaacaatgagaacacatggacacagggaggggaacatcacacactggggctttcaaggggtaggtaagcggcaaaaggagggagagaattaggacaaatacctaaggcatgcggggcttaaaacccaggtgttgggttgataggtgcagcaaaccaccatggcacaggtgtacctatgtaataaacctacacgttctgcacatgtatcccagaacttaaagtaaaatttaaaaaaggatattggttattatgattatggaggctgacatctgcagtcagtagctggagagccaggaaagctgatgtgtggctccagtctgagtctgaagtcctgagaaccagagagctgatggtatcatttccagtctaaacgccagcaggaagggccaatgtattgtttaagtccgaaggctggagtggactgatgttgtagttcaagacaggcctctgactcagctttttggttctgttcagacccgtaagtgagtagatgaggcccaccacattaggaagggtcatttccttttctcagtctaataattcaaatggtaatctcttccagacatgcccttacatccagaataagagttgcccaagtacctggttaccccatggtcagctgagttgactcataaaattaatcatccaactgttgtaggccaaatgttggccccatgatctccacctcctggcattactcctgcagttatgtggcctcacatggcaaaggagactttcttagtgtaattaaggttattaatcagctgaccttaaaacaaggaggttacccgggattatccaggtggacccaggtaatcacatgggccctttaaagcagaagaggaaggcaagagagtgaagaagagagatgcagcagcagagaagagttagagaaatgaggccaaagttagttcagagggttgccaattctgagatcctgaggattcaacctgctgctggcttgcagatggaattgggctgcatgggaagtgtgagaaataaatccattctgccagcaccccaaatgatgctggaaaaggatttttccccccagggactccaataaggaacactgccctgctgaaactgagattttggccttatgagcccctaagcaggaaacctactgtgaaccccacggaggtcatacttctcacccacagatactgttgttgttttaagccacttaatttatgataattttttacaatagcaatagaaaactaatacagaatgtggttacattatcttacataccatttaagagtaaagctgcttttcacaacaaaataacagggatttttttaaaaaagcacacacattcataaactgttgaacagctatcaaaagttcgttttcaaatgaattaccaacttacaattttcaagtattcccaataccaacatcattcttaaattaaaacagcaacggaagcaatctcagggacatgtttagcaacacttcctagtgaagctcccagaattatgaatacttttggtatgcgtgcgatgccactcattaccacgaaccgtcttttgaggaggttgcgctgactgcattaaggagctttacgtgcgagtccccagcccactcagctttcagaagtcacatcgctgcttgccacaattcacctcgctttcccagagtagacatctttcataagatgctgggatttgaagtggaaatcacactgacagaacgacatcatccctgcgattgggataagctaccatcattaaggaagtcacagttgctggtttaaggcttgtacaagcttttcgatattctccagatagtctcctgacacctacacctagaacacatgtgttggaagtaatcctttatgataggtcccttaatgtacttgttttggaatatgaccttctcctgacctgtcttcattgcagaattgctggaaagtctgaaatggggagcacagaaggtcatggtgtggtggttgacacttaggaactctcaaaaaagtgtataaattgccttgatttatcacatactgtgcgtaagttatgctgttctcattcagccaacagtatgtttaatacccaaagccctctttttttttctccttctttgtttttggcatataacagcttattgcagtataattcatagactgtatgattcacccatttaaagtatataattcaatgttttttggtctatttataaagttacacaatcatcgccacaatcaattttagaacatttaatgactcccaaaatgaaattctgggctcattaacgatcatttctcatttcctcgaaaactctttggtactagacaaccaatgatccactttctacctccatggatttgcccattctggacatttcatataaatgcagtcatgcaatatgtggccttttgtgtgtcttctttcactcagcatcatgttttcaggttttattcatgttgtaacatttatcagcacttcatttcattttattgattattaatattgtatgggattatattttattttaagtttttacgttatattttatgacatttatccatttaaaagtccatggacatcgggttgttactactttttggctactatgaataatgctgctctgaacatttttgtgtaagtttcctgtggatatatgttttcatctttttcttaagtatatatctgggaatggaattgctgagttataaagtgactctgtgttaacctttggagaaactggcagactgtgtttcaaagcagctgttccattttacatttccatcagcagtgtatgagggttctaatttctccactttttaccaacacattattattggtcttttattatagcctccttgctaggtgtaaaggagtatctcattgtggttttgatctgatttcctttttcaagattgctttgcctagtctgggttctttgtatttccatataaattttgaaatcaacgtttcaatttctgtgaaaaaagagaaaggcagctggaattttgaaaggcactgttttgaatcaatctgtagatcaactggaagagtattgtcagcttaacaatattgagtcttcccatccatgaatatagaatgcctttccatttatttttgttaatttccttcaacaatgttttatagttttcaatagacaagtcttgcatttattctgttaaatttattcctaagtatatttgatgatattgtaaattgaattattttcttaatttcttatgtggattattcattgttattatatttaatcaattgattcttgtatactgatcttgtgtcctttaaacttgctgggagctctcttttaacatagacattattatgcttattttatgtcttcatttatttgctcaaatctcgtagtagagctactggagcccaacattcatattctgtttgttatacactcataattatacaagtacatgtgcacaagtcaaatattaaacagatacatactgaggtagcattgttccaaatcctcatctatttgagcttacctttctaacgtgtgaactaattatggaaagaatttggttgcttgctgtagctcatgacttaggacgcattttcccctcttcaactgtcttttatttgagccatgattgaattattcaccatgcctagttgttttccttttcctaaacatttaaaaattaactcattttcttttttttctttttttatttcaataggttttttgggaacaggtggtgtttggttacatgagtaagttctttagccgtgatttctgagattttggtgtacccatcacccgagcagtgtccactgtacccaatgtgtagtctcgtatccgttgccatgcccaaccctttccccaagtccccacagtccaatacattattcttatgcctttgcatccttatagcttagctcctacaggtgagtgagaatatatgacattcgattttccattcctgagttacttcacttagaataacagtctgcaattccatccaagtttctgtgaataccattatttcattcttttttatggctgagtagtagtattccatgttatatatatatatatatatatatatatatatatatatatatatatatatatatactaggtttttttaatctgttcattgattgatgggcacttggcctggttccatgttcttgcaattgcaaattgtgctgctataaacatgcatgtgcaagtatctttttcgtataatgacttcttttcctcttagtagatacctagtagcaggattgctggatcaaacagtaggtctacttttagttctttaaggaatctccacactgtttttcacagtggttgtacttgtttacattcccaccaagaatggtcatgatcaaaaaatgaaaaaataatagatgcggggaaaagggaacactttttacactgttggtgggaaaattagctcattttctagtagcagtatatctctccaacaaacaagtcacctgtttttttttcctgaacacaccatctctcatcattcttgatgctaaaatataagcatgtaggtccaaacctgtctctcctcctttcagagtgaccagagagacccttctagtgttttgttttgtttttttgagctggggtctcctgtgttgccagtctagagtacagtagtgcagtcatggctcactgcagcatctagctccaaggctcgggtcatcctcccacctcagcctccccagcagctaggactacaggtgtgcaccaccaggccctgccaatttttttaaatttatttttcgtacagatggaatctcactgtgttgccgaggttggtctcacatccctggcctcaagtgatcctaccacctcagcctcacatagtgttgggattacaggcatgagccaccatgactgtcttcttctagtcttgatgcctctcctctccatctgtagaccccactcctcctaggtcacttcctgtgaccccacaccaacatcctttctctagaaacggccattcccaaactgtgagcctcgtgtttgtattcatgacacatatgtagcatccactgtgaagtcaaaattaaggtgaatggtaaactcaaccacctggcttcatgttgaccttgtccctagactcccattccctgcagctggtcttgctctctactttgaaaacacagttgatgccatctgaaacgatctcctccacttggatctctctgcccgtatttacctgtatctccaatatctcctgctactcaagtatcttctttttattaaaactttcatatcgttggctaggcgcggtggctcacgcctgtaatcccagcactttggaagtctgaggcggacggatcgtgaagtcaggagattgagaccatcctggctaacatggtgaaaccccatctctactaaaaaatagaaaaaattagccgggtgcggtggcgggcggctatagtcgcagctactcgggaggctgaggcaggagaatggtgtgaacccgggaggtggagcttgcagtgagccaaggctgcgccactgcactccagcctgggtaacacagcgagactccatttcaaaaaaaaaaaaaaaaacttccatattttcagttctatcttctttttattcttcctttacctgtacctttattgatttattttaacttttgttttaggttcaggggtacatgtgcaggtttgttatacagggaaattgtgtgtcacaggggtttggtgtacagattatttcatcacccaggtaataagcatggtaccctataggtagtttttttgttctcaccctcttcccaccctccacccttaagtaggtaggccctggtgactgttgatcccttcttcgtgttcttgtgtactcagtgtttagctcccacttataaatgagaacatgtggcaattggttttccatttctttgttactttgcttaggataatggtctccatttccatccatgtcactgcaaaggacatgatcttgttcttttgtatagctgtgtagtattccacattatatatgtaccatatttctttaatccagtctactgttgatgggcatttaggttgaatccctgtctttactactgtgaatagtgctgcagtgaaaaaatgctcaacatcactaatcattagagaaatgcaaataaaatccacaataagataccatctcacaccagtcagaatggctattactaaaaagtcaaaacgaaacaggtgctggcaaggttgcagaaaaaaagggaacatttttacactgctagtgggaatgtaagttagttcagacgctgtggaaagcagtttggtgatttctcagtgaacttaaaactaccattcaacctagcagtctcattgttagatatatacccaaataaatataaatcattctgccataaagatgcctgtacttttaattctattttctgttgactgccccatggcctttctttttaaatcattaccctctccttcctgcatcttcagtcacattctccatcatttcttttgcattagtggagaaacatatccaggtctcccaatcctaatatgagagaatccactatacccctgcctttttgttcttgcttactgcccattataagcccttttcctctttcttggcatacttatactttctgaaaatgcaatgtttattatgtcagccatgtatacatctgctgttgtgaaagataattttaggtggcatagaggtgatcttttataattttaatagctatttattttgatgtacaactaagcaatacctggtacgtttccataatttaaatcatatcattgcttagaagtaagttaaatttcaaaaatcaatttaaagtatattgaaagtagattaatagtggtactgtcaatacttacatatgaatcactgaaatactggaaggctttgcatgtaagaaaagcagaactttaaagacaaacggaactcagagtggatagtacccctgaatggacagtgcttcacgagtcttttctggatgaccctaagaaagttagttgtctacattgcagaaaggctatgaagattagagcaatgtatttaaaggaacaagaacattgtccagaaaaaaaataggtgtttaataaatggtaactaatcatcccccggaccgtatatacagatatatagggatacctttggggaaagtagaatggcccaatatgtaggttattcagttccacgtaagtgggtgttcacgagatgcttcctgatttgaaacatcaccatcatcaacaataacagcattgatgagaggtcatcatgggccaccactgtactacgcctttcagatgtacacctcactcattcccagtttgcaacagctttgtatgggaggttctgtaacatccccactttataggtgagaacactgagtctcagggaggtgaaatattttacacaagattgctcaactagtgacaggtgaagcagagattcaaattccagaagtctgatttcaaagttgtctctcttaaccactgtgttgtatctcaaatcatgacagttctaacttcatgtgtcatggtacttggcataaggacgtttttctccccattcttccccaaattcagtgcaaaaaatatatatgctgagtttttcatgggccaggtctactctattcttagagaaagggtcgggtgcggtggctcatgcctgttatcctagcactttgggaagctgaggcaggtggaccacgaggtcaagagattgagaccatcctggccaacatggtgaaaccccatctctactaaaaatataaaaatttactgggtgtggtggcatgcaactgtagtcccagctactcgggaggctgaagcaggagaatggcttgaatccgggaggcagaggttgcagtgagccgaggtggtgccactgcactccagcctggtgacagagcgagactcggtctaaaaaaaaaaaaaaaaaaaaaaaagacaatgacagagagcgacaactcatctctgcatctctgctttctgtggggaaacttgcaagtaaaggagactgacaagtgatggcgttaaactgtgctaagttgacaaaacacagaatcctcactgcctatgaatatggatctagggaagccagcaatggacctttggcagagtcaagtgaaatctttataggagatgaactgaaatagtttagaaagaatgcattaagatagttttacctaaatagtttatcgtcatatcaataaaattgatcatctctatcaccagttttaaagttggctttgacaacttttccaaagccagagtttgggcatatttgggtatttccataatattgagcaaatgtttaaactatattgaaaacgtttgccgtgcataacagcatcccaataggaagcagacggcatgctcaaactaggacagttgtaggaggacctatttttaaaagggcctagttacaaaggggaattgcaaaggataggagcataaccttgggcagtaagaactgagtaggaacagtgctccacagagagtgcaaagtaagctgatgggttgaagctaaggagcagggaaaagatctagaaggctcccaggcagaaagtgattggtaagctgagtcttgaaggaatcccttctggatagcatgagaagcttgttccggaagaaggaacctatgtacgaagacctgaaagagtaaggcatgatctgagaatacaggtagagggggtgtgacttgggcataggctatggggatggcagggagtagaaagggctggaaaggccaccatgatacaggtgttggagagaggcaggcatcatgcaaagtgtatgtgttaagactattaggaacaaaatatttgtggattaaagatataacacagtggttaagagaggcagctttgaaaccagacttcttggatttgaatctccgctttacctttcactagttgagggatcttcgataaaatacttcacctccttgagactcagtgttctaacctatccctagacctgaggaatgaaggaagagtcactgatctggaaggcgtgagtcccatagagagcctcgtgggaggaacagagaccaccagcatgggatacatccaaccgcaggcaacccgaaagggaaggatccaggggaatgagcatgctgaccttactcaaccaccaccttctgatctccaaacgcaacaggaagtcgaaggtctttctctattcaggccagcctctaaggacagaggggaggcagtggagggtactaaggcgtgctaaagggtcacactaatgatgctccgcaaagagtgcaaactttcttatatgttcttgctgctgttccataaagcaaagactggatccacataacctgatggagcaaagtcttagtccaaccccttagcctgcaaactctggaattttagaaaagtcaatagtgtgccccagacatatttcaatatacctccattttactccaggtaaaaggtttcttgcatccatttaactattgtaaatgaataaccatgtgaccctcaagaagattccaagccaaattccattggtttctaaggtcttaggtttgcttgcttttggcaaagagtgtacttatcttttcatgcatgcctttaaagagaccatattttttctctgataaagtcaattatcagtgtatgtgctgctctgttcacagttttgactaaatagtgcaacatctacgtagaaaacataccccaaacttgagttttcctgggttgtgcattgtacattgtcaaagcgtaaagaacatctgagttggaactcgtacccacttcaggatatgagaagatgcaggtcagtgatttgtttcgaggcggaagaagcttaaagaaagtaccttgcgctgtgtgttcctccattagcatttgttattatgaaagcattagactatctctggatgttttccacacacctgagagtgtgaaagaatgacaggtacctcattaaagatgcataatatctagtctcctgttctcacacagactccaaccactggtatgaatatactgcttccatatgagcctgctgcaagccagccagatcctattcagaatatctcctttctaccacatccaaatgtgggcagcctatatatacagatttgaagtgcaaagggtttgagtcaactttttgataaccgtggggattttccatctcaagaaattccgaaaatgatgtaatgatataatgtagcagaattttaatttagtaggtaggattaagagctgacaaatttcctctctttaagtttctttaattctgtctgtgcaagtcagagcattcggtatattcccaccctcccagctgatatgctaaaattggtttcactgtactactctcaggcatgcaatgagctaggcaaagctgtttagttacttgcgatctgtttacattacatagaaggttggttaattagaaataatcatgtttcttaattaaggaacaaattgatttttaaagaagtgctgaggcccccttgggccacagcagataagggactgagctcatggtttgtggttgtctgtgtgattctctttaaggagggtctgaagtgtacagtgacacagctatcagtggctatggaatcaaatatttgtagattaaaaattgtactcattctgctgacatcttatgagtatctgttgtgtgcagagaaatatgttggaggactctgggaacttgaagataagtaagacaaaatcagatctttaatggagctgagggtggcatggtaaaaacaggcttgtatgttgtatatttagcaaactgtgttaagtcctagaagagagatgggtaaatatcccaggaaaacactgagagcaaagtaagctgatggggtgaggctagggagaaggcaaaagatctagaaggctcccaggcagaaagtgattggtaatctgagtcttgagggaaccccttctggatagcatgagaagcttgttgcaggaagaatgaacctgtatacaaagacctgaaagagtaaggcttgatctgggaatacaggtagaggagatgtgacttgagggtaggctatggggatggcagggagtagaaagggctggaaaggccatgatacaggtgttggagagaggcagacgtcatgcagagtgtatgcattaggactattagggtgagtttaagcagggaaaaaaaattgcatcagctcatttatttaaaggaccaagaggagctttagggatagcagtatctaggtgttccaactgtattgtgaagaatctttcttacttattccttggctctgcttttctctgggatagctttccccaggtgatagcaaacaaaaatggccacctggcattttccctactattttagcaaatgaagctgcccctcgcccttcataaaagtattgttcccatgtaactccctttaaagttttaggtatgcctctgttggcccagtttaagtcatgtgcccatccctgaattagtctctgtatgcacagatgtggaagactcaaaggggcttgtgcctacacctagagccaggtatgggggaaaggtgataccagcccttcctcaacttcaaggactaagagtgaaagaatggtggtcgcttaagggaaaaggagaatgctgatatcaagagcaaggagaacagacgcaggacagaaataaatagatagctagtatgcaaagatgtcaaagtgacagctcttgatgagttttgagtaaaaacgacatggacacattttcattagaaaaaaattattctggctttggagaatgggtaggagagaggaacatctaactcggtgagatgctagcatgatgacaagggcttggtctcaggtggttgtggtagagatggtgagcatgagacatgcatactctagagagagttaggaggtacaaaagatggacttgggggtttctgatacattacaaagggccagaaatctttgagcatcttgtcccctccccttgattctaggtgaggaggggacattgatttgaccaatacaatatgtagaagtgacactctgccacttctttgatccaggccttaagaaatgggttgatttaatttactgtctcttgcaacgttcactctgatagaagccagcaccacataagaagtttggctacctggagactgccctgtgtggagatgctcaagctatatgaaagggccttgaaggatgacatactgtatgaacagagaggtcaaggaggagtgaagcactattcatgggaataaaggagctatatcagaattagactctccaaccctggctgacctcatgagaatctgagatgtaccacccagctgagtccttcctgaatccctaacccacaaaatcataaacacgataaaagtgacaaaatgtttagatgttttcattctacagcactaaataaccagaataagaactgaattaaacataaaaaggagggaggggtttatgttatcagccaatggcaagcaccactgaagtttttaacaaatataagacaaaaggttaaaccacacatctggcccacacccagcccccagttcctaaaaagcctggtccatctcttcctcttcttgccacatctcaaaggctatctctctatgtggatataaattatagatttaggttatagtttcccttcctcctggggtttcctctttgatgggactgtcaaactcttgggtgagctttattgtcagtcacagggtctgtcagttttcccatagtagtattatttcactcatcctttaatgtgcccattggtggtgacaaattttctaacatgcaaccacaggccataaatgtaaaaataaagcaaaagtcattgaattgaaaagcaggagacactttgcaaggctccaaccagtgagcttccatttcttctgcctgataatgactcccacacttatgccatttcttgagaactgtaaccagaaacccatgttttgggagtcaatagaatagatcagagcaaagacaaaggcaagagaagtgagattggtctttgttctggtgttatctggtagaaagaccataacacacagctaaccaataaggtactttgcaaaaattagaaaaaggtgtccccttcaagcagataagttctgagaaagtacccctctggaaagaagcagaccattgaggtcttggcttaatgagtagaagatgaatttgcatgtaaaacaaatatatcccttcttccagagagctgagcaagaggagggcaggctgctctcagtaccctttggacccgctaccatgcatggtggctttgaaaaagccaggcatttgcttcctaagagcacaccttgcagaagcagcatcaccatcatcactacgatttatccagcctttgctctatggtagatgctgtgcaagtgctttcggtctcatcctgaaacaactattgatatagatgccacatagatgacaaaacaacaactgagaatcttgatgccttgccctgaaacacacagactaggagtgggagagctgtaacttacacctgacctttctagctcacatgtggcctcctgttcagcggagagggacttcttggagaggtgccctgagaaaaacacatcccttgaccatgagtttttaacagtatcagctctcatcgggacattattatgttctagttgtctgcaacgataatatatgtgactgttattttgtctcatatctccaataaaggggtccccttcagttggattggccataccttcaggtgggatgcaactgtgagtctgtgtacatggcccagaagcaaatgcagcacagtggagtgattaagactctgatatgatccagttattgctggactggatctctgtttcttattatcatatttgcatgaccttaggcaagatacttgactgctctgagccttagtttcttcctctttaaattgggatgactgtagtttgttataaaaatgctgtagataattcccagacttgtaggtaacacatattattaaacagtagaactgtcgtgaccattaccagaaagattttacaaacaccctaaaatcatcataggattcagctagtgttcttagccttctaagctcacaccattgtctcatgctaaacttgtggtccaccagaaacttaagtgcatatttcttataattatttccaagataggtttctccagtttagaaattgtatatacacatgcatctatatatatatatatacacacacacacacacacacgtgtgtgtataacatatgcttatccttgatgtcatatttacccatgatttttattttaattagctttaccccatgggaagaatacaatgtcttttgtcttcaacctggtttgttggcaattattcttagcctttttaaaatattcaaaatctcataagcatgcattctgcatcttcaccaaagtaataacaactgtatatggtttagaagggcactgactacctctccctcaagtgtcaactaaaaaatattagatacgaagcttgagtcaagaactgtcctgggtgctgttgactcttctacgtccggtgtcttccatggcctatggtacaaagtcactccagaacattggatggatggatgggtggagagacggatgagtggatggatggatggtaaggttattgaatagaatagaattatatatttatgtttacctttgcctaaaaggcaaccatacagtgttttggtgaggttgatcaaccagttatatatttacctaagagtttgatcactcagcccacgttttcccatggtatgcacaacttgatcatgagaaggttttcacaggccttcctgaaatcatgatactatatatttgccaggctcctggtttatcagttacacaacaacagacttgaagaagaaaaccagctcacatctgtgcacaaggagacacacagttgttcattactgcattgtttgaaaaccactacgttgtaaattgcataaatgtgtatcaatgggtgaatggctaataaaaactttaaaaataaatataaaactgccattcaaaggaatgaacgaaatattatataaatatataacccaataatttctataaagattatatgtgtgtgtatatagatatatgtattatatatgtgtgtgtgtatatatatatatatatatagagagagagagagagagagagagagagactgtcccagaacaaggaagccaattttagggcatattccatataatacaatttttaaacaattaataaacatatacataaaatataccatattattctcagaaacaaatatatgcctaagatgattcaaaatggacattggtattcttgcgtgaggatgagagtggttgtcattggtaaaaaggttgaaagtcatagaacaggatatgacggatcaaagatcttaagctttatctgtaatattttatttcttttaataaaataaagacaaagcaaatgtgacaaagtgttaccagttggcaattccagatggtgggtgtgctgattttcatactattgttctttgtgcttttctgtgttttcttaaaattcccaaaatatgaaactgaagaaggaaggtaaccatcattggttgctgactgtcagcccattcattctatttttgctcccagctattttttatttgaagataaaagacgtgacagatacacgtgaaacctttctatctacctacctaatttaggattagacttagctgcatgtaaaagaaaaaaaaatctcaagagtgagacatttctttttatcacataaaagacattcagaggtctgtatagggcagtctggagacgtcatttgggacaaaattctaccattctcagcacgtagattctgccctccaggccacttcatggctcaaggtggctgattggagctccagccttcacctccatattctagaccaacagtaccctcccttcccaaaattacctctgcttacagctcatgggccagaattcatcacatggccatgtaactgcaagggggatagagaatatcatgtttcattagggcacattacccaaggtttttttttttttttcctttaattaaggaaaaagagaagagtgtatattaggaagtaactagcagccctgccacaaaaatgccctcatcctcactgccctccctcccttctcagaggaaggcactctcttagagttagtatataaccttcttgtctatgtttctataattaaataactatgttcctatccatttaaaatacatggttttattgatcttaaagttttaataaattctgcaattattgctttcttgttccaggaaacatgctaagtacttcatgcttattatttcattgtgtcctcaatagatggtaacaactacctatttaatagttgcttgcttttttcacattttagcaaatgtacctttttctaatttctaaagttgatgttccctccttgccatctggagtgagcacatctctttagcctccaccagttcctaactgcctgaaattttcccagaaatcgtggactccccctttccctgccccttcatgtcttcctggatttctgacatctggcttctcctgcctgtgcattaagagttccaaacctctctgacttaagccaacagtgactttcagtgttgtgcgttccctatccatgttcatgattttttagcaccgagatcgcatcagcaagaaccctcaaagccctgggatgcagttcttctggatctcaagtcttgaacacattaaatgataagctctttacagactttctcttcccaattattaagcagcaattacccttcacatcaccttctcccatatcacctctataattccaaccactctcacctaaaaaagctcacctaaacccaccacttgtctatctgagtcaaatcattccaaaccaaagctgcacatgcctgaaattagggattaaaaaaaaaaaagtaccaagaggataaacaccttccttcctttactagatccagggtatttttcaactgaatgcagccattgccaccctatatttggcttttagagacagactgaagtctaacaagttgctccttatacttgaattcacaagtataaaatcatatggatgacttgtgcaccttgctgtcattctgtgcagagctctgcctgtgcactccttccctcacttaccgagggcctagttcatcctccacctctgtggacacaggaacgacgaaaaagtctcccttatgacctaacggcttagagcatgggtcccataatccaatgtgaatgggcttccaccccaactctaccagctacttattgtgtggttgtgagtaagtcacctaccttctcagaacttctgtttcttcatctatagtagaaggatactaattcctccaccatagggatgatttgaggacagcactgactaatagccataaagtacttagcttgctgcctggcacataatgaagacaaaaatgaacattgaccaatactagcatcatctgcatctccaccatttccaccatcatccttaattggttgtgcaaataaatccacaagtacaatttaatcaggtaaattaatggaaatattttattctggggttattttaaatgtacagaaaagttgcacgaacagaacaaagaacttccataccccctcatgctgatccccagctattcacatttcactgcgtacactctatctccctatgtatgtatctatgtgatgtcccttcaaccctcagtgctccatcatatctgcctccccaagtacaccctcctgcataaccaccatgcaaacccacaagtcaagaaatgagcactgaaacaaaacccagtgcatcaatacattgatgcaatgtccaatctccacaccccgttcagggtttttctagccctcctacctttcccttcttaaaaataccttctgcaacagtgagaaatcttcattaacctcagatctgtccagctgtcctagtgatgtctctttttcatatctggcccaggattccatccagttacaccaatggttctcatctggagctgactttgcactcccctctgaccccacccatggtacatttggtaatgtctggagacatttgatcacacaagtgggaattggtattgacatctagggcttagacaccagagatgatgccagacaccgtgcagtgtgcaagacagaccccaagaattatccagtcaaaaatcttgaaagagctaaagtgcagaaaccccgagttacacattgcatttaattgtcacatctttgcagtctgccccagtttggagcatttcctcagtctttccctgactttcatcgtcccaacagtttggaagaatgcagccctacattctgcagtgtgatgctcaacgtggtccatctgatgtttcctcgggaccagtttcaggtcatacgttctggggagaaaaaccacagaaatgatgccatgttatcagtgttccacctgctggggcacacacaaccaaccctgcccaaggctcaggaatgttagcctctttcacctggtcatgtcaacatcctcaggtttccccccaaaaaagtcaccattttcccctttataatcaaatttgcagcaagatattccagatcatcgatcttgtgatatgctgctctcatgagacctcaactcacaagccttgactcacctgccagttcttagctgagcatctgccctgatggtgtggagtgatttcctttttccatggctccttgtacatttatggttggcattctactgcaaggaagactgtttcctcttctcccattagtatattcattcatttattttttatatcagaatggactcatgtggttttaattctttgggttgttttctgttgctgtctttcttttttaatgctgtgcttaaattgtgtcatatttggccagggggagcctggggcttttgataattcctcatttatttttactgcttactttcttatacaatgagatattctgaactcatgttgtaccttcctgcccaaccctggattgagtgacttcctcaaggaaccttggtttcttttcatggagggtggtctttagaaatcagtgtctgggtatttggtgaggttgtggctgctggagtgtcactgctgctaggtcctttcagcagacagagcaatgatacagacacacacatatacatacacatatacatccacacaaatatacgtacatatatatgggtgtacacatatatacacatgggtacatctatatgtactcatttatacatgcttgcacatatgtctacaactactgtatctctctgcattgttcatacattaaatttaaaacacaagttcaaactgatatctccaattccaatctaatatctaagggtttttctagccctcctacctttcgtgtttatcaataccttctgcaacagtgagaaacctattattattctcaatatatctactaattgatttgatgaaatcacatgatgtaaccagcctctcaaccatgccagccatctctgctgactgccacctctgcctgacttcccagagccccatatcccaggctaccagcaggcactggtccttcctttcttccctccaagtcccccaggccagtgaaagaaggaaatagactaccgaggcgaatttatggacagaacaatagggtcaagggttaagccaagaggcttattacaagaggtaatgcaaagaggctttctgcaggaatcaacaccttgagctgccccaagggcatagaagcatcagcaaggttaacaccctgtgggaacacgagcagaaggaatggttctgccaaaggcatggaggaagagagcctggtcactctggcacttgcatgtgggtcagcagcatgggatccgagggtatggagaggggagagtggtgaagaggaggctagacaggtgtgcagggccacatggcaaaaggcctcatgtggatcaatgtggactaatgatgaatctttcctgtctcactcttcaggcatgcgcttggcttttggattctttaagtactctcagataaatccacctgtcctttccaaagtcatttccatctattatatacaagtctcatgagttgtcgtgtgtaacatggtatgtccaacttctaggaaagtattttgtacatagtatatgctcagtaagtattttaaggcaccaatgtatatttttatctcaaataagctctcctggccctctttcaaacaaagatggttggcaaacagcagccagctcccagcacaggtggcccctactgtctctacatttgtatggaaaatgtaatgggtcatgaaattgcatgcattagcatgcggatgcttagacatatatattttttgcaaacatttcatcctataaaagtaagggaccaaagtataaaattctttagaggcatcagctggaggtagtagtcaatgagagagaatcattgtttccattaaatagtaccagtttttgtaaggcaagtaagatcttcatgttaattctaagaaactgtatgcctcattaggcagctaaggcatattatgatttggatgcagaataaccccagtgataaatgaatctcccagcagagtagcttccagattataatttctttctttgcaagattgctataggcaaggtggcctgatcacttttcagaggcccatcttaatagtcagagtaagctcagctatgctgtagtaacaagaaaatcccataatctcagtgtcttaataaattaaaataacttatttataacaaaatgtctaatgcaaatagggctccttcatcttgtagttactctagaacatggggtctctatggtcacctatggcatgggaaaagggattgaggtgacattcagctctttgctcagcccaagaatgaaactcatcacatctgttttcagtccagtgaccaatactagtcatgtggccccagcataactacaggagaggctggagaatatatgggaacctcctcacattcaccaaatggaatctttggtgaattctaaagattcccggcatgtcccactatctccttttggggctgagaaaatgaaagaaaaaactgacaggccaatgtactgactgctctctcacctgggtctgatcccatctgaagctactttgggtggttatcacaatgtagtttatcatagtgctgtggaatatgaactatgaccatagccagccctatattctagaaccagcatctccatttgtagctatgggtgcttggacaaacacttcaatgttctccatctcagtttcctcatctgaaaatagagtaaacaacagtaccaacctcatagggttgtgtggattaagtagttagaaacatgtcgctgttgaggaaacatgagctgctgttgtatttgaaatggtgctgaattcagaatcccatggaaatcttcactatgacaagaattaaccagcccagagccacatggagaaaagatgtgtggccacgatctcttgaccgaatccagcatcagaatccaccagacaaaaccagcatcaggacattggccacaaagggataggcgtcccaggatgctggaatgttgggggcagcgctattattagagacacctggtcactgacccagctttcttcccatggctcaagctgagacttgatagtaaaaactgccttaaatggaagcaactatatttttgatgtatgctcttctaggatgatactaaaagccatatataaaagaggtgttggttcaaaataagtgggatttttcagttccacctatacccggatagtattacccaccctacttgaggactctaggaggcaggtaagctacagtgaaatgtgctacccttgctagttgtggtcacttcatttaaggtaagaggttgtatcttcatttaacttgatgaggaattttccatcatacaattagttttgactgcaagtataagaaaatctaaccatggtggcttaaacagtttgggggatgtttgttggctgctggtattgattcaacatcatgatgatgtcaggggtgtccccactgtgattctcttagccttttctgcaagacagctgcctctgctctagtcatcacttctgtatttaaggaagagataaggggaagaagtaaggtccaccccaccttttccattgcatctagaaagccaaagtttccctgaaacatcatctttagctccctgctgcaagagactttcgcctacattttcttagccagaattgtgttatatgcccatccttagtgacaagggaagtttggaaaattaaatacttgtgttcatagactctattatagaggcaggggaggaaaacaggggccagaaatgagtgttaggtcaaccaagttacaatgtctgccccaggaacttatccaagaatagtatatgtgagaaggaggaggaggaggcaaggtacccattcttatgctcacttgagatgccatatttgatcctccctagcattcctcaacttaagggctgttctttcttctgcaggaagaaggcttaagatgtgaactggaaagttcttattctccactgagaactaattgcctgcagcaggtttcggctcacttctagttgtttactattttccaagtcactgtgattccagaaggtattgggcctcagtggagctcaaaatggatattagctcttgggtgtgtttcatcgatttgggcacaggagggaaattatacacagaggattgtcatcctggacagttaaaaatttaaagtaaatgaactgaacaaacctcctcccttaaatagtgctcagaaatcaaagagctgaaaaaatgtaaatgggattcattaagagctacaaaattatcttcttgtgttgctttgataagtttttcttgcaaatctctagaagtttagctcagggcaagtcttggacatggttgagaatgtctgccttatgaatggcgaagtggacaatggggaccagtgagaagaggctcttaatatgtgaccatcttaggatgccactggctcctacagcagtccccctggcactttccccttgctgtctctttctttgccttggtttgcagtgtttacacagcatgtccaagtgctagtttgagttaattttcattatgctcattttaacacaaaggacttgagtattcaagaatttctgtagtgctgggtttttactttctctgttggcaagaattacctttggttaacctttgtcttatagactcattgggtttcagttatcaggactggggtaaaagacctcctagacatgacacctactctgacagagaccaagaatccggcattgacaccctgaggctgtacttggctggcaggttttttattgttgtttggactgtgcagtgttttataatatttaagaatcacatttctgggctaggcatggtggcttatggctgtgatctcagcactttgggaggcaaaagcaggcttaagtccaggagttggagaccagcctgggcaacatggaataaccctctctctggaaaaaaaaaaaaaaaaaaatgttagccaggcatggtggtaatgcctgtagtcccaactacttgggaggctgaggtgggaggatcgcttgggcccagaaagtcgaggctactttgagtcgtgattgtaccactgcactccagcttggccaacagtaagatcctgtctcaaaaaaatcacatttctggctttttttgatcaacgagatttgatgatattggacaagtgtttggaggtggcaccatgggcaggagctgaggagcagctgcctgtttggatcatggcagctacagtcctcaccacaccctattgccttgcactcttcccatgatgctgatttaccaatctctgcatggccactttaggccctgcgttggtgtaccccatccagattgtctccattgtaaagccatatatttccaagggcacagcaggtgtgtgtggtatgctgagagtccccttctatctctccaccaccctctccatacttgctccccaggatggccatggatacagctacattagcctcacctgggtgcttcttagaaattcagaatctaaagctcagcccagacctactgaatcagaatctgccgtttaataagatccacaggtgatctgtgtgctcataaggtgggagaagcgttggtctaaagcacaattttcaaacttggctgatgataggaatgaccagggcgcttgtgaaaaacccattcccaggcaccaccctaaaaccagtcagagccgacagggaagggctctgagaatccacaggcttaacatgtgccccagtgattctaagacaatggtcaattaaaaagacttggcttgaagacttagttctcaaacgggtatgcatcagaatcactcagattgcttttcattttttaattaaagaaacataatttacaaaaatcacattattgtaagaattttaaaaagtcagatatgcaaaatataaaactataaaattgccatagttgttattttagcgtatcttaacgttttagtgtataagcatttttttaggtgtttgtgtgtgtatattttttaccaaaatgagatcgtaccataacgttattttcaaatctgattttctcagttaacaatctctatctttctataagaataattttcccatttgaccccgaattccaatttacagtgaattgttctgtctaaactaggagccaatccagatggatctggttattccatcctttatgttttttataaacaagcacattcttctcctcctcaatccctttattttattctccacataatgctgccttattgatggactggaccatttattctgcagatagtcccaccttttagacttatctggtcacttccttatggtgtcacatagcttgttgctctgtcctggggtgcctttgtttattctctttaatgcattttccaagactcccctcaaactccaatgaattaaagttttcagagtttggggcctgggaatctgaagtggttccactttgccaggtgagtctgagtttgagaggaaaggtgtcctagatcattcagcagcagcagaagagttggcccttaaatctacgaagaacattgccctgtgcatctgcatgcagacagggtctgataacatcaaagctgggagtctctccaacgctttaactaatgggatctgagctcggctgtttatttatagtcattcagtgataagaaagtcaacttggttggaaggagcttctgtcctaggcttgcagctggggccttagctacccttgtaattttcccagaaaaaaaaatgcacatctctttgagtcctgggccatgtgtaaatcagtggtaatacaagaaacatggagcaccccagaaaatcttcagaccctgagtttggagctgaggaactcagaaacactcaatttcatcgaagccccttcatacagctttgaatgcatacattatggggtctgtggctcagaggtaccagtgctcagagcagtatctgctttcctagtatggcctgtgggcagtggtctcagcatgcagcatcactgaacagaaccctgcatatgccataatttacgtagatactatggaggtggaaccatgtatggttaagtcccggggccctggagcagtagatcttaaccttattggacacagtatcccatttctatttacaaatacttttttttttttccatgagaacaaccacagggacttttaacttgcctaaagataatgtgtgattttgagatgtgattagggattatcattcccacagtgatcctactatcaacaggaactgctgtttctattatcaacaagaatatgcctccaagccaggagtcctgctgatcccactgtctccccaccccaacagccatggcccgagatcagattgtctccatggattctagtgctcagggaagttaagaaaactcaattcacggtgctcagttcaaccttagacatgcatcagaatcactcacattgctgtttaattttttaattaaataaaaatatttattcagccgaggtagctgaagcaggagaaggaagagcctcaactcaggggaagatttgctgtcaccccctgacactgagcagaggccagtcaaatccactggagctgacctctttgatgtcaggctcagcagaggcctggctcttagcaggccagcttcctgtgcttgggattgcttgtcttagctttcagaggatttaattgctgattcaaaccatacaaagtacaacgaacagtatctactggtgggttgaacaaatgggttccaatgactcaggcccgagtgacctctgctgcctctaacctccttcaccatctgctgcccagggggtcctgagaggccaataagtatctgccaagatgctctttagtatccttctgtgacattcataagatgttaacctgcctacacacttttttttttttttgagacagcgtcttacccgtcgcccaggatggactgcaataacatgatcttggcttactgcaacctctgcctcccgggttcaaatgattctcctgcctcagcctcccgagtagctgggattacaggtgcctaccaccacacccagctaatttttgtatttttcgtagagacggggtttcaccatgttggcccggctggtctcgaactcccgacctcgtgatccgcccgcctcagcctcccaaagtgctgggattacaggcatgagccaccgtgccagccacacatttaaaataatgataatagtaagccccaattatactataaaggaacaactaatttagaataggaggtctaggtaaatatgcaaatgcaaatactctggcgcaacccccctggaaaacataatgaagtggtcccgccagagtatcctcacacagggtcaccaccaacacattgcatcagctgccatgcagacgaacacaggtctgttttgcattgtcacccaagtgacattcagtattgccattggttaggcaattttccagaattggtgagattctgaaccaaacaaaaaacaagatcacctcttttgacacagggtctgcattgtggtgatgtgtggaatatgttcatctgtacgaaaatatttggggtttgagtgtaaaatcgagttgggttctagactcagataaacaagattttttttctcccccacccaaagactgtttatcagggtcattcgaaatgtatgtggggcaactctatgtagtcaggagctccatgcatcgcggggtgtctaacacctaattgtcacctcccactaaatgccagtaacacccccgattattgtgacactcaaaaatcgccccctcgcacttcgaaagcacacccctatacacactgatcttctgttaaccctgccttgaatgacttcggtagcctgaattcccatcctggccccactgcctcatagcttcgtggccctgggcaagcccacaacccccaaacctcagtttcctcatctgtgatatgggtgcatggaggaggttaaataacagctccaatcttaaagcctccttagcgccgtgcctcacgagctgtaagtactaaatgaatgctggctattatatataacttatattgtatattatttatgattgttcctaaaattatcactaataagtgcttcacagcaatgagctaagattctgagtgctatttcatggattttagagaaataattagattctagaacctcaattatcatcgtaatgactcccctgatagagttccaaaactgtttctttgtgaccactcacagtaagaacatcacacgaatgaatattccacctgtcttaggtgtgcacacagaaggtactgacggttctctctgagcagttccaagccctcatctgggaccacgtcttcccaagaccaagccctaagtcgtgatataaaacaagaaaagacgctgggagtacagtcagcttcaaagacagaaccagcgcacgaggcagaatcacagtgtcagagcttctgtaattacacgctaaattatgcggtgccatctttaaattatgtaggaaatagaaaaaggaaaatctcggtggaggatggaggtagcttctagaaggaggtgggcctgagccgcccctgaagaatgttgggaatctgggtcaggcaagaggctggaggagagaggtgaagagctggaaggaagttgggaggggagaggcccaggggagggcatagatggagggtgatggggtgtgggtgcccaggcctgggaattcagacctgccaatagccctttcaagggccagagacagttccctgccagaataaatacatagataaatactatttaaagcaaaaacaaagtgtcaccaatatctagataaagtgtccccaaggatacatctggtgctattccgtgagaccatgtcacccagagctggtgctaaactgatgccaaggggtgcccatggaaatgccacctttgggtgggcagaggcatttggctctgcactggtttttatggtgtgggaaaggaagcattctcgtgggaatattgttcttgcctccaggaagggctgtgggaacgtgcagttactgcagagggacatttctgagcatacatgcttgtttatgatgatggatgactggctcaggagagagctaaaatgatcctttccctagagatgtgaggagaagccagcccagaatttctgtcacaatctgctgcccgagtccagtgactcagaaacaaagttcatctttactgacgtgccatggctgccaggaaccagggcagctgctaagccaccaatccccagcccacagttttgtgcggaggagacatagacatatatgttattgcaattatggctctactgaaagaatgaatgaatttaatcgaatcaatcattcattcaattcagttgaatcattcattcattgaattgaatcattcattcaatgaatgaatcccctggtcaaggaaccaggctcagcccacaatgtatgcatttattcattcattcatttaacaagcaatgccaggcttctggcctcagggagtacatgttcaccccctagtggagggagacacacagtaaacatagaatacattaggcaatgagaactgtagagagaagcaagcatgaagaggaacatagaatactatgcagccataaaaaagaacaagatcatgtcctgtgcaggaacatggatggacctggaggtcattatccttagcaaactaaggcaggaacagaaatccaaataccgcctgttctcgtaagtgggagctaaatgatgagaacacatggacacagaaggcaacaatgaacactgggtcctacttgagggtggaggttgggaggagggagaggagcagaaaaaaataactattggttactaggcttagcactttggtgaggaaataatctgtacatgaaacccccatgacacaagtttacctatatagcaaaactgcacatgtacccctgaacctaaaagttttaaaaaaaaaaaacaaaaaagagtgaacagtactgaagtgagagtggcaggggtgcggttttcaattgcgtgctcaaggaaagctgcttgtctgggaaagcaatatttgaacacagcctgaaagaggcgagagagtgagccacgtggataactggaggtacagcaggccagacagaggcaacagcacatgcaaagtccctgaggcaggcacacgtgtggtgtactggaggaattgtaaggatgtgggatggatgaaataaagtgagaaggggagcagaagcagggggagcagatcacatccaactgtgcaggcgtagtaaagaacccagcgtttactcacaaggaatggtgagccgccaaggttttgagcagaagcgtgacatgacctgacttgcattttataggacctcccttgctagtgtctggaagagatcaaagtggatgagaacaaaagcaaggcagccattgaggagggtgggacagttacataggtggattgagccagactggtagcaatggagggatgagaaatggttagtatccgcaggggtttgaaagggctgactgatttgctgatggatggtgtgtgtggttcaagagaaagaaaagtcaaggaagggccaggcacagtggctcatgcctgtaatcccaacactctgggaggccaagacaggcggatcacctgtggtcaggtgtttgaaaccagcctggccaacatggtgaaatcccgtctctactaaaaatgcaaaaatttgctgggcatggtggtgggcacctgtaatcccaggtacttgggagcctgagacaagagaattgcctgaacccaggaggcagaggttgcagtgagccaagatcgtgccattgcactccagcctggacgacagagcgagactccatctcaaaaaaaaaaaaaaaaaatagctgggtgtggtggcatgtgcctgtaatcccagctacttgggaggctgaggcaggagaatcactggaacctaggaggcggaggttgcagtgagccaagactgtgccactgcactctagcctgggagacagagtgagactctgtctcaaaaaaaaaaaaagtcaaggaagatcaaatactcaaggctcctagtgatcatcaattagacatccgagttcttctgggaggtcctgtttgccagtggtcatcctgtcatttccatcagtgatgtctggaaggtttgataccaagaagttacctcctttcaaagtggcttcttcttccagctactaggtttgacctcctggaggccaggagtgcaaggtacaactattactcttccagaagaggctctccccaaccctcccacattgaagggttgacattgaagtgttgaagttttccttcagcctggtcattgctcaaaggtggtagaatatagatgtaggtcagtagtgatagcaggctacagccagccggtggtcaccacagggtagatatcacatagtggttgaaactgaaggcggctgaaacctgaattctaattaatttctttgtgaccatgggaagttatttcacctttccgttcttttttttaacttttaagttgaggagtacatgcacaggatgtgtaggtttgttacataggtaaacgtgtgtcaaggggagttgttgtagagattatctcatcacccacacattaagcctaatattcagtagttatttttcctgatcctctccctcctcccatcctccaccctcctggtgtgtgttgttcccctctatatgtccacgtgttctcatcatttagctcccactatgagtgggaacatgtggtatttggttttctgttcctgtgttagtttgctaaggataatggcctccagttctgtccatgtctctgcaaaggacatgatcttattcctttttatggctgcatagtattccgtggtgtatacataccagaatttgtttatccagtctatcgttgatgggcacttaggttgattccgtgcctttgctattgtgtttcaccttgttgaacatcagttttgtgagctataaaatgggggtaatccattctctacctcgtaggattgttcagagtatgataaaacactgtgtctggcacaggaatgtcaatgatcagctattgagtaagcaaagtgaattaatgatctttatatgccatgtgtcatgtaattctatcctctcacttccaggagatttggaaggcagccaggagtccctctttcctctctgttgcctggctgacctccttcctttaaaacccttctcctcttttttgtatcataatgaccttattttgaattatggtggtactttaaattttatgtccctgaagggttaagctctatgttggctttacctgaactctctcatcctcacccaccagcaagatgaaggtagggtggccactgacaggtgacgttcgtgaggtgcatggcttttctgaagataagcagtaattgaaggaggagaatcagatttaaagcctggggctgcaaggatatgagattcatcacaaatgatgatgatgatgatgatgataggaacattaggggaggagcaggagtagggggagactgggagacacaaaacatgtgttaccagactttgtcagtagcatttttcatggtttcacatttttaattctcacaatgaccctttcaggtagcttctatcattgtcccaggttccagttgaggaagctgaggctctatgaaatcagataacttgcccatggttacacagctactagtggtggtgcagaattgggaagccaagcagccttggctaaaaagcctgcagctgtgatctatgtcctcgctctggccctttctcctggctttcctgatctcaccgccgcccccttacccccactccccagcatgtccctcctcggccgtgggcaacccctccttctttggggacacacctctctcaccaagttgtgtttccccaaggcctttgagggtcacagtagtacatttctcactttgattatgaggggatacaccctcttaatctaagacaaaccaccaccaccattatactgaatttaaaccagtcaagaagttcaacccttccagctatggaagccaaggtatgttctcactttgtcttggtgcatttgatttctctgaagataccctcagatgctctaatttgagaaaatactagaaagtgtgcatttacaggtgaccatccctctgctctgttgtgacttttataaggtctagttgttcttgatatgcagactaatctgtaaggaagatgagcatgggggagagaagaaagacgcattattcactggaaaacagcatcgtgtattttagcaaggagagcgtgctggtgttgatctgatatcaccccaatacttaggaggaattgagttagagatacatttgtagcttgaagagttgcttatttgataagttatcggagtgtgtttcaaagacattatgcctatgtgaaagtaaagatggagttgtttatctctgtatctccttgtcctgtttctcccaggacttggcagaactcttgatggcaagaatctaatctttgtcctacttgtaactgcagtgcctggcagtttgccctgtccatattcatagagctaaagaaacatttgttataaatgaagaaatcccccagagagaaagctatagagaactgacctggaacaatttacttacctgctgggagacgctagtcttgccccagatgttcaatgcctgcactggtctatttgcaggtgcaggggaggcttctgctgtcctggggaaaaaatacccatgtcttcagccagccacaattcaattactctagaccagtgtatccgaagcttgagtgtacagcagaatccccaggaggatttgtttaagtactcattgctaggcgtactaccctggtttctaactcagttaggtatattaatttcctagggctgccataacaaatcactgtaatgttgatgtttaaagcaacagaaacttattctctagcttctggaagccagaagccaaaatcaaggtgttgccaaggcatgctccctttaaaggctccaggggaggatccttccttgcctcttccagctcctggtggctccagggattccatggcctcagctgcatcattttcatctctgcctttgtttttacgtggcctcctcctcttctctttctcaaatgtccctctgcctttctgttacaaagacatttgctattggatttaggaccttcctagataatccaggatggtctcatctcatcttgagattcttcattacatctgcaaagacacacccccacttattttccaaataagattcatgcacaggttccagggataaggacatagaggtatcttttagggagccaccattcaattcatggcagtagacctggaatatggggcctgagattatgcttttttgtacttctaacatgttcacagttgatgctaaaagttgctcagaggttggaatatgagagcttggactgctgctccaaagagagagaaaataatacaatgccttctttgaaatagcaccttttcagaagagttcttaaaatagattttatctcatgggattgatttattgtgcccattaagccagatgcatagctcttctactagaattaattttaaagttgctaacccttaattatttgcagagataggacaaaaaatgttggaagcaatttggaaatagtctttatgttcagtccataatggatgctatttacaacaatggctgtttcatattctcatataaatgatgaagctaacactcaaagccatagaccattcaaatgctttatatcctaaaaaggatacaaagaccatcagaccataaattgtgatttttcattgccatggcatgtttcaatagatggtttgtttctgtagaaagaacagttaattctggactcagatcctgaacatgctccttttttggctatgagaatttgggtcttagttttcttgtctaaacagtgtgggtgataatattttgtcctaataattagcaggcttattatgatgatcaattaagagtactttgtaaactgtcaagtgttttgaaatatgttacttctgtaatgacaaggttgaaaataaatataactggagctaattcatagaaatctgtgtactaaagatagatcttaagaaaaattttcgtccaaagtgtatttgcttactgcagccctttcagcttctcccatctgtcagatggcctttctcaaatgtgaccactatgtctctctcccatcccacatggtcttcttcagtgtgaccttgacgatctttcattgagatatggggactttgtctcatcctcttggatctcagtggatcaaggactcactcgtaaccagtagaatgatgtgtgacttctgagatgaggtcataaaaggccatgcagctttctccttgttcgctgggaatcttgcttttggagtccgtctgcttgaaagccaccatgttgtgaggaagcccaaactaaaccacgctagactctgggctccaggagagcacagactcctttgctttgtcctcaccattttaccccccgccgcatttagcacagtgcctcacacaagcaggcattcaaacagctgtgagagtgaagaaacaaaaggaggttgtacccaactcattctaatatgctctcaagtttaaatatgtgatgtaaataggacattataagaacaaacaccaaaaaaccacctatgtgttgcaaaagttaacattattaatcctctagaattgtatggtgcctaatggttacatctgttttcttaatcgttcccttataatgcctgtcttatagtactgccaagaattagaagggaaggagcatgctgaggcctagataattctgatgggtttttttttttcttttttggaaaggatttaacagatattagagaaaacttagagggagtcttgggactccttgatggccacgaaagggatgacttttaaagaaatcgatccagaaatgtctatgtggctgccctttctcttctcgttgtaaattttctcacagtgaacacaggtgttagagatcaagtgtttggctttctggtgctctgatgcaggaagtttgttttctcaggcaggcttctcagctcttgcacagtagcctatgggttgggacggctaccggatggcccaactccaggatggggtcatagtgcggagctctgtgagtggtgccccctagaggaaacttcctgaaggaatgaagcttcctgaactcatgcaatttggcaaccctgggttctccccaatgctttcaagacatagtaggttggagcaaaagtaattgcagtttttgccattgaaagtaatgtcagttacttttgcaccaacctaatacaaaccatcccatatctgtgttctccatcctttcatcctttatcacagtggggttgtgatagatccctgaaaacacaggatcaagtataggtaaatgcaagatggtacatagaatcaagtgtgaaagtgagtcccatcaacccacactctttccatttggcccagttgctgcccttgttgtttagaatggcacgtacctggccttgaaatgcactgaagcctatggggattactttaaaattcggtcctgtaagccagtctgttagtatcattgctcctactaatgatagaaattgctggtgttggccgggtgtggtggctcacaccagtaatccaagcactttggcagacggaggtgaagggatcacttgaggccaggagttcgagccagcctggccaacgtggtgaaaccccgtctgtgcttaaaaaatacaaaaaattggccaaatgcagtggctcacacctataatcccagcactttgggaagccgaggtgggtggatcacctgaggtcaggagttcaagaccagcctggccaatatggccaaagcccgtctctaccaaaaatacaaaaattggtgtggtggtgtgtgcgcctgtaatcccagctactttggggggctgaggcaggagaatcgcttgaacccaggaggcagaggttgcagtaagccgagatcacgccattgcactccagcctgagtgacagagtgagactccatctcaaaaaaaaaaaaagaaaaaagattatataaaaaattaaaaaattagccaggcgtggtaggcgtggtgggaagctgaggtgggagaatcgtttgaacctgggaggcagaggttgcagtgagctgagatcgcatcactgcactccagcctgggtaacagagcaagactccgtctcaaaataaaataaagtaaaataaaataaaaataatctgtggtttttcctcagcatgccctttatgaactgaattatacaaattatatactttaaacctcacaacaacctcatgaagtgtatataccagtaatattcccattttatggacaaaaaaaagagaaaaaaaatagaggcaccaagaggatcttacccaaggatgcgtgactggtaagtagcagagctagaatttgaacccaatctgttaaacagttccctcaacaaagaattatctcattttgtgcttgactctcaagcattcatgtaggtgaaaaacttctttagaattctctgagccaagaacctagctctttgtataaacattttttgtatgattttaatctgcactgaatatattcgtttcagtctcatattcatctggagacccctccagagcttgaggtcttgagaagtcctggggctccagtggccactaaagcaatgacttttcaaaagaaaagaaatgtttcctgagtgtagatgttgctatcttttttctttctcattgtatacttccttgtagagtacataggtgttagaggtcagatctggagggattttgtatccaggaggttaccttgaactttgatgctgtacactagcctagtattattattattgttgttattatcattactcctactattactcctcctcttgctgctgctgctaaagtagcaaaactgtctggctcccggagcgccacctattgaccatatagtttgccacctgtctcagttttgtgccatgcatgagctcatcctcaccaattattggcaagattatagaacaggacacagagtgattcaccttcagtatagctcccactagtgtgttgctcttatcccacaagaacgtgactatccaggattccttaaatccaccaggctctgagccagactgcatttaccaatccacagaaatagtgcagaccaattccttttgtgaaaattaacatatattttgtctatggccttctcttcatcacttgccccagcaagtctctcctcaaaggatagtcagtttggcatgatttatgtatgacgaacccaggtagactaccataactcactgttctcattgataaatcgttgataatatatgccttgtaagttggtgctgtttggatggcatgactaaagtcaagcattagcatagtgcccaacactcaggaatctggcagaaagtcaaaagttacaccgatcagtgtcattattagtatgcaatttcattcttagtcttcttgggatttaattgtattacctaatttatgtaatgagactatattttcttttctgtcccatttctattaaacttagatacgtccccttctccttgcttatggaatcaaatttttaaattaatttgatttgggttctattttctaatcccatcaataaccagctacaatctgcccttcaggaggacgctgcttcttaaagcatgtctgagctcccctagccaccctgatttataatgtgatatttaacaccctcagctgcttctgaagcccaaggggcaaactggttacctagcaaccacatacacacactagctcatggcgcaggttagccccattttgttataatgaaataatacgtcttgtgagaatgaaaagctaaggtacactatatgaggttagtgttttggagaaaaatgggctctttaggacagattagcaaagcaggagttgtgtgggtcaccccctgcttcacagtgactcaccacttcctagaatggaagtcacgaccttgaaatcctgagacttggaggaaatagaggatatgtttgatgtactgaactgtctttaaaaataatgtaaatttagcactttgggaggccgaggcgggtggatcacgaggtcaggagatcgagagcatcctggctaacacggtgaaaccccatctctactaaaaacacaaaaaattagccaggtgtggtcgcgcgcgcctgtagtcccagccactcaggaggctgagacaggagagtggcgtgaacctgggaggcagagcttgcagtgacccgagatggcacaattgcagtccactctgggcgacagagcgagactccgtctcaaaaataataataataataataataatgtaaatgtagaaacctttgggggagtgagcagtccccagtggaagtataatttccaggctatctcacacaagcctgcttggccccaggacatcctgttgtgatggagaacatcataaagctcctccaccaacatggaatccatagagaatattcttacctagatacaaaaagttcagtattctatcatgactttaatataagggaaaaataaaaggaaggtgatttacaataaaagaatgcacacttgaaatgttcgggcatgactacacaagaagatataatgacacagccaaatgtttgcacctatgtgtaataaatcaacttgaatttaggagaagtaagatgattcagaaatgcatttctttttttccagtgtctcttctacagaatattttctgaatcataatcattgcagattaaaaatcccacaaaaaatgttcatacaaggagtcaggctcttggctcagaaaattctgaagaagtttctcgcctccatgaatgcttaaagagtcaaatacaaaatgagataatcctttgttgggggaactgttcacgtttcagaacttttggcatcctttgctccacctgcagagagccaacaaaatccttcactaattttaggaaccaaaaaacaaatttccccacttctcagtacagccttcaatactggtctgtcatttctgcctgaccttgtttcttctcccaacacatctatccatttgttgattcattcactggttatgcttataacgttgtcattatatccttgtctcagttttcttatcagtaagggtaagcagcttcgcagaattttaggaaggattaagtgatgcgtgcaaaatacttagagcccacaagaagaacttgattaatgttgttcttattattgctgtattgaatgtatcctttagtactttctttttgtatagtaccatatggcatagatgtgtgtgcacacaccccctcacacacaaatacacacaccaaatatttcaaaggaatatatagtgaaaattcctcctatgtgcctaaatcttcctcggtacccttccccagaacagccactgtgtcttcccagaaattgtgttaagaaacaaacatgtatatccttttgtgctgtgttttgtagaagtggaagctttctgtgcagccagttttgcattgtgttcctcaccaacaggatctgtcggacgccgtgtatatagttcttcctcattctctttaatggctatgtgatgttgcattttatggatgaaccataatcctcaaaaacattcgttaggttgtgttgataacatagaaatgtctaaagcagtgaacaaagtagcccattatctcaggacccagataaccaagttaacatttttttagcaaaataaaagtagaagatgcagatgataaaagtaaaagcaggtcagtaacagtacagtaagaaaagtagaaatctcctgtcattttctgaagtcccaatccctctagctctcaaaaaaaaaaaaaatcttaacaattctatgtgcattctttcaggaaaaaagcaagatagaatatggatatactagctgtgtaagtagctgtgtaagtagctttgtaggctgaaaaaagcttatcccccatccccctggaagatgtgcaagtactaattcctggggcctgtgaatgttagcttagattgcaaaagggactgtgaaggtgtgattgagttaaggatcttgatttaaagaagttagtctgatacgcccaatgtaaccacaagggtccttataagaggctcaccagtggtcagagaggaaaggtgatgttgtcctgctggctttgaagttggaggaagaggccatgtgccaagagatgccagcagcacctagaagcaggaaaaggtaagggaacctcatgtcactagaaggaatgtagccctttggattcattttagactcccgacctccagaactgtcagagaatacatttgtgttgttttaagccaccaaatctgtgataatctgttacagccgtaggaaggtaatattttagcgaatatttttatttgcataagtaccacactctgtatgtgcactgagttgttctttactaatagtgccatgttatctaatttttcacaggcatattcctttctcccaaattaggtttacaagcaccttggaggcagaggctgtggttggtatcacgttgcattcctcccggctcttctctcagcaggaggaaatatagctgcttagttaaaaataaaaaaggattctgaaggcacacagttcaaagttagaacaggcagccaatgcgtttgatgtccttgagccacatgccctcagcccacctggatctcggctgcagctgcattgggcactcccaccttcttccagcagcttctccccgcttttccaggaccaagaaaattctttgccagcacatagtagccccaaatcaaggaagctaatgtcctcagaggtgacctccagccagtggggacaggggtcagtggatcaatgcccaggcccctgtctatgaaagggcaattctgagatgtgctctctgcaggtccccagtaggactgagctgcggtagcgcccggtggtaaccagcttagccacacagctgtaagaaatagttttctccttccttatctccctcttctgccttctcctacctgcttcctgaatctcccaccatcctcaaaagcacgcctacactcaagtctttgtctcaggctcagcctggaggagcccaagttagaatggaaccccagctctctttctttccccccccgcctctctctctgtctctctcccctttctctttttctctctctctctttctttctttcagtggagtcttgcttcatcgcccaggctggagtgcaatggcacaatcttgtctcactgcaacctctgcctcctgggttccagcgattctcctgccttagcctcccaagtagttgggactacaggcgcacatgccaccacggccagctaatttttgtatttttagtagagatggggtttcaccatattggtcaagctggtcttgaactcctgacctcaggtgatccacccgcctcaacctcccaaagtgctgggattacaggtgtgagctaccacacccagccagctctgcctctttctagctgaggattctgtaacaagccagtcttctaaaactgaattttttttgtctatcaatgaagatagcagaatctacctcaatagagtattgtacagtttgaaagagataatgtatacaaagtatcttatacattgtccatagctactattgttaaaattagtttatgactattacatcatagtaattgctttctaaaaagtaacttaatgaaacacatacatcaaatgcctgatgaaagctgaattttctaaaattggtcttggccttcaaaagatttctcattccttctaccatgtatattcaacagataattttgagcgcctactgtgtgccaggcagccctctgggagcaggaagactgcagtgagcaaagcaaacaaaactcccattttcctatgtcagatgcaagtggactcattcagcacatgctatttgcatcctggaggtatcaaggcaaagaaaacacagtttttgcctccagaggcataatcttacctcctgcccgtttatttgaaatacacacagttgaaatattgttgtaggtttatcgattttctatatgtttattaggctcctgctatatgccaagtactgtggttagcaccatcctcatataaacattatcatcttagcccctgaacttaaggaaatgtccaggctgctaaagcagatctgtgaaaaagctcagcctgctttttttcagctagactactatgactctagctcagaaaaaaaattatttctaatcactggttctaatacaaataaaatgtagtgattcattaatctccttagcctataattgcaaattgagttttctttcaaatatacctaaagaaggtaggtgcccactaaacatttcaggggagttttatttaagctgcaaataaaattagtttactcatttttaatttaattcccaggaggcattttggaaaccttccctcctcatttgacccaaaatcatttttaaaaattattgttctcctaaattgaagccctttccagcattgcgcattagaagtcttaaaactcatctgttttctttttgtaattgacttacaaatgcgtaatcgactcacaaatgtataactgagtatgcatggcattttaaaagggcagagtttccatttgcttcttgatttctttgggggttctcattttcctaagccctcttcccacaacattcccagtcattccttgggtcatctctcaggtgtcaccaccctgctagcatcttaatggagcggctgtgtctcctcccagcagcagtggcaccagaagatttagctgtgttggggacaacgttcagaatcctcatttgctgctaaagatgtacccggtctcattctcctgacacatggatgatgatcttgtgacccgtgtgactatgactgtatcactctgatcatcactagaacaataagtaatctaaataataagaaattctgcatgttccattgacaaaactgggaacactgcacacacatacacatattcacacaaaccatatacagtcacgtgtcactcaacaatgggtataccttctgagaaggtatcattagatgatttgtcattgtgcaaacatcatatagtgcacttacgcaaatctagatggtatattctgctacatgcctatcctgtatgacattgcctcttgcgcctaggctacaaacctgtacggctgttactctattgaatactgtaaacaattataacacaacagtaaatatgtgtgtatctaaacatagaaaagataccataaaaatacagtataaaatatttaaaatggtatccctgtataggaaagctcgattataatctaatgagacaactttcctatatgtggcccatcattgactgatatattgttatccagcaatgactgtacttaagtaactttaatagaagcatgaagaatgtagtagttgtcatttgaaaagggccttgctaaatgtaaccttcagttaaagcaagtcagcctagtggaggatggtggctgctcatgttgtcttatgtggatataaacctatatatccccactaagtgtgaaaagatgtcatgcaccaggaagcatgcaggagacttggtaaggagacagagggatgcagagactaagcccaaggctgggagcacaaggcttccttccttggtccaggtgtttctgcatgggaacagaagattggtgtctgcttttcagtgacgtggctgaatcagagtgagtgagtgggtggtttattgttggtttccacagatgctgatgctgaggcaagaaatcaagtcaaaattggtttattttgggaggtacaggaaacaccagtagaaaagtgaggaaataagacaggggagggaaggcagccaataacgtaaccagccagctgctttcatgagagactggagcatcgtcccaccaggaaacaataaaaaatagtgtaaaaacgcataagcttcagagaaagatatgggagctggggagtggatatgccaatcccattcttgactgattgaaggctgctgctagggacattaatcccccagcactcctgggctaccatgtgccaagcagagctgcctgctgtgcctttggggaaagccctcatgcagcgacacggggcaatggtagttgtctgccttgtgaaggagtaagacccggggctatgactagggtatcagcagagcctgctccaagaatggttaagggtttggtttgggacatgtagagttcaagcaacctgggaggcacctaggtgatgtgactcagacctctgtcaatactggctggagtttcaccatcaatattgatctgttgagtaatctacccattgtatgtgctttatagtgactgaattaccaacatgcatctgcctagcctatttccctcttcaaaatggcatctcccacacatgaaacttcctccttgattatatcaaacaggaccaataaatcattcagcttttccccagaagtgggatgttgagtggtacaatccatgatgtgccatttctcaacaaggcagatgatatttgattcttgggatatcagtaagtctgggttatttaactggctttttttctaaatcctgacttgtgtccagttgcttaaccagatttagaagaagccatgtttacatggaatttctgaattacaagctgagaaatgtttccagaagatattttaaagcctccttaagaaggctagtgggccttatttcctgtgtgaaacaacttttatcaaaatgtatttgacactgggagtgtgggtgaactggtgaaaaggtccctgagagttcgggtccctgagagttgcaagcacaaatcctgttaacaggtaataagattatgagcatagcccatgtagagcgcatggttttatcagctgaagtgaagcaccaagatgccaagttgttaatggaattcagcatctgtgtctttcatgggtctctaaatagacaaggttcaatgctacccaaatttcctgcagaatcaaaaccacgttcgcctttggaatgggtatttatttattgcttttactctggggaaaaaggcttttttactttataacctttttatctcttatacagcaatttccttccatcttctaaaaatgttagaaaataaagcaaatatgaaaattcatgttgcatttctaagcatctgaccacaatctatagatcaagataatgccagactctaatttcagtgtttagcaaggttactggcaaatagcatttgagaaaagagaaaaaatagtatattgaaggcaatacccaccccctatattttgtattaccatcttttgtaagctctggtcatgcaatgctatcataggatatttttccttccttcttttatgtctttttgggtcattttaaatataccccatttatatatgctactcatagaaattagttctttattctccattgaacttttctgaaaagtattataaagaaggttcaatttaattatgttcaagtaactgagtcgttggcaatcagctgccaacattttgattgttttcttgtgggattcagtcctagtattgagtgcccactaacaactgccaaatttagtcatccaaatcaccacgacaataagctccaggtattgaaacatcaagactgaagccaccacttacgatccaatcaacctttttaactgtcagtgcttccagtctttgccgaaatacacagcattaaaattcataagtcaacccatgtccgtgcgtgctttttctctcccatatccagttggtcacttgcttcatgctgatccatccatagcggtcgtggtccacactccagccctcctttacatcctccagacagatagggttctttctatggcttaaaggtgccaacctcattcctgtctcagggacctcacacaattgctcctttagcctgaaacaatcacccactaatctctgcatagctgagaccaccttgttattcaggtcttacctgaaatgtagcttcctcagagaggtcttgtctggttaccccactgaaattagcatccccctttactgtgttccattaaacctcccacttttctttcttttgaagcatttaccatcatccacaagcatccaatgtatatcaccgttgtgtggtttattgttggcttcttcattgctagaccaagagctccatgaaagcatgggccttgtctctcttgttctcagtgaaatcatatgtgctcaatatgggggttagcacatagtcaatgaatattcaaattcattcatttaaatatttaaatatttaaaaaataaatattgagatacactaccattcatttggcacacagcacatgctacttttaattgtgatggctcaaataacctatgatactgcaaagaccatttttatgcccttataggtcatgtagtaccttttgttctctgatatgtccctagtacacattacagtgtttcacacagagtaggcacttaaacataccagctagtggatagtgtgatgatgccaggaagtaatatacaagggtaggaaactaacaagtatggagcatctcatatgtgtactggcatctgacttctcatttagtcctcataacaagtttataaggtagatagtaacatcccacattacagaggaaaaacacgagcttgtaattgcatgataagcgcataaggagcaaatctggaatccaagcctgtgttctctgcagggtgccattgtgctactgacagtgtgctaagtttaggttctctgtggatgtttgtgaaggaggcacagggaggcaaggagagccacaagctcatggctctatggctggaacttcataccattaatgaccacttaagaacgtgctgaatgcacctatgcatgtggaatcatgtacttccttttcacattgtaaatgtgtctacaaaggccaggcatggtagctcactcctgtaatcccagcactttgggaggccaaggctgatggatcacttgaggtcaggagttcgagaccagcttggccaacacggtgaaaccccatctctactaaaaatacaaaaattagtcaggcatggtggcagacgtctgcaggctcagctacttgggatgctgaggcaggagaatcgcttgaacctaggaggcagaggttgcaatgagccaagttcacagcaatgcactccagcctgggtgactgagttagactaggtctcaaaaaataaaaataaaaatgaataaataaataaatgtgtctacaaacagaggtttttgagagtcaggcataagcccccaccttagtgatactgatgcagccacctcgaaatgggaggtgggtcacccatctttatttgtggtccccgaagaaagaagatctcagcggggagaaggtggggtggggcacatcaactccttgcaggtagacactctgacaagaatgtatgcactactcaaaatgtttcttacccatggttcctaatacggtgaagtcatgagcccccttaagacccagtgaaagtggaacaattccacgtgcacataagccatgcatttacgatttcaggacatctttgaacccagggcaagaactgcagctttgggaaattcccagaacagtaaacagtgtaaattctcaaaagggggtttatttcatgttacttccttttttaaagaaatgtaactgtgttgtattaccattagacgtaattgggtgagaaattacttataaacctgtcatcataacatagctattgttttctttgtccaatatattgacattttattccactgtgcacgtagagttctgcatttggctgtttttacttaatacatcatagcatcaaacagtggtaatgccatttcacagtctgtatttaattggaagtgttttagtataatgttattgtaatactcaaatgcaaaggcacggtgatgcagtgaagattggtttctgttttgtctaaaattattgtagaacccattaaattttgtaatgcacattctcttccatctacaggtctcccataaaatagcttcaaatctcacaatcaatgatattttaaagcagcacataagagtatttagctttaatgtgatcattgcctcaggctgtaataaaaacagaatttttccccaattattatcagtcactcctcctccatagtccatcatgataaaaccgagcgactttcattcctcaccaggcaactaatcatccctttgctgagcattcttcataaatggaatggaataaatttcattatgcaatgcggtaatgttccccaactagagatcggggtgtagcaatcttggggaaagttacagtcaagattattaaaatatatgaaacttaaagagaaatagtgtcctaatcatgcagcccataataggctgtgccaaccccacttatcctcaaaacagccctcccttaccttgccggcctcatctaaatgctgctgtctgcagtgcacggtggctcatgcctgtaatctcagcactttgggaggctgaggcgagaggatcacctgaggttgggagttcgagtccagcctggccaacatggtaaaaccccgtctctactaaaactacaaaaaaaatttgctaggtgtggtgggcacacacctgtaatctcagctactagggaggccaaggcagaaaaattgcttgaacctgggaggtgcaggttgcagtaagctgagatcactcaccactgtactccagcctgggcaatagagcgagactccatctcaaaaaaaacaaaaatactcttctctcttgttgtcctttgtaaacttctgaaaattagacaatacttgattcttttacttccctaacaagtacctgcttaccaacctgctatagttttatagaagtactctctgaaaaggtaccaaaaatattctcattcctacatccaatagctgtttttcttatttggttggaattttccatatgaatcaacatgctcaaccattttcttgaggatctttttgtcgtagcagttgttgtttaaaaaacaactttattaatacataattcatatactgtataattcacccatttaaaatgtgcaatttaatcttttaaagtatattcacagggtgatgcaaccaccaccacagtctgattttatatttttagaggaaacaaatatatatgtttatatttaaattttattttattgtgataaggacacttacctgagaccttaatagattttaagtgtacagtagtattgactctaggtacagcattgtatggcagattgctagaaccccttcatcttgtttaattgaaactttatgcctgttgattagtatctctcaagttttccctccccctagaccctgacagacaccaattcagtctttggtttgggttatatgactattttgagtacttcatgtaagtggaaccatgcagtattagtctttctgagactggtttatttcacgtcacataatgtcttcaagattcatccatgttgttgcatattgcagaatatccttcacttgtgaggttgaatcatattttattctatgtatgtgtcatatttatccactcatccatcactgaacatttaggttgtttgtacctcttgtgtattgtgaatagtgctgcagtgaacgtggtagctctccagtaatatcttcaaactatctcttgaagatcctgatttcaatatttttggacaaatacccagaagtgggttgctgggtcatatggtagaaaagttggttttttgaaaagataagcaaaattgacaaacccttagctagactaaggggaaaaaagagagaagattcaaataaataaaattagaaatgaaagagggaacattaccacttataccacagaaataaaaaggttcataagagacccctatgaacagttccctgccaaaaaaaatgaaaaaaaaacctaggtaacctagagaaaaatgagtaaattcctaaaaacatacaacctaccaagattaaatcgtgaagaaatagaaagtccgaacggacccataactcatagggagattgaatcggtaaccacaaattctcaacaaagtaaagcttaagaccagatgtttggcccaccaaacatttaaagaattgatgagaatccttctcaaactcttccgaacagctggagagggagtgacacttccaaactcattttataaagctagtattaccctgacaccaaagccagacaaacaccacaagaaaagaaaacaaaagaccaatatccctgataaatgtagaagcaaaagtccttaacaaaatactagcaaactgaatccagcagcacattaagaggatcacaggtcatgatcaagtgtgcatgggagtcaggaattgttcaacacacagaaatcaatcaatgtgatacaccacattagcagactagaaaataaaaaccacatgattgtctcagatgcagaaaaagtacttgacaaaattcagtgccctttcatgataaaaactctcaaaactaggaatagaaggaaagtacctcaacataataaaggccacatatgaaaagtccatagctaacgtcatactcaacagtgataaaactaaaagcttaccttctaagatcagaaacaagatagggatactcactgtcaccagttctattcaacatagtcctggaagtcctcacaggagcaagtaggcaagaaatagaaacaaaagggatccaaaacaggaagaagtaaaatgtcccggtttgtagacaaaatgatctcacatatagaaaataactgaagaacccattaaaaactattagaattaataaatgaatttagtaaatttgtgggatacaaaatcaacaaacaaaaattagttatgtttctatacactaacactaactgatctaaaaaggaaatcaagaaaacaatccctttacaatagtaccaaaaagaataaaatacacagtcataaacttaactaagacagtgaaagacatgtattctgaaaactacaaaacattgacgaagggaattttaaaagacacaaacagatagagatcttgtatagatggattggaagacttactattgttaaaacatccacattacccaaaattatctacagatttaatgcaatcagaatttcagtggcattttttacagaaataggaaactcagtggagcttcttccttctttttgactctcatgaccctgtcctcagcagattcacctgtgactatatctgtttctctttctgggtcttatctcttcttgtgcctctcatgtttaagtatctcccaatattcagttaataacattttctgttttctgtaggtagaaactgccatgcccacaggtcgagctatgacatgcatactgatgcctcccagaagtaccacttcaatctctgacctccctcctgagcatccagatttgaatttgcatctttctgtgagcatctccaagtagatgtccttcaggcactattcataggttgaaaagagtgcagagcagaaagatgaataaaagcacaaatgctggggtcaaatctctgagattcaaatcctggctctgccactaaatagctatatgtctttaagccacctaattaacctctctgtgcctaaggattctcatcagtaagatggggataaaaatacttgccttataaaattattgaaatggttatgctaaaaaaaatgtgcaaagtctttagaacagtgcccggcacatgttaagtactgtttagctatcagccataattttaaaaatagtgtttttaaaatcagtaatattattgacaaccttttctgaatattgtccaagtgctttacagggattatttcacttatcatgggaatgatcctatgagatagccactgttattattcctactttacagatgaggaaaagagaggttaattagcccaaggacacacagtttccccaagatcaaagagtcagtggtggggccataatttaaaccagggcagtctgacttcagatccacacttttgacctgggcttccctgctcaattacaaataccaaattgactccttatcttctccccagaacagcctccctttccggttttctcccctttccccaagattaccattacagcccctttctttttcacctgtgaattagcaaatgctgcacccagaatctttcctccacctctaccccattctcttcttgctgccctgactagttgaactgtcctctttatcttaacctgtcgtgacaccacctccctggtcaccgtgctcttgccttcttgccttcttgcctttccaatttatcctgctcactgacacctcagttgccatttggaaacgaaaatagaattttcagcttgataacattaaggcagagatgttgcagcaaacaaacacttcagcaggcaagacaaatatgtttcagatattttttagcagctagagaaactccaaagcaacagccagtgatttagaacagaggctcctcttacgaagcagacaggctgtagagatagaattcaaggctcagcagacatgtatctcctgttatataagcaatcagaattctcttttccaattgaacaaatccctctctgctttgatggggaaactgggatgtcagtttccctaaaatgaaaattctatttcacagcaaaatggttccagtcaactggagagagagagaaagagaaatcataactgttttcccctccccagcctagcatcctccccacccccttaacatggaaaactcctatacatcctttaaagcccagggaaaatgtgtcttttctgttgaagccctttgtcaactcttccagacactttctcctttttaatcatgcagtagaacatggcagttaggaaaatgggctctttggaaaatattcagtgttcaaatgctgattttgctattcattagctacatggctgtcagcaagttgcctcgtcttactgtgctacacttttcctcatttgaaaaatggagggcggtctcacctctctttttatatgtgattatttggaggattaaaagggaaaaattatgaaaagcatttagctcagcagctggcacttgtcagtacccagtaactgttaccagctgaattttatagccataaaataaatacaagcatcctagaaaattataatacccataggaagcatgagattttttttccaaattaagaaaaaagatatagtagtcttggagtagtttctcttcctcttaaaggaaaaataaaatgtcagactttcttacattctcataggtcagtaggttgttcctatagctatggggacaatatagtgagggtatgaggcagacttcaagttacaagttagggtttgatccgatgtcttggacatttgcttggatctgtacaaaccaggattctgtccaagaactcctttgatgaggaagtgttgctagaacttggcctatgagctctgcctgctgggaattagttttagcaaagagagagagagagagacagagaatatcatggtgatgagtgctaggacattgtcaaggctcttttaagtgtgaccaccaggggacagcaggaaagacaggagaagacctagagttcaacttggagtactgaaagccttccctttccttcttttctctctgtgaaggttgttttccttctttggggagttgcaggcccatttggtaaatgaagtgtcatatggagaattttcagcagatgcttctcttctgatagggaatggcaaagccccctaaattcatgaaacatatgcaggtgccagccaactttgcactgccttcatgacacctcatctgttttctcaaacagccaagcagcactctgtgcccttagtgaagtaagggggaataggggccaaaagggcagcgtgaagacctaactgttgtcctccctgacagctgtcgttttgtgatgctgctgcttgcttttcatgaaatctgtgaccagctccatccctatcgtgccccctgcctctgtaaccagatttttgagtctacatataggtttactgagatgacatttacttattcattgattctgtctttggaagatgcctcttccacccatacaaggtatgctgaataattggtactcagaagtgtaattagccacacatataagacatcagaactactatatgggaggcccaatgactgatcatgaatatacacagtgagagaaatgtcagtcttgtgtgaattatcttatttaaacccctcagccaccaataagttaccttctacttttacatccttagatcaggagtaagattccaagttctataatgatagccaaccaagacattacagaacaattgccatgctctaccagtagtaatacctgacatttattgagccaataatatctagaccatggctgtagcatatttcctacatagaggggaatttactcaacaccattcttgatcagctgcccaaaccccgcagtattatataaagtgacttccctgacaagttgccccaaggcattcccataagtgtactggcattgtggttatatactatgaaatatatattataaaatgcatttttctctgctcatgttttccagcaggtttaggagtcacctaaaattattgaacatcttgcttccaaacaaaataaactgtattacacattcagctctacataataacaggaatttcttttctctgaatcgtccaatctttttttttttttaaaaaaaagttttgtatgtatgtgtgttctgaatactatatgcatagattttagcttgagagaactgattaactcacattgcatcttgggaggcagattagctaggcatcagttttaaagaattagatttaaatagagggcaaagaatttcccagaaaagatgagcagaataaaaaatataaaagagaaattctcaagatcaggacatagagctaggttccatagatgctacaaattgaaatgaaccttgatcctactctcaaggaactaaatcgagctgtcacaatctctatgaagcaattgtagaggtaattaaaaatatgactgaggtagtcacaattgagagcatcaactaaggtcagtgaaaattggagcaggaggtctggctagacacaaatttgggagattcgaagcagttgaattctcaagcagcgttcagacacagagattaatgctggtcaaaggaaaaattgttcagtaccaaggacagctccctagaaagcttttattcccatagatctctgggcagagaccacaggagtattttggtagctgtgctctctctcgtaatagttcattgcacaagcattctcatgtgataatgtgtgcacatgacagcatcttttacgtaccgattaaattaccagtggtaccattatcattgtattacggttctgcagagggacagagctaataggatatgtgtatatataaaaggatatttatcagagataattcacccacgtgattacaaggtaaagtcccactataggccatctgcaagctggggaacagagaagtccatagtggctcagtccgaatccgagagccccaaaactagggaaaccaacaatgcaaccttcagtctgtggccaaaggcccgagagctcctggcaagtcactggtgaaagtcccagagtccaaaggctgaagaatgtgaagtctgatgttcaagggcaagaggaacaggaggaagcatctagcaggggaaaaagaagtaagacggaagacccagcaagcaaggttatcacaccttcttctgcctgctttgttctagccatgccgacagccagctggatggtgtccacccacaatgagggtgggtctttctctccctgtccacagtaaaagctgtgtaagtggataagattaataagggataatgtgaagggagatgagaacaagggctacatctagaacctaggaggaacactcatattccagtactggaggagaaagtggcataagtctagaacccttccagagaaggagaaaactctcaggaaagtataggattagtgaggtgaagagaagaataaatatccagaagagggttaattgtttaagctatattaagctgcaaataaatgaattccagtactagattaaacaataaataaatgtaattaattcatataaagtgattgaaggtaggcagttaagagtgtttcagcagtgtttcagcagctcatcataatattatgaatcttagctctctacatctttccaattaattatcctctgcatgttgacttcttgtccctgtgtttattgcctgatggttgcaagacggctgatgcaactctagacacatcaagatcatgttgaaatgaaatgagatgagagtgggcaatggagagaagattcatgatcttttcttccatcaggaaagaaaatcctttccagaagttcctatagacttcttatgatttttaattattcaggaccagattacatggccacccctactgttgaggagactaatgaagtatttggcttttccaggctttgttgttagcgtccagtaaggatgcaattggaaatggactttgtggtgaacagccaacaagattggccacagtggaattaacgacatcagtgttctttcagacattgaaatgctttttccataattagttcttttgaataagctgataaaatagtcaagattacccaaagcaccttctcatgaaagcaggaaacaaagttttggcaatccttagccatgatattttggttgctaaaattgatggcatttcttactttttaaaaaactgtcatatgaacaagtgtttagttcatctttttctcatatgaaagttaagttctgacttattcatgttggtctcagtttttaagaatcaatcatacagaaaagttggtagattttgtggatttatagtagaactacttagctaaaaatttgtttatcatttgaaggccatgttcccctttaattagatattctagaacctctggatttttccataatactatttttcgtaagttgtactgtataaaaataattcgttttgaagatgttgtatcattgaactaaaaatcatattaatactcatccaaagaattacacagtcattctctttaataggggaacttaagaaccagaactgtttcctatgatgtttaggagacattcagtgaattttgatcatgatgaactagaacatccaattctaagttggacactggtctcagaaagaatgctggctgcagaggtctttgagataatgaatcatctggtttcttatagtattaatgcttataattagagacagaaaagagtttaatttcttgcacgaattaattaatacttacgataaatgtcttgaaagctctttctggtgtctggttcaaaaattgcagttcttgaggtctgttaattccttctaaaatggaaaagctggtaaaggttgtgacactgctgctaaagtgatctgtgaattagaggacgtttgacttctcctctgacctctaagctcatgtggccatttgcttgcatgacctctcattgagattacccaaagttgccccaactttaaaaggaagataataacagtactttcctcatgagcctgttttgataattacataagatgcttagaaaagtgcctgggacacaatgaacactcagaaatgttgggtaggaacaatggttatgatgatcatgataaaggaggaggaggagaatttggcaattatttcctgagtacccactatatgtaaaacactatgccaaatactaggaatacaaaggtaaattagacatgcaagatttacgttccagaaagcttcatttttgtgttctctaattctgtacatgtctttcttccatttataatgtagatttacatgtaacagcaaactcactggaaatgtgtttccccccattttctgctatattgaccctgtatgtagaaataaccagggtcccacaaaaatctgttttgttttctttattgatgagcacagtttaagaattgtgtaagtcctcagtagcctctaaagtatttcaggcattttcaacatgacatgtcaacactcacccaagagaccatcttttaactaagtcgttattgaaagttctcattttgttcacttcttcagaaaattcaaagaagaaaaaaagcctaaagccactcactcgttgctctttcaatggcatcaccattgtgtgatctgtcttcttctgctagaaggaaattccaggaatccttgatctcgcatcttttaaactgatttcacagagggtatccctgacagcatttaaaaaaaaaaagcaagcaagaaaaacctcaaatgggtagaatttttctaaaagtctgaaataaaagtttataactgattttcaggtttcctattattacctaggcacacctaaatgaatacttgaagaatggggttgtaaatactcccagaggcaactgcagcaatcatgatcatatgtctgttgcagtggaattctttagtataaattattgtatattaaaccctaataaatatgtaggatcaaaacatgtgtttctggttgtggggactgcaagatgtgcaagtccccttgtccctgttctggtggcccttgagcattcctgccaatctttggaacttcagagaatgccagagttgtggggaaagataattcttactttctacccccatttccctccgtcctatggcagtctgggacgtggctgtacactataactaaactttaagacatctacaagtaagaaacgtgaataagaacttcacctgggaaaccagtctagaagagggaaatccaacatggactgaacagtctagaagagggaaatccaacacgtactgaacagtctagaagagggaaatccaacagggactgaaaagtctagaagagggaaatccaaaacgtactgaacagtctagaagagggaaatccaacatggactgaaaagtctagaagagggaaatctaacacgtactgaacagtctagaagggggaaatccaatgtggactgaacagtctagaagaggaaaatccaacatggactggacagtctagaagaggaaaatccaacatggactggacagtctagaagagggaaatccagcatggactgctgtgcaccagcctacatcatagtcacgtggttagcattggttgcatatctgcagtagcctagagtttaatcacacaagcagccttggagctttagttaatttcagttgttcaaactagttggatttatgaaggccttgccatgcccttcatcccccacttttgaagcctctcttgattattttttttaagctgctgtggtaagaggtaattctggatggaatattagttagactgaggcaaactaatataaataatattggactattaattttggaagggtcactaagccccctcaaaaataaaaaggaagaaattacacattttcataaatggttttgcaagaatgaaaaagtaatctttagtcctagacaaatgctcttggaacattattgtataatttctggttcttttctctctcgactgtagttatttcacacacattacagatgaagccactgtatcagtcagagaccaattttaatcccaaggttgattagacaggtagctcttcgcagcttgtgcactctccctttgttctacagccctacactcacacagacaaagatttacacacaagtaaggatttggcctgattcgttagtggaacatcctgatgaacacttggttgcatttaaccttttgctgcaacaaaaagtcccaaggttgccatagtaatgggaaattaaatccacagagctattccttttcccttagtggttctggcatgctatcacaccatagcatgcttacaacctcggtcaagaaagagctgtgatcccaccgtttgtccatcgagttctaagctatggtatttgtaaaaggtcattctgctctcccgacattaacctgaatggaacagctggaacgtaaattggaaggaggagtgatgattctccctttggccatttgatgacttgggaattaaatgggacccaatatgtcatctaacgttagttccagccagtgtttcagccacaggacatctcggaaaggtggtcatttggctcttgcctgaagcaatcgaggaaggagagcccagttctggaattagacaattattgttcttacccttgaaccagccacttacctgctgcgttcccactcttggccaggggccaattaatgaatgaaacaagctccctgcactcaggaggctcacagagaagatgatccagtttatgctaccgcatctccaccataactccccttttagctcattaactccctcaaaaatatccttctgctaattcctctcccttcccctctcttccactgttgcctttggagctttcactttatcctaaacttctttatgtctttagtcatctcctagaacacacatttcctcacctttagagaaacttgactctttcttcaactaatctgcagtgttcaaatatgaatacctttctgtctttccttctttctttctctttttctttcttcctttgtctctttcttcttcctcctttacttcctttctttttttctttctcccttccttccatttattcattcaacaattatttataagggacttaatatgtgcccagcactgttctaggcactacagatacagcattgaaccaccccaattaagcttgcattctactggggagaatgaaaataaaattaaaattaaaatgagatatatagtaaattaaattagaaatgcagtagggtttctttttaagtggaggtggtcctttctcctatcctcccaacttcttaactccaatgtttcaaagctaggaggagaaatcagtattcccagggaccctttggaagaacctttcttctttcaccctctttcatccattccttctctgaagctcatgccatctgattaatcacactatgttcactcctcccagcctctgggtttccaccctaatgcattgagattctagggctctggattctggttcagttttcctgtctcctttcagcatttgagtgatttctgcatccgatttgaagggtcagtttcttggttttcattattccaataatgtttctctccccctcatttgagaagccaactcataagactaaactctagtccttgctaatatgccaactactctaattccaatatttcccaccataaatctcctcctggaccataaccttttgtttctcccaattttctctctcatggaaacaactcccatggaaacaatcacacacacacacacacacacacacacacacacactcatgtggttacctttttgccagttttccagcctcctggactgaacagtctagaagagggatccaacatggactggaagaggggaatccaacatggactgctgtgcaccagcctacatcatagtctgcctacatggtgcttggcatgtagatagaatgagagatgctgaatgatagtcctcattctccctaagcccttagtgattatgagcccctcccacttgtcctaccaaacttaaacttcttattaacatgacccatctcttttctcctctcttgctgttaaggtgtgtggtgatcacagtaatggccccccaaatatgactttgtcctaattctcagaatctataaatatgtttctttcttttttttttttttttttttttttttttttttgaagacggagtctcgcttgctctgtcgcccaggctagagtgcagtggcgtgatctcggctcactgcaagctccgcctcccaggttcacgccattctcctgccttagcctcccaggtagctggtactacaggcgcccgccaccccgcctggctaatattttgtattttgggtagagacggggtttcaccgtggtctctatcttctgacctggtgatccgcctgcctcagcctcccaaagtgctgggattacaggtgtgagccaccgcgcccggcctaaatatgtttcttacatggtcaaagaaaccttctagatgtgattaagttaaggatcttgagatggagacagtgttattgactatctggatagacccaatagaatcagaagtgtccttacaagagggatagaggagggtcagagaaagagatgtggcaatggggacagcagttagagtgatgcagccctgagccaaggaatgtgggtagcctcaagaagctggaaaaggcaagaaacgaattctcttctggagcctcctgaaggtaccagccccactaacaccttgacctaacccccatgagactgatctccaacttctgacctctaaaactataaatcatcagagttgttttaagtcactaagatggtacagttagttactgcagctgcaagagactcatataaaataccagcaccactagataacacagcaagggagtgcagtgattatggtgccttgtgccttcaggattctcctccaccctcggcaggcctggtgctactaagcacctctgcacttatggtctgctgtcctgttccaccattctctttcccagcacatcaagaaccaaccacagagttgacaagaggccacttgtaacaatgtgagcttctgttcccctaatagtattaacaattacattcctgtgactcctttcagggccgtgaagatgttccttggacccaggcaaaggcagaactgctgacagctttggctgctccatgtcacctcacttgtgaatggcgacagaaaagccagggtgatctgtagctgatcctctggtcagttccactggctcaaattaaaattttagagaatcggtctctggtatatttcccctttgcagatgacacagagagggtcatttatgttcataagttggggcgaaagctccactggctagtagcagcatttgaatagggggaaatggcaccttttgactgctcatgtttattatgggaggggaaaaatgagttttattattgaacttcatgtgaccttccatgggatccaagagggattcaatgactgagaaacacaggaaaaacagcaggcagcaaaaacagtgaactagctcaagaaatatgtttttttgtttttaaaaacattggaaacatactacaagtccctaattagtttgacctccatggttagattttttttttttaactccaatattttcctgagttgattttagctttgtttgtttttccattgacaagattcatttttaattgtgttgtcaagttagagaataggattctgcttttgaaaaaagtgcttcgtggcatggagataacaataacttttcataacttgtgatgttttgttaaataacttcctgaacgagccatggtaataagtgctagcccaagaaatcagaactttggtgcttggcatgtagagaggatgagagatgctgaatgaatgagaaataagtagatatactagaaattagtccgtaagacaaggggatggatgagattctgtatcggtttgcgattctcttcttgcctttgttcctttggggaataagctacacatatttatttgttgatgttttatggaaaatctatttggtgcgtgaattctgttgttttcttgtgaagttcattgtttcaaatctccccatcttccagtgcattcaggcactattcttggtttatttgttaaaataactgttgcactgggccaatccattacatttatctttaataaccaactctaggggtttgttcggtcatcactttccctgtcaaggggcacaaatatcttctctcatccgtttcctagggggaagtatcttcttttcttgtcttgataagacagttaccaaaggaagaaagaggaaagccttatcctttgaaagatggcattaattcatgtgcatttggcagtgggagaggatattgcagtctggggtcagctatgacttaagactttctataagactggatctgaacaagccatagcatttacgagaaggtccttttgtgtgttgtgacacagactggtatcccatttatgacaagagtggcccattttctaagattggtccagagcaggacactctttgaccaatctcaaccacctgatttcctcatgaggtacaggggacttatgcaaacctctcctttaatatggaaacctctcctttgatgacccatctttaaggaaagggttagaaccttcagtctggattttattcattatcatgtcccctatgccaggctcagagacttcctgtgattatatttgttgcatgaccattacatatacactaaaagacaatgaagacacacacacacacacacacacactcacacagcattgaagatgacccaaaagagagaaaatgaagcttgagaaaaataaaaataaattacctggtctccagccaaacaacctactcagaatgctgaggggaaggtgaccagttgtggctaatctttccttagaacttgtgctctgcttctgtaacttggcaagcacaggcccttttgtaaaatacctttataatattccactatgacatgaaccacgtttttattttattttattgtggtaagaacacttaacatgagctctaccctcttaacaaatatttttgagtagacaatccattattgtgtacacaagctatctggagcttattcagcttgccaaaagctatctagagctaattcagcttgcctggctgaaaactgatgcccattgattattaattcctcatttcccctcccttcagcccctggcaaccaccattcccctctttgagtctataaattggactgttttaggtacctcatctaagttgatctggtacagacactatgggacacagtatggagtttcctcaaaaaattaaaaatagagctaccatgtgatccagcagtttcccttctgggtatttaaaagaattgatatcaggatcttgaggacgtattagggctcctgtgttcaccacagcagtactcacaactggcaagatgtggaaccagcctaagtgtttcctgacatgcactctcttttccagtttgattaatttacagtgatcatgtttgttgcatgaagattaactatacagtaaaagacaatggagaaatacacacacatactcccacacagcattgaagaggactccaaagacagaaaacagggcataaggaaaatgaataaatgaaaaacctgatttcttggcaaacaacctaattgatgggagctaaagtagttgactcttatttacttccactttattctttaacattacaaataatagactccctgaattgaaagcaaaattaaatgtgattttatcaaacctttattcttctttttgaaatcctgcttttctatgtcttatccatagaatttccaagtctctgcttgagcattttcagtggtaaagaatttacactctcatgaaagagatcatttcactgttggtaggttgaaattgtaagaaagttctttctcaacaaggatctgaaattattcctatagtttcacccagtagtcctgtctctacttaatggtagattccacattccagatttttaaaaaagtttattctgctttcttgtctactttaatctacacaccagttcttttttttttatactttaagttttagggtacatgtgcacattgtgcaggttagttacatatgtatgcatgtgccacactggtgtgctgcacccactaactcgtcatctagcattaggtatatctcccaatgccatccctcccccctccccccacctcacaacagtccccaaagtgtgatgttccccttcctgtgtccatgtgttctcattgttcaattcccacctatgagtgagagtatgcagtgtttggttttttgttcttgcgatagtttactgagaatgatgatttccagtttcatccatgtccctacaaaggacgtgaactcatcattttttatggctgcatagtattccatggtgtatatgtgccacattttcttaatccagtctatcattgttggacatttgggttggttccgagtctttgctattgtgaataatgccgcaataaacatacgtacacaccagttcttataattgttgcatagttggctgcgttgaggagacaaccataggttagagttcttttacgatcctggtcctatctccttatcatttatttcattcattcatccaagcaggagatgatggcagagaggaaacagagcagaagtcattgtgcaaatcatggaggtctttgtaggtcattgtatcagtccgttcttgcatggctataactaactacctgaggatgggtaatttataaaaaattttttaaaaaggcttaattgggtcacagttctgcaggctgtacaggaaacacaatgctggcatcttctggggaggcctcaggaagcttccaatcatgcacgaagagaaaggaggaatgaggtatctcacatggtgagagcaggagcaaaagagagcaagaggggaagtgccacacactttcaaacaaccaggtctcataagaactcactctcatgaggatagcaccaaggggatggcactaaaccattcgcaagaattcacccccatgatctaatcgcctcccgccaggccccacctccaacactggggattactattcactgtgagatttgggtggggtcacagatccaaaccatatccatcattacgtgaacttggaatttttgcagtgatacatacggccattggcagattttgagcagaggaaagagggattcatgttttaatggatccttctggccactttgttgagggatagactggagaaggaggaaggggagaaacagagaaaccaggtagaaggcttctgcaattacccagacccaaggggatagtgtcttggacttcagtggaggcagggttgctgttgagagtggtcagattgtggtatattgccagttgcacagctggaaatttcagattccctgtgacgtgggaatcttttatccacaaggttgtcatgcatttggaataagagaaatgaattaccaacatgagctgctgggacaccatggatccgttcgaggagtatcagtagctgcagtagctccttctagtgctgtgccaggcacagaactcataccatgtcatcctataatctaccccaatggtagttaatatacccctatcacagatgaggaaactgaggccaggctcagaagtaggcttcaagtggaatgtctagcaagtggcagagtggggacctatgcctacttccacgcttgagatgttcttctggggcatggagaacagtggcaaggatcccctcctctcctcaccacagctgctgtaaacagagtgggtgaaacgagcttcaagaaaagcttttagactgaacttgagaagagtgctggcctgggactggagccaccacgtgtcacttcactctgggtggagaaaggtgtagccggctctcaggctcatgcagatgtcatgagcttccccaaagggccccaagaaaattctagaaggcagagttggatggcacaggcagctgggtctctgagatgcatcttgcacacagcctcagagcatccctgatcaggaagtgcaaacaggttgctaggaatattttcctcgatttaaaaatcaccaccacaccataaatgtgtagtgttcaaagaaaacttgcatggtcctgtttgacataacatttatgtttcttcttcatggttagggttgataagaattactttcactttacaaaacagaagccatgggctaaggagtattacttatccatgctgttgcaggaggtctcctactgaactggggtagaactttccagctcccttggctctcttactgtgtcatgcttctggggaatgagaggcacagagaagccatcagcaggtgtttactgagcacctactatgtgccagatactagactagacagaccaagtccccgtcttcctggaacttactggtagagtgttgggaccagaaaggggttgccctgagttctcgtcctggctcttgtgtgaattagtccatgactatttgcttacccaacatctcatagcttcagtttcctcaactgtaaaatgagggaaataagagtgcctctgccttccccttgaggcttgttgagtagttccaatgagtcagcaaaaaatgagaaacacgaaaaagctttgtgacttctaattcagcatttatgtgaatgtgggctatcattcattactgggaaaatgcatgaccagcggataaaccacaatgaccccatgtaaagagcatcattgtttccttggtgcacctactaattttaccaaaggcagctggcctcactccctgtgactgcaagaagttttcatgttcatttttgtgagcttggggatgagggtggtttctcctattgactcaggagtgtaaccaccagaagattcattaccccagcaggaaagaaaggggagccctctcaagtccagttgtgtggacccggtgacaaatgtggcaaacaggctgatgtagattccttgaatgtaccattagctactgccatgtcacattacacttgtttatgcaagaaccgtgcagcagataagagtgtttaaatgcctttattacatggcatcatggtattggtagtagttggtaatgatttttttttcctcagtgcaaagcacactcttaatctaaaaatatgaattatgcttagtggctcgttggaaagtatttcctttgcgttgggggggaatcaatcttttctattacttatttttctttcctttctagcaaggttaatatgcagaacattatctgatggactttattttataaggtgagaggtttcccagaagtgcagtacaaggctcattactccagtgcagaataaattgtccaaagtaatttgaaggggcatcgttaatagcccagtcttctatgtacctaagctgaggtaccaccttgccgctcaggttattgagaattgtccagcatctcaacgaactctgctccagtttcaagatggaccccattagggccaggtcatggtacaacatgggagaatcatagggcttggaattttgagacctgcgttcttgtcctacctgctccatccactggctagatagccttggctctgaacctacttccccatttgtgtgacagagatgacatgcaagatgacttcctcaagggtcatattccctgttgcctctgaaatataaagcagtgtctatctctggcgtggtccagccctgccacctctcttcaccccatctcattccactctcccatgcccactgaagtgccaatgattcaagtccacatgctgaaaaatctaacctagagtccctcctccactccctccatctcaaactcaattaaaaaaagaaaaaacagatccatccagtgtgccacagtgagataccaatcagtaatcatgtacatagcccttcctcttatccctgtcttagagccaatccatgtcccagccctgccgatgtcacccctcaatatgtctgcaatctgttgttttgtctttggttcctctgctgtcgccctaaccaaggatatgccccaatttctctcttggactctttcaacagcctcatacctggcatacctgcacctatttaaaatatatatatatgtgtgtgcgtgtgtgtgtgtgtgtgtgtgtgtgtatgtgtatttaaaataaacccctattttatttatatatataatatataaatatattttatttatatataaaacataggggttttatttatataaataaataaatatatatatatatgtatatatatacacacacacatatatgaaggaacatagggtttggaattcagagagagatatcgagagagtttcgctcctgtttttctctcaggctgaagtgcaacggcacaatctcggcttactgcaacctccacctccccagttcaagtgattctcctgcctcagccacctgagtagctgggattgcaggagcctgctaccatgtccggctaattgtatttttagcagaaacggggtttcgccttgttggccaggcttgtctcaaactcctgacttcaggtgatcaacctgtctcagcctcccaaagggctgggattacaagagtgagccactatgcctggccccctatttgacatatttttaacggtgtaggcaaaatgatcttttttccaaacactgcaatcgtgtcatccccttcaaagccttctgtggctccccgttgccccaaagcaacatctaactctgatgtggtccagccctgctgcctctctgatgtggttcagccctgctgcctctcttcactctgtctcattccactctcccacgcccactgtagtccaccctggtctccctgaacgtgccacgtgctctctccctgatctcagggtctttgttcatactgttctctctgtctgagttgcttttccctgtacctcacatctaagtccagatgactgttgctcagcctccagcttcagctcagctgtctcttcctctgataaatctttgctgtgtccctaggagaggccaagccactctgttactccctctctccgtgttcactagagttgtccttctgcatttcctgctgtctctggttggctgtctgtctccctcattgtattgcagactccgctgtgtgaagagaggaattgtgtggctaacaccaggcctggtacatagtagccactcagtatggggaatgaatgtcttacttttttaattcttcaatttaaaaagctattgagagtttgtccatgatccccaaggatacatttgacaatgtctggagggttgtcatgactcagggatgctagtggcgtctcgcaggtcaaggccaggagtgccgcttcatatcctgtagtgcaaagggcagcacccgtcacaaagaatgatttggttccaaatgtcaccagtggcaaggtggagatgccctgctctagaaactgccaaagaagctgttgccaaataaaaactatagggaacaatgcaacaaatgactcttgatctaaattccatttcattggttgtttcattctggggcaatttcgctacatatgtttcttcatattggagcttataataatgcttatgtcatagtaattctgaaggagttgtcttttttaaaaaaacgtactctctctagaggctggagagggaggatcgcttgagcctgagagttcaaggctgaagtgagttatgacggtaccagtgcctcaagcctgggtgacagagtgagaccctgaatctaattaaaaaaaaaaaattatacaatgaataatgacccaagtactgtgttgtcttcatgccatggacaccttaatgctttcttcaaagcagtatgaggttgttaatctgagaatgaatctgttagccttccctgaactcataaagtttgcttcctctttgaaagaacttagtgccttttaatgcctatgcagccgtgatgtgccaagtaatatgttccatgtgtaatcccagttttctgatagtaaaaagaaaagttggaaacctttggccaactttggtgcctgtggctgggagaccttgcagaggttttcaaggtctgctgtgaatgtatgatttagaccacagctcagttgtgacatttaatccatagagataaatcatcacctgccattggtagggctctttatggataaacaggcctaaaatagttacctgtaaaactccatcagagtctccatcagaaatcaccaccatttttttttaatgtaggagactgggatggtgaaactctttcttgattttggtgcttgagaacaaattaaatcaaagtcaaaacaactaactttcccttggctgtccttgaggcatgcttggtactgttttgtttgggtttttttttcccagtagtaggctggagttcttatggatttgattctgacatcagcctcccaggagaggccatggtgtataatggttaaaagcacagagtccagaaggtgactctcatttatcagctgtgtgaccttgggtgagttacttgacctctctgtgtctcagtttccttctttgttagatcggataatgatagtccttacctcatagaaatattataaatatgaaatgaattaatatccataaagcgtttagaacagggaacgtactcagcttaataatgtacatattcgattaataagataaaggctggccgggtacggtggctcatgcctgtaatctcagcgctttgagaggtcgagtcaggtggatcacctgagatcaggagatcgagaccatcctggctaacacagtgaaaccccgtctctactacaaatacaaaaaattagctgggcgtagtgggacatgcctgtagtcccagctactcgggaggctgaggcaggagaatcacttgaacccaggaggcagaggttgcagtgagccaagatcatgccactgcactccagcctgggagacagagcaagatcctgttccaaaaaaattaaattaaaaaaaataaaggcttcacataatatgcagccaaagtcagaaaaaaaataacattcttgactgcccttttcccatgaaccccagatccacttgatataatatgccctgatgtataatagtttggccaaagggtagaaattaatgtggaattcaacttaggagaaaaagcaaataaagattatttgttccatgtcactccaagatggccagttatcgcccaactctcttccttctgcttcctcaagatctcttccatctgcttccctccatccatcctcctggccactcccatgtgcatgctcctatcctctctgcttcagccacccacccctcaccggtctccctactctcccctgtgctagagtggactctaaagcacacacctgatgatgccactgtcctgctcaaaacccctttcatgacttaagaagcagtgtgcatcgaaatcgcagaccctagattcctttatcaaactgcctacaggagagcctgagggacttgtctgcaaagctattctggagtcagatgaaactggaatatttggtctttggtattcaccatgctccatcaccccaactgcaggaatcatttgcagctcatggacattttggatcacagggtggaagggaactgaagctccccattgttgcctaaacctaatggcaccaggtgtatattgctgacttaccttcctgtaggttgatttaggaattgaagtatgttaaaggaatacatttgagatggcacagacaatagcacctagggcagggcccggtcacagttgtctcttcataacattctaagtcgaggtatgtttattcattgaccaactccctggagtctttatttctagtacagctgctaaattcagtcattcattagtcatgttttaaggacaatggataggagacattatttaaaaagcaataatacaaaataccaagagctattcagctcttttatactagagcctgtatatagtacgttctttcccacaaatccctgtttttaaatattttctccatttcacaattataatcccccaaatgacagaatggttgtctgacaatatttcttctgatgttgaacatattttgtacgtttgagactgtgccagaaagtctatgcagcagtgacattgaaagaacagaacaatctaaactgcagatattcacagagggctgaaaacctacaataactattgggaatgttaatcatttcaaatggaggaattattagaggcagcacatttatcatgcatatcctcatcactagcttagagcacctggcatagtttttaaaggaaagggagaaaaaaaagaaacactataataatgagaaaatatgcaagatttgaagtcaggaaaatgtgggtttaaactgcagcttcttccaatagctatgtgatcttggaaagttacttctccagtctgaacctccatttcttcaactttaaaatcagagtaataatagtaatacctatattctaatgttttattggaaagaacggtgtctggcacatagcaattaacccaagcaatttacatagcaattactcgtgaaaaagaagctattaatactatttattgttattttcccactgctgttgcccttcagccaaagagcaccaggaacacatccgtaattaagaagttgggttgattgctcattgcaatgggagagaatatactatagggaactatgggatgtcttagtaaaagtgtgttagaaaagacatataatttgggcttgcattattagctgctttggcggaagggtcacaaaactgaaccatttctctgaattggttgctattcggaagcatgggtagttctatgaccagtgctaaatctcatctttaggtaggacagcctagggtgaggctacagccgtaattggcaaagaagcagctattgttttagccaggaaaggcgatggcttcggcaatgttcaggtctgtctgtgttcatgcataattacggaatggccttctttatggtctgattgactgtggtcatagagtggccttatctgatgttggtattctctgaaatcatgtttgacaggagaacaccaacatctaattaatgtcccaggccagctcctggaggtcagtggctacttttcttttccccatcatatttattcatatatttagtgagtagagtactgtcaatccttggtgtcctttctctaacaaagtccaaattctatgtaaaaaattctatgtaggtcaacaaaacttagtaacttgggtgtcaaatgtaaagaagaaaagataggctcaaaggagagagtagggctgatgtggtagagggtggacccacggtgtctgtgcaggccagggtagggaggctggctttcattttaaatgacatctgaaaagtttgtcattttaaaaagtttgcttggtcccagtaaggatggagaatggcttgttggggatggagaaaaagggaaaggaggttcaaaaagtgaagtaaagcttttatcatttaaatgtggcagcattagatgtgggtcacagagttgtagacaggcttaggacacggaaaggagtttggttattcatctggcccagttgcctcctttacatgtaggaaaatcagcactgaccaggacagatgaagtggcttgtccacacccaaatatttagttagtgcagagtggagagctccaagtgggggccagagcccagaagactccttcagccttgtgcccccaacactgtggaatgggaactgaatcagtcgtggggaggaggggtctctgcaaacgtggcaggtcacagaagatggacagcaagggccaggcacggtggcttatgcctgtagtcccagagcttcaggaggccaaggcaggcagatctcttgagttgaggtcaggagttcgagaccagcctggccaacatggtgaaaccgtatctctactaaaaatacaaaaattaactgagcatagtggcgcacacccgtcgtcccagctactcaggaggctgcggcaggagaattgcttgaacctgggaggtggaggctacagtgagttgagactgagccaccgcactccagcctgggcagcagattgagacttcatctcaaaaaaaaaaaaaaaaaagcgggggagggagattaatcctggtgcccttctagaactaccacctggcctttcttaattgtccacttggagtgtttgccaagcgaagaaaagatgaacccatgactgtgacctacctggagggtagacattctggagagcttcccctccaacaatgtcccaaatctgtgttcatccctgaacacaaccactgcagttctaggaaaccaactttctaatatatttaaggatgcttgtcaagattttattatctgttctttcatcagagagatgtttacaacagcagaaaaatttaaaaataaaaatgaaatgttttgaataagaaaataattaaattatggcacagccagggtcagtagtcatctggtcgactgtggatggatcttccagagactcctctcgcctgtcatttgttggcactcaatctctacctgttgttcaatactttgagtaccactctggtaatgaaataataagagtgatggaatactgtatatccatttgaaagatgacaattcaattacttgggaaaaacacaatacatttacaattggcaaaatacaagctctagaacatcagcttaatctatatctatgttaaatgtatgtaaaacttatgttcctaccaaatattaacagtgactttccccgattggtagaattagggatggttttaattttcccaatttttggtcagtgatattttcttaatgtttaaaaaggaacattaacagtttttatgataaatgaggaaagtttctttacaacatttttttgcatgccattccttagagttgggcagcttttgcaagctgtgagaagcccagctcctgcttttcctgatacggtttatgactcacagctgccaccaagatgtcagttagctctgtgacagtgaaatgacttcatttccctgaacccggatagaaacggtgtctgggaagagagagagtacctggtggagccctatgagtaaatgtgatgatgattcagctctggaccctatactctactccaaaaggaaatgtttcagggcatcagagggcatgaattcatgaatgtgtatacgaggctttgttcaggatatttttaaatatagaagttcattgatacaacatccctatgaggtagggattattaagagggctttatctataaggaggctgggattgagagggtttgaatgatttggcccaggtcacaccataagagctgggagcgagatgacagagtcttttttgtccacaagcaaaatagccatgcctgtacttgcagtcggaccggaggaacacacaggccaactctgacgcaaagcatggttatcaccatgctcctccaatgccacctgcgtcttagctctgggtttattattcactgagtgccttaatgggcacctatcgtttattttccctgggcctcagttacctcatccgtaaaatgagacaagaaggtatttgaggtagatgaacttcaggatcccatcagccttgacgagtgcaggattctatgtgaatctagatgagatttatccaaggacctccacatcctgcctcccacctccatgagcagctattccaaagctaccagtctggtgattcagccaaagacccatcattaaagagcacaaagacatccttggccagtatctttctggatgctgatgcttttctcctgaattgcatgtcaccttggagaactcagtgatggatgagagagatccagctttgacctggaaaactttcacattgcaagttttttttttctttttctttatagatttatagtcaatacttcagcctttctatgacaagaagcttatatttttctggactagatgtaacaaacgactttccaagtgatcagtgacatcccaagttagggctgcattttgaaattgttctttagaatctctaacttcattgggaacagtgatatcagaatgttaccttaatactctgccagaaaggcatggagaagatgtaaaatgtttataaatgaacatccagtgatgtgcacttggtaatttcattcaaagatgtaaaggaagagatactataagggacatttctgttattttgtcaaatgctattatttactgaaaaataaaatttcaccctatatgcttgaccttcagggacttattttaagatcatatggcttttcctaaacagctgaattatttagtgagattgaactctcaaagactttaaaataaagcccaccaaaataccagccactctgcagtgctacagctgttcagacctcaatctgcatatttcatctcagcagactgaagtttgcaactgaaaaatcgctcagaaaatacttatcaccttccatgccaaacgcagaaaggaatttatttgaagctgagaatgtgatagggtgggtgacttactcccacagtgatgcttagaatggtggatggagttctagctgcgtttttgctgcttcacccctggggaggccacgcctctgagaaagaggctgggaggcccttccgcaacaggtgttcaggtatgagtgaaagaatctaaggagtgagcttggagcactgcacccacagacaggaccatcattaggagcacattctcagtgcgtgttgaatgttacgaaaaggtttgatttatacatttttgacctaaatagaatttaatcaaaatgtctagagaatttttacgggttactagcccctcactttttctgaagtactaaaagcagaatcaggaattcaagattatcatgttgagtataaagcactctagtcttcctaaaggaatcagtgtcagactgggctggtggttcacacctgtaatcccagcacttaggcaggctgaggcaggaggaccacttgagcctgggaatttgaggccagcctgggcaacagagtgcgaagtccctacgaaaaaaaaaaaaaaaaaaaaaaaaaaaaaaatatatatatatatatatatatatatatggagagaaagagagagcgagagcaagccaggcttggtggcatgtgcctgtagtcccagctactcaggaggctgaggtgggaggatcatttgagcccaggaggttgagactgcagtgagccaagactgcaccactgcactccagcctgggcaacagaggaaaccgtttctaaaaaaaaaaaaaaatcaatggtacctcctatagagtcaggtgatggtgttgattatgatgatgatggcaaagacggtggtgaaggtgatggcgatgatcatggtgatgatgatgggctgatgatgactgtgatgatcatcatggcaaagatgacaatagtgaggttgatgatggtgaagataccaatagcaacaatgaagatgtggctgctgatgtgacaaagatgatgatggtgatggtgatgatggcaacagtgatgacaatgatgatgatgataatgatgaccatagtaatgatgatgatgatgacgatgatggtagaggcttacattgattgaacccttgctaggtaacagatatgttaagcacttaagccctgagtgttcattatcttatttaatcttcagcaccatcacatgaagtacatgctgtgattttcccattttaaagatattgaaactgaagtttaaactcggtaaggaacttgctcaaggacaatacttcttaaattttgctatacattagaatcacctggaaagattttttaaaatcttgacccagaggttgagtaatgtgctcaagggcacccacctgatgagtggcagaaccaggctttacaacccagtcactgagcaccagaaccatgtcctctcttgtgaagagccagtcatagtgcccaaggaattttcagggccatcattgctcatgtccctccggtgatgctgtttttaataatagtaactggcgagctggagtataatgttttgggtagcatggcagatctttgtggggcagtgtgctgaaaccagcttaaatctctgactgccgagttaatttatttcattcataatattctgttcgaaatgaaaatattctcatggttggttttgcctgaaggtataaaattccccaaatcagcaaatcagcaaatcagcgctttcctctgatgaagggggagttcacggaagactccaaaaatggaccaaaatgcctctgttcccacgttgcaggtaggaaattaaagctcttaagaaaggatggcattgtttatccatattcagaaaccacagggctgggatttttttcaaatgaggccatgctagttaattaagactttgcctttcagggattatttatattcttaatttttgatatttttcatggcagtggagtctgaataaactcacaggtgtgacctccttccatgccagctactactctctcatttaatcctcatacaacactgacatttgagtaatagttttcccattttgcagctgaggaaactgaggctgcgagagtttataatttataaaagcttttataatttataaaagcttttataatttataaaaggttttataaattataaaaggtttgcatcattttcacctacccgaatcattcttctacaaaagaagaaaagttatttcagaaaagcttcctaagttttccctaaaatgaatttctggcctagaaaatcagatcctgctgtgttcacacttggcctcaatttcctcaggcttctgggtcattaaggaggagctttatcacctggctgcagggtggaggaagccaagattctggaccgatagcctcccacagctgcgttagtattccacaaaggcgcaaccagaagatagcaaggaactttcacacttggctttaatttctctctgcacattttgttagcgataaagaccatcatgttttttctttctccaccttttttgcttttagaattctgaatagatgttttcatcacgtggctaagtaaaactggaatagctgagatttccagaattcagttagaagatctgataagcatctaaaacttgtcctaaggtagggggagaagtgtttagcttggaaatataactcggagttcccagtcttcctcaagtaggtacttggggagatactgaagtaggaggaagatgattcctacaaaccacgccgaacaacagacagttcagagatctttgtgcctcttgactcaaaaaggcaactaaaagatttctaaagcattatccccatccctcccccatcaaacttttttattgggtatagaaaaacatgaggaaggtcaggtgctgtggctcaggtctgtaatcccagcactttgggaggctgaggtgggggggcagattacaggaggtcaggagttcaagaccagcatggccaacgtggtgaaaccccatctctacaaaaaatacagaaattttctaggcatggtggcatgtgcctgtaatcccagctatttaggaggctgaggcaagagaatcgcttgaacccagcaggcagaggttgcggtgagccgagatcatgccactgcactccagcctgggcgacagagtgagactgtctcaaaaaaaaaaaaaaaagaaagaaagaaaaaagaaaaaattagaaagtaccttcactagatttagaagtaagcccttaggcatagatggtcagctgagcctttttaaaaaaggaagttgcttaatgagatcggtttccaccactcagtgttagagttttgtgcctccagttttataaaataatgtaaattattcccagccgcagagaagaaaggacagaaaatgaaaattagcagggtacagaagtccattctgctgaacaatggaagaaaaaccacacagggatttggtaccattaaactctggggcaattttctgctcatttctccatctcctctctttctggtggtaatcaaaggaacgagctccagataggaaagtcttccctgtaattaatttaaacaagttcagtagactccaattatctagtctgctacaacatggagaaatgactgggaaaggaactcctgggcaactggaatgaattccatgatggctttattaaggagtacatgtaacaaatccaaagtctttaagcttatccttttggggggcttttaaaagttatgtctttataataaaataaaagctggggaccatgtttacctctatctcaagtgttaagctgaaccattgatttatttccttagagtgatgcattactgccacctaatggtcatgtacctgcattgaaggggttaagaagtaaggaaatgatttaaatagacttaccaccaccactggtcacccgtcttaaaaaaaaaaaaaaaaaaaaacaaaaaacaccttatagtaaccttttttttttttttttttttttttttttttggtttgtgctggatgcggtggctcacgcctgtaatcccagctctttgggagggcgaggcagatggatcacctgaggtcaggagttcgagaccagcctagtcaacatggtgaaaccccatctctactaaaaatacaaaaattagccgggcgtggtggtgggtgcttctaatcccagctactcaggaggccaaggcaggagatttgcttgaacctgggaggcagatgttgcagcgagctgagatcacgccactgcactccagcctgggctacaagagctagactccatcccaaaaaaacaaagaaaaaaaagtttgatggatgaagcagatgagttactgtggatcaggactgtggaaagcccgccagttagacaagggatgttgccctcacccaaagagcagataaacaccattggtgctgtttgagctgggcggggcagatgataccagatctttagcaagatgagtttcacacctgtgtacaggaagaagcgtgtgaaaacaggtcaagaggatcctgaaataaaccaagtgtgagagtatcaaggtgacaaaagggtaatggaggctggaatgtgaagttagagataatcatttttttaaattatattaaattatattttatattatatatattaaatattgatttattttttataatttataatgatttatattaaatatcgactgtttgccaggcaccatagttaaaatgagatagaccagttctctctctcaagaagctcccacatcaagtagcccttgatgtgattcactctgtggtctgcagaagttgccccacctctctggtccccagtctcctctgttacagggaaaaagattgctctgggagttttcagaagcccctttgactcccaataggaacttgcctggagcaggtacttccaagggaatgagaggaaaagcacagtgtttagctgagataggggtaaatatggtccccatcttttattttattatagagatataacttttaaatgatagctttgtgtaggtgatagtggagctgagtgagctaaagattttttttttaatctcatgatctgagtctagctatctggagtggagcaggaaatgtggtatcactgatatgtaaagaaatcagtaaggaggggctcatttgcagataaaagggaataaaaccagggcaggcatgcagacaccatcatggtagctagacatataaatgcagagatccaagataccaacttcagcttggagggagaaacaagatcaaaggaagagggttcagcagttctgtgcatgacactgggtcagatctcttccctagaacaagatgctcaatggctgtgtgccccagaacaaggtgctcagtgtctctgagcttcatgtcactgttgtgtaaaagcagcactatgataggggcctcttcatagagcagcattgagtatctttggtttaacatgagaagagtgactggccctgtaagcttcagcagatactaactagtatcattatagctcctcctcctcttcatgatgatttatagaattggtcaatttttccagggaaaagcagtagagatgagagtaagaggatgcattcattccatgcctgcaagacagcccagctggggaaggtgaacttcagtggtggggaggagtgaaaggaatagaaaatagagatttggggaggatagggtggactggttccacacctctgagacagcaaagactccaagaagtttctgagcaaaggtcacaggacttgatgatttggaggttactgatgactttcgaaagagcagccagtgaggaatacaggattcttcgtatggagacagattacagaaagaagtcaagtgaagcaacaatatgctcctagataccgaatttccacagcctggcaatcctcaacaaaagggagacctgggctagttttagactcgagaatagatcaagggcaatgtgtgtatgatcagcaggctgcagcttccatattaacctacgttttaaatgtcttacattcctctggacaaaataaatcagcccggatggaattcgttgccacaatgatctataatgatctatgatatgtcttctcatttataatgtcaagcccttggagataggaggccctcaatgtttctttgagacctgagatgagaggatgatcaatgaaagtaaacgaagaggatcatggtaaagatctcatggtaccaagaggaaaacaactgataaacagggctcatggaagtccctgtccgctgggcaaaggagaaacggctcccttacctgatcacacatcttcgtcatgtccttcagggccccagatcctgttctaatgcagagcaggaagatggtgactttttgaaatttctggaaatatcactcggtgaatcaaagcaaattaattctctcttttagtcactctgagcctggatttccagtccttggaatttcgcttctaccaacagttctttcagagtcatttatggttctaaatacacaggatgcagttcccacatcacctcccctcataacaccatgggatgaataatcatggtgaagacaaggatctgtggccaaatgatggtttcaagtccctgttctgcaacttgcctaatgtgtcatcttggacaaatcctttatcctcactgcaccttcgttttgtaaatagggacgttaacgctgggacgtactctgctggtttgttttgaagagaaaatgagctaatgcaagggagagggagctcagaccacagatttgtgcagagaaagtgccgaataagtgacggctgctgtttctgtttttattctgcgaggaactctaatagaagaaaaagagcatttgatgactgaatcaccggtcttcgctagcagggcagaggcagatagttcccccgccccgaccccgggcccagctgctcatcactggggttgcagagttcaatgccgacatcccaactctgacccagcacggtgcctactggggaaggcagatatggataaaccacagcagcgccctgtgattgattctttgccagacggtggagaaagtgcacattcccagatagctcctgcagggaggttgcatgatgcccacaaacccacctgtgaggcccataagcctggatgttctctcttagctgcttaggctctgcccctcaaaagcggaaatgttgagtgtggagtgcagcttgttctatgaatttgaagtacgtggtccctggggttggaccagcaacaagtgactcagtccctctgagactctgtttgctcctctgaaaaatgggtggtgttgtgggggacaattttctacctgatgagctcctcatgaggatctatgtaaagggtagtatctgattcattaccaggattttgtatgctttataggcatgccaaatacagctgtatcttactttattaaatcgaacggaaaaaaatgtgaaaatcaagttgtgtgttaaatttgataaagagggccaggggcggtggcttatgcctgtaatcccagcagtttgggaggccaaggcaggcagatcacgaggtcaggagatcgaggccatcctggctaacatagtgaaaccctgtctctactaaaaatataaaaaattagccaggcatggtggagggcgcctgtagtcccagctccttgggaagctgaggcaggagaatggcgtgaacccgggaggcggagcttgccgtgagccgagatggtgccactgcactccagcctgggagacagagcaagactctgtctcacagagaaaaaaaaattgataaagagagttcatgatgtaaaacagtagttctcagccttgtgtgtgcgtcggcatcccctggagggcttgtgaaaatccatatggctgagccgcacccccagagttaccaattccataggtctgggtagagtctgagaatctggatttttaataagcgcccccagtgatgctgctggtctggggaccacacttggagaaacaccttcttcaaggagtcacatgtttctgaagcaaaggagaatcatttgtctttgtattactctgttctcacgctgctaataaagacatacctgagactgggcaatttataaaggaaagaagtttaatgactcacagttccacatggctggggaggcctcacaatcatggcagaaggcgaaggaggagcaaagttacatcttacatggcagcaggcaagagaaagcatgtacagggaaactcccctttataaaaccatcagatctcatgagacttattccctatcatgagaacagcatggaaaatacctgcccccatgatttagttacctcccaccaggtcccatccacaacctgtggcaattgtgggagctacaattcaagatttgggtggggacacagccaaaccataccactctttttttcttttgtttttgtttttgcttttttgagacaggctcttccgctgtcatccaggctggagtacaggcactatcacaactcactgcagcctcaacttcctgggctcaagagattctcccacctcagcctcctaaatagctgggaccactggtatgcaccaccatgtgcagctaattttttacttttttgtagagacgaggtcccactatattacccaggctggtcttgaactcctggactcaagtgatcctcctatcttggcctcgcaaagtgctggcattacaggcatgtgccacacgatgcccagtccattttatttcgtactgaaatattcttcctcctattttttcttttcaaactgaacatctttatattcgaggttaatttaaaatggagccttcagtgcatctggtatgtgtgtgaattggacccagctcagggattttgctcttctgtttaatctttgcttttcctgtggacccatgagtgtcaggactgatatttctgatttttcctttgtgccaaattgagcctcatctgcccggtcagccctaatgtcacacgcactccccaccgcctgagattacaggacaggagatacatttcgattcaaagttctgaaaatatgattaatctcaagactggagagagaaaagttattggaaatattttcataaaaattaatgtttatagtcaaccttgtgacagtcggtagtatgtcagcaattcaggtaaggttgtgtttgtgttttcttgtgcagaggatttagctgcctataatcagtttcatgaaaccttgctcttacatgactcatttttttcatttattcactcatttgttcagcaagtgtttatattgattacttggtgccaagttctatactaggctgtgaaaacagagacaaatatagacatcctctgttcaggcaatgagagctttgtaataagtttcttgttttttaaggacaaaggcttttatgattttagcatcacgtggctcctcactttctcggttcgttttgtgtttggttgatgttttcgttgttgttttgcttggggatggtacttgtttcctgcccagcaattcttgtaagtaagtaataatatagaataaccagatttgttgggttcctgcaaagacaaacatgatatttaaagaagcttgcaattaaatagagaaaataaacatctaaaaatagatgtacaatgcagtgtgatgaggaacaagagaagtacctcggtgaaagaaataatgtatgtgtttgtgatgtctagagaagtattcgtggatgaagtgatactggaggtgggttttggaaggagaaatctctttctcatattattagtctcagtcagtttcccctccttttgttccaggaacaccagcatttcattagacttagacccactgtaagcaaagggcttaagcacaagtccctgggggagaaactcaactctgccatcttctagctgtgtgcctttggaaatcacttaatttttgagcctatatgatggaatactactcagccctaaaaaggaatgaattgatggcattcacagccacctggatgggattggagactattattccaagtgaagtaactggggaatggaaaaccaaacattgtgtgttctcatctgtgggaactaagcaatgaagatgcaaagacataaggattgtacaatggattttggggattcgggggaaagggtgggtagtgtatgagggataaaagactacaaattgagttcagtgtacactgctcaggtgatggatgcaccaaaatctcacaaattaccactaaagaacttgctcaggtaaccaaataccacctgttccccaaaaacctatggaaacaaaaaaattaaaaataaaatgaaaaacaacattgatcatgaaaaaaacatgaataacattacaccccacacaggattgttgaaagaaacaaaagaaaatattatttaaaaagcacttagcatcgtgtctgacatgttataagcacttaataaaatcatagttgccttagttattataattatcacaatgttgatgggtgtcctacaatacgaagtggacggagtcagggctggggaattgagtctatctgtggggtgtgcgtctgtttaatggtggggttctcagatccttgcatgtacaagggcattgtgaattggctgtatgtgggcaatgttctctgccgtactcccgaacttgtttaaaaaggaaactctttatccaccatgtatctccaccatgtatctgtgagagctgggactctgcagatcacttattggttcacagcctccccaaatcagcctgctctgttcaggggaccatatgtgcctgataatgaccctgcctttgtagtccatggtcaaaagcttgccatgagtctgtagtgccagctcaaatggcatcatgctgtgctcctgccttcccaagcagggtgtgcacgcaggcaccctctgaaggctaggttctagatatcctctcatctttatctttgcaactttatcctggcttctaaggggcatgggtgtttcactgtcactatctgtggaaaaattgattcagtctgcatgttccgtgaaacactaggagattctccaaaagaagcctcagttagcaactgcaagtatgcaaaacaggtatattaaggggtgatgactcacctcagaaaaggaacctctgtttatagaaaagattaaccagaagacgtctttaaattacatccatctctgggcatagcttgtgggtgtctgagaaaatgattgagaagtaaaatctgttttgtgtgcatgatacacattcccaaataagcccaaaagaaatcaaagtgacagtttgatttaccttttttaattcagaaaataccttttcaatattgacactagaaatcagccctaattattcccctctgactttgctactttgtctttccttctcatctgtgtccacttgcttcctattgcattatatattttactttgcatttaatgtatcataagcacatcccagattgctgtatggtccttatcattataatttttaatgactgtgtaatggtccatcaagtagctgagtctaatttatttggccattttcctatggttaaacatctaggccatcgattttctgccatttttagctgtagaaactgtgttttaagaaaccatatgtagaacctaaatatgttctattgattttttttttttgatatagagtcttgctattacacaggcaggattgcagtggcatgatctcagctcactgcaacctccacctcccgggttccagcaattctcttgcctcagcctcctgagtagctgggattacaggcccctgccaccacacctggctaagttttgtatttttttagtagagaatggggtttcaccatgttgaccaggctggtctcgaactcctgacctcaagtgatccacccgcctcagcctcccaaagtgctgagattacaggcatgagtcaccatgcccagctctctattgattatttgtgaatacttcagcttatttaattttcaaagtaatctttaaaatcggagccattgttatcacactttctaagtgaaaattgatgctcagagagattgtagagtttgctcaagtctggatacctagcaggttatagacctgagacatgaacccacgtatctctgactttcagagggtggatttttcatcagtgaacaatacaacttggaccatgtggagtgagacaaggaaactggcaaggcccaagagattcactaaccccctctaaacctgcccctgatgaatggcagatggacattcaaccaatgacagctgtttctgagcatctaaaatgcagggagcctggtgtgatcactggcccacctgaggctctgggggatgagtcgcaggttccatccattgctgccgtgtctctgtttggtttagaagtggctttctccaaggacgtgaatgttcattttagtgcaccttctggattttctcctcttccctagatatttgcttttgtgtattcccacgcaggagcttcagccattgctacacgtggctccttcttgtgctcttctctgcttccagctgcgttttcctcaaaggctttctggtatccgtcaatccctagatctctaagaaccttgagctttgcaatttatccctcttcagaatcctatatgtcagtggcattggcggagtgggtggacacctggacaactgttcctgctttccattcgttttcctttgtcacttaaagtgcagggccagggcagcatctcttctgttagtggcgcagctttccctgtggacaagtctccctttccttctctgtgctagctggaaacaaatcactaattaaatttcatctctcgcagctctggaaaaacgacagactagtgcttccaattaatttcatcaacagtgtggaataagaggcatgttgcatcctgtaaagacagcagggctgaggggaggaggctcccactgctgttaccctgctgtctgtcttcagcgaggctggagttctgagcctttctcacctgcgttccaatatccagccctggcttgcttagagggtgagaagactgcatttcttcatccaccaaacaccagtggggagtcacctgtgtgccaggcaccacgagcctcccactgttgatagaacagcaaacaaggcagacacattccctgctctggagatagtgccagacaaaaataaggatgtcgggatgtggcagttacaggtgtctctgaacatttcactaaatcgaatggaccagggccaacgacctagagacaggaaagggactggttgagcacagtgaggccccgtcttaggtaaagaggatacagaaatagatcaacatggtcccgggctttggaaaaatccaaactggtgagaaagttacctgaggggtcagttgcagtacaacgtgaaagacgtcatgacagtagaatgcacggggaaccctgggttcaggggaggggacttttgccctttgtgggttcagaggcaactgcaaggaagagcagatacttgagccattttcaagagtgtgccagatgggctaatggaaggaagggcatttcagacgctgagaagtccggggcaggctatgtttaggaagcagtgaatgatgtgttgcatcagaaagataccctagggggctgggcgcagggttcatgaccgtaatcccagcactttgggaggccaaggcgggcagatcacctgaggtcaggagttcgagaccagcctggccaatatggcaaaaccccgtctctactaaaaatacaaaaattagccaggcatggtggcacacacctgtaatcccagctactcaggaggctgaggcaggagagtcacttgaacctgggaggcggatgttgcagtgagctgagaagatgccactgcactccagcctgggtgacagagtaagactctgcctaaaataataaaaagaaagatcccctagggcatgtccctgatggagctgaaatgccaggtaagcaagaggcaggttactaggggtctgatatggcttgattttgactttgggcttcatctcagaggcgatggaggatggagtccaagccaaaacacctgggcaccggcccaagctctgccacgtccctggtatgaccttggcgagctccgcagttcctttaatcactgggggtaataagagcactgacaccttacggttgttttggggattagacccaagaatacacatgaaacactcagcacgtgcctgggctttaagcgtttgataaacattacctctaattgttacagcttagtagtgtctgtgttagtattgatcaccatggtgggcagccaggcagggtgggcactgaagggctttgaagtcagaaggacataggatctattctgccttgccatcactcattacatagccccagacacgtcacttacctcccttaccccctctgcttttcaattaaggattgtgtgtgtctgccacccagccccagcttcagcacatggatcctcaataaatcacagatgttgtcgttgtcatcatcatcatctacctctattatcctcaacaacaatgacatccacagtagcaataagcaggaggagcacctaaggcagactctgctttagagagatgagttcagggcttgaggctgaaagacagggaaccagcaggccaggccatgcaagccttgcagctaaaagacagggaaccagcaggccaggccgagccaagccaatagtcactgacccactccgcatccaagatccctgaggcaaaatctgaaaacacacatgttaggaaagacatttgtctctctcccagatttctgatttgacaggtcatggcaccctaaatttgcattttcaaaagctccccagggaattttgcttttccagcaggcgtctgagaaccctcatcggacatacgcagtgatgctggtaaagcctgagcagaaacaaaagagggtcccgggggcagaatgggaggcagctctgggtctcttaagatggccctggtgtgctaagtgcaccagaggtaggaactcacccactgtcgccattacagacagaacgctcctaacagagagcttccaagaaaccccagggctttcctcgtctgctgggacgtctctgtcttcctgtgcctgctcctgctggatccaggatcccaggctggctccaactcaagatctgctgtttctcctgtacttgacacctggttctttgggctgttcctttgttgatctgttattgtttactttttagtcgcctttgaattaccaaactaagtcattcttgtagcaaaatctcaagcacagaaatgactacattaaaatgagccttccacctctcctaattcctccccaacacttcccaacatcatcgccattaacaactgtgtgtagtcctcttatattttcctttccttaaatataactacatatctacagacaggtctttgttttgatatgattttacaaacctatggagttatagaatggagttcatcttataactcatctccccccactacaaaaaatcttgtggtcatctttccatgacaatacaaattcttactattttttcatagctatggtagccttgtaacttatttactgatttccctttttcagccatcttcctgttgttttgcaaacccaggccacccagcaacaatcttctttatatactgtcttttcatactgacacttctcagtcctgttggatgaattcccaatggtgcgattgctcatttctgacattctgtctgctgatcgtgggccacagcaccggttgtctctttctctgactcaacccaagtctgatgagatttcagtttcactgcagcattgcagcaatgagaaaacatcccatcatgcactgcttctagatattgtcaagagaagggtatattattatgcaaaagcagtgtctatttacagatgatgaaacgacaatttttcatggggtttttctttttatttaacatcttaactgtcaattccaacaaacacacttgttttcctctatgactaatctaagaaccaagatggccaacagcacaataccaactttttgtttgtttggtttttaaatatggcaaaattatatatgagcttcccattttacaggtttctaagaacatcttaatgaaaataacagaactcagaaaatccactgtcattttgtccagaaatattttgttagcattgggatgcagcaatgccattgacaagaaacccatgtggaccaccttttaatgcttaatgagcctttcttcctagcatgcattccagtgggagagaggacagaataaacgtgattaaattatcggacagaaacacatgactataaataattgactctcccatgtttcatgagccttaacctcacacttcagaatgtttatttcctttatttcaaaatgtttgtttacttttctccatggactttaattaattttgcctttggcttataaacgggtgaaactaaaaacttttttatttgcatttttatcttgaagcaagctaactaattaaactttgcaatttggtttcactgtgctgtaccagagccataggaaaatggctgacagattcgcagatttgtgaccgtttttctaatgaaggagattttggaaattttgatggtttcatgtaaatgctaaaggtaaaacctgtattaagagtcacttgatcacaggaagaaaaataaccaaatgactcaactgcataaggaggtgaaaggaaggatctagaaactacataccagtaaacgtcccctgagtaccacaaaaagtgtagaatggagtatgagcattgtagttttcaatagtgttactcaactggtagaaaagaggaatgcccaaggcataattcacatagatttcagtctgatatgcaacaggttcttccatgagatgtgagggcttaaaagaaaaggtagagattgaagacgttatcttttaaaagatactcacagcacatttaattgataggggatcagtaacaagattatataaagaacttctaaactcaataagatagcaaaaaaaagtaaaaaataactaagagataaaaacagtcatttcacagaataagaaaaatgactaatgtataaaaaactgttcacactcattggccattgctaaaattccagtaacaattagatgtatttatataattttatgtcttcctgattggtaaatattaagcctagaaatgccaagctttggcaataacaggaaaacagagaccctcgctgactgctgttcagagagtaaatttgtacaacaactttgaagaacagtttgtcattatctaccaaagtggaagatgtgtaacctatccctaagataatctctgcaaggaattctcatttatgcccctgggcacagagacaagaacactcctagaagcatttctagcaatagcaaaataggaaatggcctacatgctcattgatggaagcatagctccgtacccggcagtgtgtacgtctgatgaactgcagcaaggatggtggatctccaggacatgcatatgtggaaaacacagtctgcagaaaaatacaaacagatgatttcatttatatagagttcaaaaaaacaggaaaaactattaggtttagaaacagataagaagtaaaactatgaagcaaaacaatgaataatagatttaaaattgcagatagcctgagtgcagtggcttgcacctgtaaacccagcattttgggaggccgaggcgggaggattgctttagcctaggattttgtccaagatcagcctgggcaacatagcgagatgttgtctctacaaataattaaaaaaaaaaaaaaagttgggcatggcggcccatgcctatggtcctagctgcttgggatgcttaagcctgggcagtcgaggttgctgtgatcactccactgcactccagcctgggtgacagaattagaccttgtctcaaaacacacacacacgcacacacacacacacacacacacacagaacaaacactgcagatagccattttcctaagaggaaaggtagcaggctaagatcatggaggaacacacaggagctgcagtggtatcgtaatgtgatatttcttaagctgggtggtggatacaagtgttgactgtactatttattataccttgctatatgttgtatatgcatgtgtgtatataggtacatatacacatacatgtatatgtacatattcctatttatatataaaatatatagcttttaatggaaaagaggaagtatcagctatgtaacatttatcaggcatgaatcttatctcattcaacatttttatcaataatttattaaaatctggctcatccagagcaggtgagggatgatgatgattgaatcaggttttctgaaaggcatggacaagctccagccatgaactgattatttaatggaacagaggtgaagatgaaatcttccccttgagattcttaaaaaccagttcactaaattgaggtgagacccccgcctttgttaaacagcaattcatgcacaaacaatattggggtcttagttgacaagttcaaaaggagccttctgtacaagtgtctgcccagagagctaatttccactctaggaagagtgatcatcctgcaacagctagcatgcatcaaggtgtatcttgtatagttttctcccagcatcttgatttgaatagagagttgacaaatcaaagcatggtcagagggtggtaactagcaatgtaaaagatcagcttgtaagtttgtagctcatcggaggggaatgtataagagctatagtggaacttcgaggtttccagaagatcgattctggctctgtgtacccaagatctcaccaaagccaaacataccccagaaagcagtggcctgccttgtaaggtatgagctcaggtccctggatgtgtttaggcaaaggctgtacacctccctgtccctacatgtgtgctgaaaggtgggctccatggctccaacatcccttccacttcgtggctctcatgagtctataagagtaacccaagagaagtcaccagcagaaacttggaaatcgttttaacaggggccaagagggaaacatggggcagtgcatgactgacagctgtgctctgtcacttctacatctgccttgcagttcttcaagcagccatgagcccctgcaggcaaacctgtggtctgttcagcaggacctgtctctgctgccttagcccctgggaaagggaagcaatgctgtggctccattttcagcagcgggcaaggaaaagaacttgggttcgagagtttcacaacttgagattgaatctccttctgcctcctttcagttatatagtctcaagtgcttatcttcctttctctgaatttcagtttctagctctttaaacaagggtcagggacagcttactattgcagaaggtggtgagatcaagaaagaaattagaggcaaggtgcagtggcttacgcctgtaatcccagcactttgggaggccaacgcgagcaggagtttgaggtcaggagtttgagaccagcctggccaacatggtgaaaccccatctctattaaaaatacaaaaaaaataaattagccaggtgtgatggcccatgcctgcaacttgctactcaggaggctgaggcagcagaatcacttgaacctggaaggtggaggttgcagtaagtcaagatcatgccactgcactccagcctgggtgacagagtgagattctgcctcagataaaaagaaagaaattggagcacctggtatatattgctttctcaatgcccaaccctgaaacatctctaatactatttgttcacttactcatcaatttgtccaataaaagtttatgtaatacctagatcctaggtacctggtggcctctgagccattgggaatatgcttgtggaaatacaccctcctctcgaggaagctatggtcttgtagctgagactgatcacccaacagacaatggtaaacccagtgtgccaagctctaggcagaggataaaaccacgaagacaagcagaatggaagaggaggaaaatataacactgcctcgggaaggagtgttggggcagactttctagtgtaatgaaagatgagcagaaattatttgagatgaagcaggaacaacctggggcaggggcattgaagattctattgctgaatgaacagcagggaccaaggcccaggcgtcagatagcacagccagctggtgaaagttcaagttaagtgcatcagccaggatgggccagcttatgctgtcatagtaaagtacccaaaatgcagcgattcacaataaaaacagttcatttcttcccattatctctatcctccagggactggctgggggctcggctccatgtcaccctctctctggcattcaggctgacagagtggccactttgcagaacagcggcagtggttgtgcagaggaagatggcataccacactacacacaggctcttgaagctttcacatgaaagtggcatgcaggccaggtgcaatggctcctgcttgtaatcccagcgctttggcaggccacagcaggaggttcacttgagcttaagagttcaagaccagtctgggcaacatagtgagacccccatcattataaaaattttaaaaatttaaccgggcatggtggtgcacacctgtggtcctagaaacttgggaggggctgaggtgggaggaccacttgagcccaggaggtcagggctgcagtgagctatgatcacatctctgcattccggcctaggtaactgagtgagactctgtctccaaaaaaagcaaagaaagtggcttggagcacttcggattctgtttcataggccaggtaagtcacagggccactcgtaaatccaacaggggaagacagtgcagtccttctgtgtggccagaaggagaactagaagtatcagttgacagcactaaggaccaccacttttgtagcaggagaagggggtcgtctggagtgggagagggtgagaaagaaacatcagccagattcggaagctcctttatgctatgttctagggggattttattgttttgttttgttttgttttgagacagagtcttgccttgttatctaggctggagtgcagtggtgtgatctcagctcactgcaacctctaccgtcctggttcaggcagtctcttgagtatctgggattacaggcacacaccactatgtccggctaaattttgctgggcatggtggctcacgcctgtaatcccagcactttgggaggccaaggtgggtggatcatgtgaagtcaggagttcaagaccagcctggccaacatggtgaaaccctgtctttactaaaaatacaaaatgagccgggcgtgatggcacatccctgtaatcccagctactaaggaggctgaagcaggagaatcgcttgaaccgaggaggtggaggttgcagtgagccaagatcgtgccattgcactccagcctgggcaacgagagtgaaactcagtctcaaataaataaataaattttgtagttttagtagagatgggatttcaccacattggccaggctggtcttgaactcctgacctcaggtgatccacccgccttgagctcccaacatgctgggattacagacatgagccaccacacctggccctcctcttattacaaggataccccaaggctggacggaatgcctgccctaatccaccataacctcattttaactaattacatccgaaaagacacattctgagattctgggtagacgtgaatttggggaggaccctagtcaacctagtacagaaagtgataatgtatttttgatggggtttcaccaagttgcccaggtgggtcttgaacgcctgacctcaagtgatctccctgcctcggcctcccaaagtactgagattacaggcatgagccactagattttttactgtatctagcaagggccattgcaggatatcaagtctgggaatgacacagtttctcatttcagaaccattgaattggatacagcctgagtagtattcattcattttttccacaagcatttgggtggtgacagaaggcggcagacaaagtccccccatcacatttggcaaagagggttgcggggattcattaatcaacgagctaaacaaatgaatttgtaatgtttcagatggtgataagttgcaagagtaaaaataaagatgggataacaggagctgacagcctgttagagaaagccagaagtgttaaggtgtgaggagcgaatgggctagacagctacaaaggcgacagaagcaacataactgagtgagcttctagaattacaagagggtccctgagataaaatctatagcaacgcctagggcaggaggctttgataaacatgatttgcatctgagtttggagttggaatagctcttttgaagcactctgtccccatggacatagatgtaacaccaaccctttccaggagagtgggtaacagacaagccactcagccggttttattaagatggaaattttcacaagggctaaaataaagattcaagtcaatggaagccgcctttttaattgataagagcagctcagcagtaaaggaaataggagatgcttgatgcctgtgtcgttctagtgttggggaattatatggaacactcaaagcagacctccccatcagctcagagacaattgatggtctgtgcatgtccttgtgaggctttctgtggggtaggatgagattagaagcaaagttgcctcttttactcttctggtttcattcttcactctggcagtcagcacaattcacaggtgtatcagccgaggaagcatctcacaaactctattctctcttacttccatgccattttggcaccgtgaacttgaaatcactggtggtgttctctttaccctgctggaatcacagacactgcaagttgaaagtcacccagaggcgatctgatgttttccttcctctacagggaggagaagtctcttctgcttttcacagcaggtgtcattcaacctacacacatgtgctgaaccacaggagcttgtggtctctcgaggcaggaccaccccccgcaaccccatggtcaagcagcccctgcagtagccttgttcttccccaagacccatcacccgtcctagctgggagccacgtgacgttacgctgtttccgtttaagcatgaagtcattcaaaagttggaaggtagcacgctcccattttagaactgttgtgccaaaccctattaacctcagtaaggaagacaccaggttcaagaggctgaagaagagacccagagccagcaaaggaggcatggggttttattaggggcttacatccaggcaagagagtctagcggcaataagctggacattagaaccgccttatatacagaaacagtccagcaacagagggctggataagatttcaccttcctatgatccactgtcagcaggctagatgacataagcacacagcctagtggcagtgggctggggaggaaaactgcaaacatcatgcaatttatataacattttcccttaacacactccccctaatgacctccacctggcaaccttcatcaacccaaaactcagggcctcaatgtgtacagctcatgtcccatggaatgaaacggagtggggggctcagatgtttatcatagacaaggaacaaatctcctggtcgacctctcctggattccctagtttggaacacacattcaggtgcatctgccatcctgggtcatcccaagggtatgcttaagtcactgttatcagatgcatttaccctacaggaacaccttcacatcatgttagcccaattcctttctttctttgtatcattgcttccctttaaatctaaaaagaagattaagtcttccatgccaagccaagcccaattactacaatcagtctttatatggcagtaccccaccatctagactgccgactaacttctctcctcctgatagtctctgctttatgtattttccttaaaaaccacaggaaccagctggatccaggactccagccacaatccaagggccagagtagagggttctaaaatttctccataaaatttacttctcgatacaagaaagcaatataagccataatggctgacattccagaaaaacactcttaccaagccccggctctcagtaaactcaaacgcatctctctgctcaaacgttttgtggttccaagagaaaacaaatacaccgtgcacatttttctttctttaaagattggaaagaaatgaagaaaagacttgtcttgtccatgtttttatagaaaaatataaagcatgtctcctctgtgacagatttcttttcctgtaaatccagcaagcccatgaaagagcttatgtgtgagcggatgtcacacattcatcttccccagccactttgctgcgtttctgaaaagataacatagatgcctggagtgcagacatcttgagatttaggagctggcgccttacagctctttgtgaattgagcctagaaaacgtgtctgtttttagctgaccccaagaacagaactggcaaccgcttcgtgcagaggagtcttcctccacggagttggttctcaagaaactgacgctgaaactttctttgggcacgagacacctgtgtgcttctcatatttggacccaatgctgttccttctgccctctgctgtctgtgtcgttcctggctgcagaacacagcccccaagcagagatgctgagtcctcaggacccaacccaccacacaccggctgtgtaaccctgagccagtcacttctgttctcccactaaccaaacaaggacaataatggagtcttcctggggtccgatgtgcacactggtactcagcacagtaccctgggcagcataaacagtccgtttgacagggtgaatcaaggctttctgtcatgaggctttctgtgaggtaggatgaggttagaagcaaagttgcctctttttctcctctggttccattcttcactctggcagtcagcacagttcacaggtgtatcagctgaggaagcatctcacaaactgtcttctctcttgcttccatgcccttttggcaccgtgaacttgaaatcactggcatgatgagatcaagtcctattccttggaccttgtccatgtgatctgatttggaagaagagtctttgcagttgtgatttattgaagggtctggggatgagagtactgtggattatccaggtgggccctgaatgccatcacaggtgttcttagaagaaagaggcaacaggagagaacacaggtgcacagaagcacaggcaaggtgaaggcagggcagagagagatgtggccgccagccaaagaatgtagatagctaccaaagctgcatatggtaaggaagagacctcccctagagtgtccagggagcacagccccgcccacaccttgacttctgacctgaagccttcagaactgtgagagaccaaatatccgaaatcctaagccacccagttcgtggtatttgttacagcatccccaggaaatagatttagtgagtgaagggtgagccatttgcattagcagaacacagaactgaggagacagaaacccagccacacttgtgtgaggcgtagggcaaatctttcctagataataactcaaatcattcagactgctgcctctctgcctctccctttctgtctcttttcaccgcctctccttcccttctttgttcttgatgaagttgagctgcctataaatcatcgtcctgtgtaaagtttttaaaattttattttaagttctgggatacgtgtgcagaatgtgcaggtttcttacataggtaaacgtgtgccatggtggtttgctgaacctatcaacccatcacctaggcattaagccctgcacgcattagcccagtgtaaactttgatctccctttggatgccagctgattctttcttccattgcccgtgggtttctgattgcccaccattgctaaagcgagttgtataggctgcaggaacaggtgcacaggactctacggctttccctggtatatcttttctctgctgaggtcagacttttagatggcaatactttttagttttgctgggccagatgtgtttccaggaggtggaattcagcagaagcagaaagttcaaggccgtggaagatagcagttcaagtggcagctgctaagggcttttcaactcagtgttttttcagcttgacttgcaaatagagcctgaaagttcccaactcttaaaaatgttcagtgtgtccagtcttatagcaggaggaagaatttgaagatggccagtgttgctgtttctcaggccctaatatttctttgtgctcagtgaacgggcaagttatcctgaggaagaaaatatttcagaggcttcagtgctaagtattaatcaaataggtcgggggtcgagcaggccttccacagtcattcatacaggaaaaacatattgaggctggccccaccctatatctcagcggggaataactaaagctattcaagagtcaccttacatccacggtgagccacatttcctgataccagatgctttcagggcaaccttgatcatgggtttttgtctattgcatcttcatgctgcaagaaaattctgtgtgtaagcatctctgtctcccagcaaaatgtggccagtggaaggtccacatgaggccttttcagtctggcatccacagcactagcacagggcctgccacaaaataggcccccataaagactggggttgaataaaatgcattgtttgcaacacgtaggcatgatttcttctttcctgcggtgggggatgggactgacccatcaaagcacatctcatatttgaaatgtatgagattcttggatagtgcaaaatacaatgtgtgcattacacactgaggaggctgctgcagtttctccaaacccctacaggctgggagacttttaagagacccttagacagtgtcacctttgtttatgcagttttcataaatttcttttacttggccgtagtctctgggtgatacttgttgtaacaggcaactattacagtacaagatatcctgcttcagatctgtgcagctctcctgggctcttagttggagtgaatcaaagcccctgcacacacatacacctgtgtgcacactctcgctttgacattcacctatccctctacttcccacctccagaaccctctgctgctggtgtttttctgtgtgtttgttttagatttttgctttttttagagaaaggtgtctcaccatgttgcccaggctagtctcgaactcctgagctcaaacaatccttccgcctcagtctcccaaactgctgggattacagatgtgagcactacacccagccaatctctgctgcttcttgctcatggcaccatccctttggctatcaaaaggtagctctcctggccatccctttgcataggccatagtggaagcttataatttgatcttggttttttcctttagctttgtcctttctgaaattcttcattttagcctagattcctcttataatagagcataacattccagcagtgctcaaggatgattcattgcctcaaagttgccacctctgaaagagtgtaatatgtccaccctactcattggcaggagggagaatctgattcttctaccccttctgctgctccaaatgataatagcagccaccacaaccacaggctcagcagataacacgcctagcccagagctgcacgtcctctgcctctcatttgcccaccacagatacccaataaaatagacaccgctagtatgagcttccttttgtggctgtgatgaattgctacatatttatggtttaaaatgtgcaaatttatctttttacacttgggtcagaagtccaaaatcggtctcattgggttaaagtcaaggtgtaggcaaggctggttccttccagaggctccaggggagaatccactttcttgatttttccagcttctcgggtcacctgcactccttggctcctgacgccttccttggtcttcaaagccagcagtgtggcgtctccagatatctttctttgacttctgcttccctgttcacatctccttctctgactcccatgtctctctcttacaaggaccttgttgggcccacccagataatctaggataagcccctcatctcaagatctttaatgacattgactaagtttcttttaccctgtaagataacatggtaagatattcacagttgttggggattaggatataggaatgtttgggaccattatttttctaaccaccctttttttttttttttttgagacgtagttttactctgtcacccaggctggagtgcagtggtatgatctcagctcactgcaacctccaccctccgggttcaaatgattctccttcctcagcctcctgagtagctaggactacaggtggctgccacagcgcccggctaattttttgtatttttagtacagatagggttttaccatcttggccaggctggtcttgaacttctgacctcgtgatccacccgcctcggcctcccaaagtgctgggattacaggcgtgagccacctcgcctggcctttctaaccacacttttatgcctgcctttgtaactgtgaagcgacttttgcagctcagagaggctgccccatgtgtccagcctccccagtgagtaaactgaaggcagggtttgaagtaggcaggatttgatcttggaacctgggctctaaaccactactacaccatatgctcacccgagcagtgcctaaatacccagcttcttagccaggctctcagcaacttgcaaggaagagtcatattttaattacctcttgagtctcatcgagcacatggaggagaccttgggatattgttgaggcttaatattgagttaaaatggtgattgtctcccttgtacaaatctacttctatttagacaacctaaggttactttggttttaaaaaatatcatttcacactaaccttgctttcattgaagacttctcttctgcttctttatcaaacgtggtgcttctgggccatgcctctcccgtcttttgataacaacaatattctcagagaacacagtgtcctgggctgaatgttacatgtagtcactcacttaatccatgcaccaaccccatcaggtgaaaaccattactgtccccacttagtaccgttatacctcaggctcactgttgtccagagtggagcagctgttcagtggcagagctgggactgaaactggggactctgtctcctgtgggcatgctgctaaccctctgagtattgtgagtctggatgggaggccagtggggatttatgttagacggtgccctgtggttgcaacaaatgaaaaccaacccagactttctttaacaaaggggaattgatgaatagatctctcccctaacaagaggctggagatatgagactggggagagcaggagccatgatgactctggagccctgaggtcggccccgggagctggcttgtagcagaggcagtggagtcagggcaccgccgctcaggggcgggactcacaaccccagatccgagggagcatctagtgcagctctcttaagttgtgtccattggcccttggggtgtggggagcaggtgcctttggtctctcttctgccaggttgtttctaagagaagaacattgcaatctggaaaagcagtattattgtagggtagaaatgaacacatggggaagagcatttaaaaccaaaaatgaaacagattattcatacagagtgtgccagaagctactggatcgaatctccttttgctccttaaatatttattgagcacctactgtgtggctggccctgtttcattcagaggatacgagggtgaatcaaatgtgcattgttaagttttatggatctaagttatcccttgagtggtggcctgatggcttggaagaggtaatacatctgtcagttctgacatccacggtggagagaaatgaatcctgccaaatggaaatgactctccagttccatgggggcacaggtggcctggaaaaagctaccccagtctgtgagcccagacagtccagaaggccccctcttagatctcaatcccagcgcatttaatttcagttttgtgtgaccctaatagagatccttcatcaagttttattcttcataaaagatccatttccatagactcataaagcaactccttctaattcagtgttattttatacatactttcattgctcgcatcaatcacaggcagccgacttcccagccatgaaacaacagcttgcaacatcaccatgttacccaatatgtatttacttatcaagttggagaacacatgtttgcaaaatcagcaacattacagctttactagcaatttgctagcactttcttcccgttgaacacggagtctgaattgtgtggtatttcactatcctggctcatttgtatcttgtaactgcagtagtcaccagcaccctgaaacctcctggagatccttgttgatcatacctggaacttcagccaggtcacttacctaacaggtgtggttctggagtcatcgatcatctgtcctgcactacaactcaaggatataggtcctatatgtccctcgggcttctggacctagcctaaagatgccccagacaagctgtaatgcagggcaaggtcctcaatagccactctgtagggagaattctggaaaattatcctacctgcaaaatgtaatgtgaaatatctgacatgagctgtgtggagctgagtagggaagttgggagaataaaccacacttcctgggtttgcctctcgtctcagccacttaccagctagataactgaggtgatgggcaagcggctttacctccctgggcctcagcttccctctccataaaatgggctaatgacacctgcctcatagggtttgtgggatgattaaatgcttgcaatgccctgagtcatctgctatggtacgaaccctcataaaggttagctccccatcactcctgcaccaacttttgtattcattcaggattatgcttttgtgtgtccctctgagcccatactcagccacttgccagtagtgatgatggagtggttatttgacttccctgagcctgagtctctttcttttaaaatagagatgatctaattaccctggcagggctattagaagaactatttctggtgcacagtccacacatgtatctcctcctccatggaattactgcaaaggtctcctcctcagtgccccctatattttacctgcatctttaagccaactttacacagtcataggtgtcagcccattttacagataaggaaattgagcctctgtaaggttgtgtatgttgctcagatcatgtagccagtaagtaaggtgccagagtctccatctgttcagcttctatcattccaaggattccactctcaaggccccacaccaggccagtagaataaaaatctctgggggagagtctcagacatcaagagaattttaaaatatcttcaatgagcagccagggttgcaaggcatacccccaggccatgtttgctcaacctcattctcatgtacggcccacatctggtgggtcccaccagaaaaaacaagagggtgggggaaatttagcagaagtatttcattaaaaaggaggatgtagcttagaattcagcaaattaaagcagaagccaaggaaatagcagttctctggtgtccaaagcaaggtcaagagctgggagcccgaggaataaactgtgaagccagcacagatctcccagaacagggaacccagagcttagggctggagaaggcactcccagagaaggtccaagcctagagcagtgactgtttgacttctgcccaggtacatcttgcttctcaccccatagggaaacaaccgctggaggagccaagtgttcagtgagccggtgcagttctggggccataatgatgaaaaggaaggcatgtgcattgttgcctgcgcagctgagtataggcactgaggccgagacactgagtgtccaggtgaccccctgtgtttcccaggccttccgccatctggctcctggctcttgaccacgactggctgcgtgatttgcagagcccattgtaaaatgaaaactcagggtcccttgttcaacaacaattaagaatgtcaagagggtgacaacagagcactaaacccagcacagggactgtctgagcaaggggttctgtgcaactgtgcaggtcacacgttcatgaagtccacctgctcttgagcttgccttagacaccaggtctggccgctgaagtgcaggcaagagtgctgtgtgtcgtttctgactgaagcgttcaatgagtcagcatgtgagtttgcaactctctgccgctcctgcagcagtcaggaagctgcatgttcaaggtggcctggctataagatgcaagggtctggatccctaagctgccacttggagagaggatctgccccttgaagtgaacccccaaagtggactgaatttgagtgagaaattaactttatgtgctaagccactgaaatgatagggttggactgttatctcattctagcctagcctaatatagtctatgtggtttttgttgttgttgttactgtttttgagacagggtctctctctgtcacccaggctggagtgcagtggtgtgatctcggctccctgcagccttcgcctctcgtgttcaagcagttctcacacctcagcctccccagtaactaggattacagggacatgccaccacgtttggctaaatttgtttgcatttttagtagagaaagggtttcaccatgttggccaggttggtcttggactcctgacctcgggtgatccacccacctcggcctcccaaagtgatgggattacaggcatgagccaccatgcctggcctatggtctgtgtttttaaagagcaaattgctgcgcctttgcccttaaatagatataaatgatagcgacaataagcccattgttcagaattaacccaggagttcattaatatttagtgtcagttaagtatcaattatttacctgcttcctactccagctttatattaccttaagctgtaaacgaagaaaaatgataaaaactcatcttttatttattcacttattcatgtatttattcacttgtgcatttggcaaatgtttactagactcttaatacatgcaaagcattattctggtgcctttgaacattttcatatttgtcagatatagagcagcatccttgatctctacccactagatgccaatatcacatctcctgccccagttgtaacaaccaaaagtatccccaggcattgccaaatgttccctagaggggctaaaatacccctcattgaaaaccactgctgtaaaaaggactaggcttgccatttaaaaatctcttaaattggctgggcgcagtggctcacacctgtaatcccagcactttgagaggccaaggtgggcagatcactcgaggtcgggagtttgagaccagcctggccaacatggtaaaaccatatctctactaaaaatacaaaaattagcaaggcgtggtggcgcatgcctgcaatccaagctacttggaaggctgaggcatgagaatcacttgaacctgggggacagaggttgctgtgagcccagattacgccactgcactccagcctgcactccagtgacaaagcgagactgtctcaaaaaaaactcttaaattggttaaacaaacaaaaaaaaccacaccgtgtccttttgttgtttttaagagtttatggaaaaatatattggagagttacaattacttcaggctaattcaatataaagagtatttttattattagtttggaatattaaagtttccacttaaaattgattttttgaagtgttttcaggcaacatcatttaattcagcatagagtatcctatgtctttcaaaaagaacttcatgggaatggtagataaaaagattaagtggaatttttaaggggtgtaagaaaaatcttactgtcgaagtctggataaaaggaagaaattaggacagtaaaatgaatcatgatgggggaccccagttttggccatgtgtcacctaatatgtcataaacagttcttcagcttcattaaagaatagcttaccagaaagaagggcagacactggaggctgaactgcagcgaatgaaaacctgaaataatcacaaggtggtcctgttgccatcatctctttatcagtataaaaataaacaacctttgaaaacagatggagacagtcattgctcaacttgtcataacttattacatatttggctgtcaatttgtacttaaaaaaccaactagctccagggaggcaaagcaaagtggagaggagaagcgaagcctgttgcatttcaattcaagcctgtggtaatttcagctgcatggagacacttaggactgtttttaaatgaagtcagcaactgtcccaaaatttaaggcattctcattttaaagagcacagttgtgttcctatgggatggcacttcctcacctcaaacctgtatcaggagtatatatatctcgtgcccgtttagtcagtgctgctctcccacagggtgagatctctctgagccagatcattctcggacagatgatgaatttttctgttccaaacagggaggtgggaggaggaagggcaaaatgtttcccatggatgtaccactttttaaagttgtaatctggagtactcatcaacaacatctaattcgtgcctttgggggaaagaatggctctaccaacagacaaggtcaaaagctggtgggcctcagaccgaagcttgccataacctcttttgtttggccttctagtcccactgagtgatcttttattttttaaatttgaactagtgtctaaaaatccaaattcccaccttttcttaaaaaatcaaaagatggctggacgcggtggctcatacctgtaatcccagcactttgggaggccgagtcgggtggatcacgaggtcaggagatcgagaccatcctgactaacatggtgaaacctcatctctactaaaaatataaaaaattagccaggcttggtggtcccagctgcttgaggcagaagaatggcatgaacccaagaggcggagcttgcagtgagccgagatcacgccactgcactccagcctgggcaacagagcaagactccgtctcaaaaaaaaaaaaaacatcaaaagatctggctagtccagacttgtatttcagacatgcagtaattcctttgagctaaaaggcagctgccgcctgaggcaggaggcacacgctccagtttgccaccaaccccacctctcccggttgccttgagagcgctttactcatgtgaagctacctgtatgggcactgggtgagtaggtgagcttctcactcctggcccagctcccagtctgaccacagagagtcccacctttgaggccagtggaactaggctcctgttagaggactgaccaaaggtcattagcatcttcatcaaaactcacattatcaagcactttctggatcaaatgcacagctggaccaccatatgaaaatgtgggaggggtccttgtgctggtgaataacaacccctggataactgggcaacccagggaagggccgccaaaggagcaagggttacaaagccaaatctcccagaccttgccttaggcctaagcctgcttccttcttctcttttccccaaaattgggctggaatcacctcttttctctgccactctgcagttccatcctcctaccctcagagtacaggggcagggatttctttaacagtcttcacacccagaactgagaaccaacctcccacctggctggccagtagagtcttttgaagatgagaaaaaaaaaaaaaaaaagaaaaaaagaaaaagctgaatgatgagcagtggcctccaattggacatcccctcaaatgaaaataaagccagtccaaatgtaagccagtgggaaaatgagacattatttacaattcatcacatgggtagctttccaggaacacatgccctgccaaacgtgggctgcctctggatccctatcaggttggttggttatctttcatcaactagtcattcgacagtttccctatcaattgctgtctactcaagaatgtccacaagaccagaggaagcggatgcatgcatatgtgcactcaacagaagtatctaggcttgtctaagggaagaaaggaattgtttcctaacaagattttaagtaactcctgtttctgtagatcctgagagtgagtcctagaagcagtgtgtcttaaaccctaagtggttgggtcccacaagctatttccctcgtcatgattgcactcagcagtgggtcctcacagaactgagttctaaattgtgagagtcaatgaaaataacaaacttacatttctcagctgggcgcggtggttcacacctgtaatcccagcactttgacgggcagatcacgagttcaggagatcgagaccatcctggctaacatggtgaaaccccatctctactaaaaatacaaaaaaattagccgggcgtagtggcagacacctgtagtcccagctactcaggaggctgaggcaggagaatggcatgaacccgggaggcggagcttgcagtgagccaagattgcaccactgcactccagcctggtggactgagtgagactccgtctccaaaaaaaaacttacatttctccattacttaccatcatcctggcattggactttatatagattaatttgtgcattctcaaagggggtaatattacttctaagcaagagaaagttggtcattaggagagaggggtttatcacatcagatgtattagatattacaatggcttgtgccctgcaaggggccatagcacataaatagatacacggtattctatagaattaacgttttgtgatggagtgagagggtgtcaagtcgaataaatgtctgaaaatattcttgggggaaggtgttaatggaaacacaagaggctcagagagcattgattcactcaatgcctccaacaacccatgagagaagagccattttgtcaatgaaaagttgaggtggggcgtgatggctcacatctgtaatcccagcactttgggaggacaacgtgggcagatcgcttgactccaggggttcaagaccagcccaggcaacatgacaaaaccccatctctacaaaaattagccaggcatagtggtgcgcacctatagtcccagctaattgggaggctgaggtgggaggatcacttgagcctgggaggtcaaggctgcagtgagctgtgatcataccactgcgctccaacctaggtgacagagggagaccctgtctcaaacaacaacaataaaatttggggcttaactgcccagagaagcccagcaggtgaggccaggttttaaaaatagatagcccaggtcctcagccgggccactggcttgattctgctttggttttgcacaccagggtctctttctttgttactgaggacggttaggagagaactggctcatgtccacctgcttggtcaggaaacaattttagattggtgtgtttggggtggccagttgagtgaatggctgtaggctgtgtcccaggcactacagtcacatttgcaacaattctcacattggcagtctgctgctcatgacgaagagacgtgtctacacctgaaagcaaaacttggcctgcagggtgaccacctcattctggtttgcccaggagtgtcctggaatcccctcagtcctgggagaactatctggttctcatttggaaccaggaggccccaaacccattcaaactaaagaatcttcaatggaaatttagtttccaatgagaatcgttccaactagatattccccaaaatgctagaatttaaaatagcagcttctacatctgtctcacctggctaagcaccctaagctgctgctggtctaaggcttgtcttctgacacaggggcaaacacacaagtaacgttgtgcactacaggatccatgaccacattctccttttgaagcaccactattagatcattcggtcacagaaagcatggtttgattggaattagaactcactgcctcctctggtgagtttgatgcttgacaacgatgtgccattttgtcacatcaaagaggttcacctggtgacatctgccatctctgctcatgtttgctttaacatcacacttctccctggaaagcacactgttgccctaactgtgctatcagaaatccagtgctgaatatagatctgaatgtctatgtctcaatacgtgattcgcttataggaatagcattttgtaaaaaatgagcctgacactttttgatcaggcaaaggaaatgtttagggatggagtcaaagaaatgttaagaacagcataattttgtcactgtcttttggagcatccccatcctcatggccagctgaaaaccccccgtcactctcagatctgcgctctcctttctcaaggggttggccgtgcttgaagtcacaggaaagcaaaacttcaaagctggctttcaaggtcaagaaaccaggcggcacttgctttaatgagagagctgcagtcaggaggaaggggctacctggccacaaggaagcgatcacacttgttaatcagcctgtcaggctggcggccgtgtccttcggcaaaagaaaatgacggcccaacttgagactttcaaccaggaacctgggatgttttcttccccctttggaggagctgctgctagttcatctggctcagggagtgacagggtgattataatttattttgtcactcaggagagtattgtgacgggggaaaagacagaaatgtactgtgtggaagccccaatgcgtgtctgtcatataattaccctttctctgctgtctggaaacacaagacaagcccggataggaagctgcatgagctggtgaaaacaaagtggtggacatggagtccagtgtgtgggactgcataagaggagaggcacaggcatcacccacaggcaattggagcaggtgcactgaggcccacctgctgcatgtcagccctgggcatagcattggtatgtgacccaggaatcccattccagcaaggacctccaaggcgcattgaacagggagctcagaggcagtcgtggaaaatctccaggcacgttgctcagttgttcattcttcttggaagacaaggtactggtggctctggtcagtgtggaatgaggcaacactacagtgaatggcaagaagccaattcaacccaaagaacactgatgaggacctaccgcgtgtcagacactgggcttacaaaatgaacacaacagtctataccctccaagagctcacatctaggaccatgtggcccatcacaaaaagatagacagttctgaaataaagaggttccatcaacagcaaagtttggtgagtgctgcagagagacaccctctcttggagattgatgctgtaagcgtgcttaatagaggcactgaagagtcctctggggaaaccttgctttgcggtgtttgccacgtatttcccaaatctgtttctcgactgaatctatggagccagagttcctcggaaccaatttagagaatgctggtttaggaggtttatccagcctttgcagaacacagaagtaaggaaaccatgatccagcctccaggggaaggtactggcaagagccaagcattgcactcagcagataggttggggttcaaagtaaagcctggtcttagaggccgactagaggaccacgtggagacatggtgtagactacagaatgtgtgtgtgcacgtgtgtgtgtgttgttgtgatatccacagtagaaacccagatctgcacactaagaccatgggcagggtgggagaagggacccggtgagagagagggctgtcctgcgaccctttgtcccacattctttggacaacttaatcctagtctcctgtatctgaggcctttgcctgcactgccataattggctcagaacccaggacagagttggataatgcaaggcttcctctctgaacactaatgtactaggcactgtaccaagttctgaaaataggtcatcccatgaaatcctcacaacaaccaaaggggaatgttgaaaacagggaaaccgaggctcagagagagatgaataatgtggccacggtcacgcagcttgaaaagacttgaacccagatacgtcacctcagagtcgttgtcttcaatgctgcaaacctatttacataactcaggcacaatgcggttccctcagaggcgcgatttcctccagagtaaatccagtgatgcattcgtgtctgggtgaagacaaacacggggcttaagaccgagttcacctgttccctaacaatccattaaaataaaaaccattttctgtgtatgcttgggaatattccaggataattttgtgttacatcatgttatccaacctgtaaacaaaaagatatcctcagtgaatttcctgatgaaaactaaagactcatcaacctgaaaggtcttttttttttttttcttcctctaatcattttaatgcatatgtcagttgcaagccatgatgacttcatttttataccttccatgacttcaattaaaggcagattaaatagggcacaaatccaatcaatcgagcattcattagacattaactaagtgcaaggccctgggtcaagtgtacttaactggagactggtgtggaattgatggggttaaggcctcctcctatgtctttggccacatggagctccctttagcatgtccctgggtaagatcgcaggcctgaaatctgcctctgatttctgatggggatatccttaagtttgcctagatcaggaagtttaatatgtgtcacatttcacatcagtttccatagactgtgagtggctgcctagaccactgttggataacactaattctgtagcatgtcaatgggagacagagtcatgctgttcctgctgtcttccagagacaggggggctgcatgggccaagaatgttcttttctgaagctgaaccttgaagcttgccctgagaccatctcacagggcaaagaagctaggtggataggaagtgcaccttgaagcatgtggccggatggcaccattggtgaaaatagctgagactgcctaacaaatcaatccaaccttgagggtggccagatcttcgttgtttatctgatcaatcaggcctaatgactgatactctgattccagtggtgggggaaaaaaaactggctttgatgattagagaagcattgctatggaaggaaaaggaattctgggtggtggtaaaaccagatgaattctatctttcctttaggcttcagtgttttctttgtatgactattcctgctgctttgttgaatagacatctgcggctttgatctcttccggttaggtcacactttgtgagtccagacagattcaaaatcagaagatgggccttatatttgtagaagactatattgggataaaaagttatggttaggcaggatgccctaatccaaatgtggtagcaatacaattgctattgtcaatcatcaaaaccagcaggcatgtttttgttggtgcttataattatgctctttgtaaattaaattttaattgccaaagcaatacattcaccttgtaaaaataaacaaaatgttatagatgaggccaacatctttcccgatgaccatgccaaatcccaatcccctctcttcttctccagatttaaccaccattaccagggagaagttctccttatagagttgttctatgcacttataaactgtacctgtaaaacatgtgaataaagtattgtggcatgttctgtgtgtaagcatgttcacaaaaatggtatcactatccccctgtgggtaaggaaagttaaaacgtgccacatttcacatcagtttctgtatacttcaagttgctacctagaccactgtttgagaacgctgattccatgacaaggtcaatgggaaacagaaccatgttgttcctgctgccatccaaaggcaagggggctgcatgggccaggaatgttctcttctggtgctgaaccccaaacattcctcaacctaacatttttactaattaatatatcttgaagagtttcccacattagaacccattagatctacagtctttttaagctgctgcaaaatatctcagtgtgagaatactatcattttggcaattcccctgttgatgaacagctaggctgtttccaaatttttcaccttgacagataattcagctagaaatttatttgcacagatcccttgcggacacgtgcagttgtttctgaaagtagatgccaaggaggcgaaggcattgtttttactctttgctgcccaatggtccttgacaatggatataccagtttccctttatatcagctgcatgggagggagacccattatctgacacccttatcaatcattgacataatccaacactccacatgcttgttatagaatcaggtcctatttgtatgactcttgcttgtttgtgagtgaacccaaccatgttaccctcattttatattggaagtccctaaaataacacggctgctacatagtaggtacacattagtgtttgctctcattccctttaactggaatgcctttttgctctgaggtccctttgacttgttcctgcctactctcttcttacgggtcctcatcagacacctttgtgcaaaccccagactagataaggttgttcatctctgtattcataatgccctctctcagtgtgcctgataagtcttattgtttgttatatatttatctcttctactgatttctgagctcctgcacacccaggagcatgcctctttgtactcctgtttccccaacacgcagcccaggcacatggagttggcattgaatcagagctttaaaaatgaaggccatggctagatggaatcttgtaatcccagcacccttggaggccgaggcaggtggatcagctgaggtcaggagttcaagacaagcctggctaaaatggttaaaccccatttataccaaaaatacaaatattaactgggcgtgatgacacacaactgtaatcccagctacttaggaggctgaggcaggagaatcacttgaacctgggaggcggaggttgcagtaagccaagatcacgccgctgcactccggcttgggtgacagagcgagactctgtctaaaaaaatgaatgtccctgtcacaaagccacatccacagtggaatgaaagcccctgaaaataaacagtgtatcaccagagggaaaaattaagcagtcactctgctgaacagcaaagatgttttcttctttatttcaggtcttttcatggaatgaaacagagagggaaaggaggaagaaaagctgaaacatagcaaagcttgggaaatacttttcttttttaatttggaaagtgatgggcacactgctgcactgctattgcccaggtggggaaggggctctggccgttgttgacccattgataaccattccgtgcctttctgtcttgccccggtaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagaggtgagctgaaaagaatacactttctttttcacgagaatagaatgtggctttcatgcaagggatgatgtggggctccagtcagtggttttttttaatactgtaaaggcagaaatgaggtgtttaccatgttttggtggggaaaatctataaagggaaatgggatattatgtgacccaagaaaacacgtgctctaaaaggctaaagcgcctggaactgtttgtattcactcaacctgatgcctatttcctcaacagccacttattctctaggccctggtgattctagactctgcctctggcccctgctttaatgctagaagggagagggaaggacaagggaaggaggggaagggaggagaggtggcttcatccaagatcacacaggctgtccttgttgcagagtcaaatgcccatgactcctttctccaaccctttgctgcaggcatcctgcattcccccttgaacccctctcttcctccatctctgttctcatccctttaggctttctccgtgaaatctcccccgtctcctgggtcacatgtcacaaacaggtgacccctggcccagtcagtccacatgcctgctctttcgttttgcctgcagtgttttacagcttttagaattagttgtcatatcaaaatatttagatttcacgtttctgttttaaaaatgccaatttccagtttttctggacatcagaaatcctggagacatcaggtccactttccacatgtgcactatcggtggtgtgaggtgtgatgctccagtggatccagggtctgctgtcccctttagatgggacatgtgctcccacctcgattacgtttccacgtgcatgggcccctctggtcctgccctttcctgagtttgaggtccaccgtgtagcttaccataagctactttaagtagaagaccctcgcggacctccaaacacagcatccttaaaccaactcgtggattcctacccatccttcactctccatccaccctaaacctgctaccattctggaattccctgctcctgacatcatcccacaggcgtggggccttggagttgtccttgaccttctgtaagaaccatcagctccacgtaactgctgggcttccctcgggggctctgtgcatttccccctcagtgtttttgatgaaataaatccatggttcggagtgttgtttcctctgctttctcctctcttatgtgctatagtttctcaagagattctggattacatcaaccccttctaagaagctgtcctcatccacctgattcttccacagtcttgttcttcctcccatctctgactactcttgcctgtagccatcatatagcagttggcatgtgctaattaggttgtcatttgtctctgaagaagattctctttctcttggtctagacctgaattgtccagtagagtaaccactagtcacatggggttattgcaattttaaagtatattaattgaaatcaagatgtaaaaatcagcttcacagtcacagacacatctcaagtgctcagcagtcatatgtggttggtggctattgtaccggacagtgcagacctagaacacttccatcaccccagaaggttctactgggcaacaatggcctagactgtatgtttcctgacaacagagactgtggtcatatgcatgtttatatttctactgcctagcatggttgaagtacttctaaaaatcctaattatatgtttgttggcatagagggaaaaaaaggaaaaagagttggaaataaaactaagatcttacataagctgtgagaaacagaagctagaaataggtaattattgaaagggagagacagagaaatttgcattgaaactctgattgtcctttggaaaatgtaatcgtttctagttaaagaatagggaagtagaaaaagtaatgagtccattatattcatttcatctcccattctctttccaaccctccctatttttttatttttttattttttttattttattttatgagacagagtcttgctctgtcacccaggttggagtgcagtggcacgatctcagctcactgcaacctccacttcccaggttgaagcaattctcctgtctcagcctcctgagtagctgggaatacaggcgcctgccaccacacctggctaatttttatatttttagtagagatggggtttcactatattggtcaggcttgtcccaaactcctgaccttaggtgatctgcccacctcggcctcccagtgtgctgggattacagggatgagccactgcgcccggccaatgctccctatttttatgactgacatattttcttcttttggaggccagtgatgacttcccaaggctctctattccccacttgacacgtgtgtgcaggtgcacacacacatgccagcttttctatagtccttaatgctcccaaagcttctcacaagatcctttcacaagaaaaagatgaagcatggtgatttctccgtttcagcttctctttgttctgagagaaaatattttataagtctctatttataaatcaaagtgataatgtagtaaattatcccatttttaaagtttattttaggggacaaatgtgtttccagctcatgatcttttcatttgggctttcattaagttgtaataagtatgtaattatggaagttgaattaagcatttctagtcacaaaacatcaacagccccccaaaaaagatcaactcaatttaaccgaaattggaaaatcaatgaaaatgaataaagagtgtcactcttctgtgagggtttccagagttcattgctgatccaggcaacatcagtgcaatccaaaggaaagaaatgtccctaaatttaggcaagctttggctagttccttgtgctgtgataagcttcacttcagcatgtttgctgaggaggtggaacgtgattccaagttcttgtctttgagggtaaaaaacttgcacatcagatgtccagtggagttccccagagtttgcaatgttttcctcccattgagacttggcactttttgtaggattcacatggatgcgatactttcttcagcaggtttgtgagattttattattaatattatttctgaagaccttctgagaaggcctgtcttaggtgtggttttaaagtctacttctcagccagatgggcagaaaaaacatttaatacagacttttgcagcattcatttaagaaagtatcccatttgggaccctgtggactttgagatgattcaagttgattttaaggtttgttaccttgtctcctgtcttcattcgcagtatctcaaattgcgtgttggaacaatgaatatagtgattccagttctgtcacaaactccttcaagagcaggagctgcagaaaccacacacacacacacacacacacacacacacacacacacagctcaccagcacctctggctctcacctgaatgagggacaaagcaaacgtgtgtttcctggcttgttgggagtggatactctggaatcccattgggtgacacgagctaagttgacacaataacaatttttcatctttattttccatttagtcaatttcctttcttaagtgcatctaccaaggaggaccccagcaggaagtgtttaaccaagggagaggcagatgatgcaagatgagtggggaggtggcaggcactgggaattttctgtgaatctgcctacctaatcatcttccctgccttttatagattcactttgtaacaaggcttgtaactgaggatagtcacacagggcagtgtagaaatgatccttactatgttgtcactttggttgttatcctttcttcttcccaccctcctcccttcccaggatgtctcacatggagccatctgaggcaggtgcactcatctaatctgctcctctcctgctccaaggattggcagccactattcttgaaagagtctatggcctatctgcttgcactcaccatagtcaatgctcaaacatgcaatttgtgggatgatgtttggcttgcccatgacctattgccagtacctagcacatgagagatgctcaaagaaatatctgttgagagttgaaaggcgggaaggaagtgaggaagacagcgtgattcacactggcttgaaagcaggtgaactggccatttcttccccttccatatcttaagctccgcattaatagatatcaagtttccccaagacatgtgcgttttccattacacgctcatccatttacttgttcggaaaaccctaccagaatatacgcttctggaagaaagggaccttggatttctgttctctctctctattcccattgccaaatatagcaccagataaataataggcactggataaagatctgttaggttatcagggtggatgagtggatgacctgtgttccttaagtttgtattatctcagaacattctgcaggatccacattctggcatggatatataaacagaggaagttactttattataggtgaaagcttagtcttacccttgtgcaatcatctggtaatctaatttattcactttatgtttaccttctgcaggaactgctttaagaaatagtgtcttggtccactgggtgaataggatggacaggagtatctgtgcctcttgcttaagtgtttggggagatgtttgcggaaaataagagccatatattccagtaaatgaaattaggttcatttggggcacttttttattattttctatagccatacttagccccccatttctggcatctctgtctatgtttttaaactatgtctggctgcactacaaaataaaatcagataaaggtctctaacgtttgataaatgttttatttagttgatcatcttggctgctagactgaaattcatctgctggaatctgccagctttctgaacacagccacaatttgcaactactcagagtaactaatggtcagggttttttttttttttcttttttaatggaaatagtttccaaaatagactcataaaaaagcaatcttaacatttgcattgagaaagtatcattagtctttttaaggggtttgagctgagcacttttctgtctttgtttgaatttgcctttaccttattatctattatcttccagataatctagggaaagtgatagcctgcccgtgaaaatgtacatataatacaagatattagggctgtgaatgtaatttgttttgtattttcagctggtaacgcactttctgaaactttataatgcccaaatttttaggccagatgtaaaaatggagagaatttctttctttctttccatggtaagtgttacataaggacttagtcttagatttatgtgcatttacttgctatgagatattcaagagtccttgaatatgtcagagaagaaaactgaagaatgttagggagaacatcctatgccatctagccaacgaatttggatgtgtagctgcaagcccaaagagaactatgtatttggtcaaaatgacccatgttaaaatattgtcacgtagcatgcatctccagaaacatactaaagacatctgtgaaaatgatgatatcaaatcaagctgccagaaaagaacaatggtaaaaaaggatagcatttcctccagtgccttcaatgaaagatagaggtagtagtcatactcttaggaaaataaatgtttttaggcctttctgatttaatgctaatacttttctcattatcatcatgtttaaaacattggcagtaattacacacaattcaatcatgctgtcaggaatattatcttgctttgttttggtgggtgggaccagaatgattcagatagtagcatcctcacaatttcttcgagctatttactcataaatatttctgttggggtaattttccccattttttttatcacttgctgctgtgaaaattgagatggaaaaagtagatgtaaataaattgccttattatttttaaaataatgcattatcctttcaaatgaaacacagctaaccaccctatgctaattgcacttgctccgttgtttcagcaaataaagtagaataggacattcaaaaggcagaatgctaagtcctggggtctgaaatttagttccatgagtgcaggcctcctgctgatggcaatggggattggtgggagggttagagatggggaaggccagggtctttatcttgtggcctcatttgctcctccactctggataaattctagaagaagaccttgatgagtctcaggactccactggtaaccgtaaccacttcccccatccctcttagtgtgacctatcaatccattaaagctaagaccgtggctagtctcttagtatgaccgcaatttagttgaaacctggcttcagagaaatgggccaagggcatagactacctgtgttttttgttgttgttgttgttgtttttggttttttgtttgtttgtcagttgtgagacctctctaaacctcgatttcttcatctgccacagtgagaataatcacaatcccaatctcattggcttattgaaaaaattcaaataagatgtgccaagtactagcgtgatacttatctataagcactctgtaaatattagttggtattagatgtttccatgattgacaatgagactgaagaagcagaaagaagttggagtttctcctacaggacgtacatttacactttgcccacacggcagagactatggcaagtttctttaaattgaatgaaagacagagctaatccagcctacaaaattcagcaataaaagctagtaaataagtattgagcaccacaaatgtctgctgaactcatggtgctggatatcaggacgcaaagattgagctgcctgcattggaggtaaagcagatatgtcgacagcacacgcatgcaaagatgtgctgttcaaaccgaaccttgatggctgtgtggaaacctggagtgcggaagcagaaggaagggcatcgtggggaaaggagtggcatggacaaaggcatggcatattcacatgctacttaaagactccagagatgaggctgtggtatagagagataccagaaaagggcagggagtttgaacaagattgcaaaaggcttctaatgtcattcaaacgattatagctatatcctactgtaaatgggaaaccaccattatttaaacattaaacacagctctgttcaacacagcattcacagagctgtgacttggacagaaaatgagttaagctaaaggagagatcgtcagtggcaaagttcaggcgttttggagacaggttgagactgacaagttggttctcgacatttctagcctgatggagataagagctgaggagctaccacttgaatctaaattctgagcttgttaaatagattaataaacctcagtccgtaggtattttctttcttctgttcttgggcttcttaaagtatcagacaatcagtagttactgggcacatgttgaatcaagagacacttaactttatcatgaagaaagattcatctttttagatttaacaaatgtttaattctctaagatatttcttttctttttggtattttatatggtaaagataatttgcagagtgatgatgaatttagagtacttctcttttttgtcattttaaatttcttcattttattttatatgaagtaccctaaaaagctaaagaatgttttcatttttggaaaaagttcttttcgagagctgtttatttttctttatcagccaaaaagtatgattactatgttaatgcaggttttgcttcatcaagagattttccagttattgaacttaaataacattgttctaaaccccaaatcctctaaattcctgttgtcagtgaaagaggtaccttctaatttggaaagaatatctagttcagttctgatttcaaaccagcagagaaaaataagaaaaatgttgctcctgccatatggagaatgaccatcatttaaggaaagaaaagttggttgagagtttttgggaagtaactgttttgtacttcctttaatgtactcagtgtccagagcaggaactgggtggttagaacagctgcaatatgattccactggaaagcagtttgcagagaggcaatcaaaagctgcaacacttagattaaggcaaactaatgatagaccatttcaagacatgatgacatctcaaaatgcctgggatccacatttctttcacttttgttttaagaggtatctcatttgctgtgccttttcataggataaaagcttgttgatcgtattatttagttgaacactttggggttctaaaagccgtgatcaaccttattggacatatggcactatgatgtcacattcaacaatgaaaggcacttcaagttataggatcatctattgcattggaggtcaggaaactttttttttaaagggccaaatagtaaatcgtatagactttcttggccaacaggcaaacttgaagatattattatcaacagaaagagtcaaactctataaaatttgaagagatttattacttcattctgaaccaaatatgagtgaccatggccactgactcagccctcaggagaccctgagaacatatgcccaaggtggtcgggccacaaataagttttatacattttagggggacataagccattaatcaatacttgtaaaatgtacaatggttcggtctggaaaggcaggacaactggaggagggtgtgtttccaggttataggtggattcaaatattttgtttggcaattggttgaaagagtttaaagacctggaatcaatagaaaggaaatgtctagcttaagataaggggttgtggagactgaggttcttactatgtagacgaagcctccaggtagcaggcttcagagagactagatggtaaatgtttcttgtcagactttaaaaggtatcagactcttagttaattctctcttggatcaagaaaaaggcatgagaaggggaaaagggattttctacaaaatatagtttttttcccccataagagacagctttgcaggactatttcaagatagggcaaagaaacatatttggggttaaaatatttttatttccttccttatctgtcatgtgatgttattgccagagtcaggctggaaagtaagccacattatgtagggttaaatgaaagccctcttttgagactttttggcttgtagagcatgattccccagatgtcttagataggaatttgggcaagtgaagaaaaaaggtcagagtttagtcctcattatgcaggtacttatataaccattaacagacaaacagagagccaaatcatgagtgaactcccattcacaattgcttcaaagagaataaaatgcctaggaatccaactgacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcagtgccatccccatcaagctaccaatgactttcttcacagaattggaaaaaactactttaaagtaagtatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctgtttaataaatggtgctgggaaaactggctagccatatgtagaaagctgaaactggatcccttccttacaccttatacaaaaatcaattcaagatggattaaagacttaaacgttagacctaaaaaccataaaaaccctagaagaaaacctaggctttaccattcaggacataggcatgggcaaggacttcatgtctaaaacaccaaaagcaatggcaacaaaagacaaaattgacaaatgggatctaattaaacgaaagagcttctgcacagcaaaagaaactaccatcagagtgaacaggcgacctacaaaatggggaaaattttcgcaacatactcatctgacaaagggctaatatccagaatctacaatgaactcaaacaaatttacaagaaaaaaacaaacaaccccatcaaaaagtgggcgaaggacatgaacagacacttctcaaaagaagacgtttatgcagccaaaaaacacatgaaaaaatgctcatcatcactggccatcagagaaatgcaaatcaaaaccacaatgagataccatctcacaccagttagaatggcgatcattcaaatgtcaggaaacaacaggtgctggagaggatgtggagaaataggaacgcttttacactgttggtgggactgtaaagtagttcaaccattgtggaagtcagtgtggcgtttcctcagggatctagaactggaagtaccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtcgtttgtagggacatggatgaaattggaagtcatcattctcagtaaactatcacaagaacaaaaaaccaaacaccgcatattctcactcataggtgggaactgaacagtgaaatcacatggacacaggaaggggaatatcacactctggggactgttgtggggtggggggagggggaagggatagcattgggagaaatacataatgctagatgacgagttggtgggtgcagcgcaccagcatggcacatgtatacatatgtaactaacctgcacaatgtgcacatgtaccctaaaactttaataaaaaaaaaagtgaccattaaaaattataaaaagcattttaaagctcatgcgtcatcaaaacatagacagcaggctggatttgaccaacgggccatagttggccagcactggtctattagatcattggccacaatgctcagataggagcagttttatgtactgactgcagcatgttatcatatgtctatatctgaagtccactctcaaaatattaactcacacttattaatcatcaccttgaagtttgattatagggacagaaactaatcatgggtgatgggtctgatttcacattttgacagcatagttcatttctcccaccattaagaaacaggcaacctcagacagacacttggtaattaaatctagctcaaaatttggttacagtaatttttaaaaagcagtccaacagaaaaagagtaaacgaaaaagtgccatctagacattgactaaatattggagggaaccatcttggaatggctactttcattatgttagagccctgataggtgagaggagagggggcaaggggagacggagatgggaacagaagatttcccagatgaggggcactccctggagctgagtcttggagccagatggacttgttcacaccagcatggagtgaaataaggagaatcagaggacctgggctcataccctgtctctagaggctccaaaggagtccctgaggtaaaactgagattattctagagccacctggaaacaaaaagacactctggaccaggcttgggacattttcctgaaggtttcttccacctctcattgccctttctgtcattcctgaatttgagaatggggctgtgataacaaagaaactgaaagaacagtgtcaccatgtgtcttacatatcaccatgtgtcagtccctagaaaacgtactttatatggcatttgactttgataggaatctaatgaggtcagtaaagtgccctggttacagagatagagacctcaatgtcactaagatttaaacccctatcagcccatctccaaagcccatgcattttttctcccactatacaaatcaatattattgatatttatatgtgtggtaagcttgcagaataaatagattttgaactttctttttaacacagaaaagcaaaatacagtgaagttttggtggaactttcattctcatcaggccataggcttcagtgccgcattatcatatgggccaggtgggctttttccaggttactgagcccagtggcttctatagctcggttttaggaggctatggagaacagactctctcctgcccttggggggaaatgcaaatcaatacaggtcatttgttgagtattttgtcaataagaatcaaatggctttttaaagtacccctagtgttttttgatgcagaagtttcttgtgatcaaatacgtgtgcaaagatccagcaacaagggtttttgttggatctttgtttaaagcaccaaatgaaatggccaaccagtgggggtttgttcagtaaattatggtatattcctacactggtattctattaaatcatgtaaaatgatgtggcaaaatgtttaataatatagaaagatgttcaccatgtatcagcaggtggtttgcaaaatactccttaagctgtgatacttctttgtttatacacgtagagcatcttggtccaaggtacaaaaggatttgtgtgatgttttaggagtggtcctgttgggactatggttgattttaacttttccacagtgcagtgtctgagatgaccgtcttcagatctgggttgcttgagtctgaactttaacttcacctttcaccagccttgtgctagagaaacatcattagcttgaacaaccagtaaccataattatgatttgcatgtcataaaacattcttctctcatatcattgttaatgctccctgagaattcccttatcataatatggagaacaaatcccttttggttaaaactatgccttggtttcttcaactgtaaatcacagtaatgcctctctcaaagggctgtcatgaagagcaaatgaattaatacagcacatgcttaggagggtaatagctgagcatgagctattgctgttatctgtattttctagtttgggtgcagtggccacatgttatttttgtaatttagaaaaccaattctgttaatctttttttttgagacgaagtctcgctattattgctcaagctgtagtgcaatggcacgatctcagctcactgcaatctccacctcccgggttcaagcaattcttctgcttcagcctcccaagtagctgggattacaggcgcctgccaccacgcgcagctaatttttgtatttttagtagagatggggtttcaccatgttggccaggctggtcttgaactcatgacttcaggcgatccgcccacctcggcctcccaaagccctgggattacaggtgtgagccactgcacccggcccaattctgttaatcattttaaaaagcagttgtatcagtggtcgtaaggcaagagaaaggttaggatataacaccatgatgggtcaagcaacactatcacatttgaattcagacactagtttctttcttctccttcttcttcttcttcttcttcttcttcttcttcttcttcttcttcttcttcttcttcttctccttctccttctccttctccttctcctcctcctcctcctcctcctcctcctcctcctccttcttccttcttccttcttctttcttcttcttcttcttcctcttctcctccccctcctcttctcctccccctcctcctccccctccttctccccctcctccgcctcctcctccccctccttctccccttcctccctcctcctccccctccccctcctcctccctcctcctccccctcctcctccctctccctcctcctccctctccctcctcctccctcctcctctttttttttttgagatggcgtctcactctgtcacccaggctggagtgcaatggcacgatcttggcttaccacaacctcagactcctggattcaagcaattctcgcacctcagcctcctgagtagctgggattacaggaaaggcacccaccatcttgcccggctaatttttgttttatttttgtggagacggggtttcaccatgttggccaggctggtctcaaactcctgacctcaggcgatccacccgcctcggcctcccaaagtattgggattgcaggcataagccaccacaaccggcctagagactggtttctatatgagccagtttatttgttgaccaaacagagggagttgtgccaggaatcatggcctccgttaatgtttttaagattgcaggggaagcattccaaatgttttcaaaggtgtattaaggtaagtcttgtcaaaacattcccacttgaaataataagcattcttatttctttaagtaacagagacatagcaatggctttcctggctaaacgtgatcatcacagacacactgaccagctgtttatctttgcttccacaaattccaacaggcaacttaatagacattttgtggttatatgtttctaagacagccatgggaaatgaatttatttctacctttgtgaagaacagctatagaaatgaccattgaaattcagtgaatggcatttctgcttatgggccttaaaactgggaaccaaaattaaattcttttaggtattttctctcccgtgtcttctaaattgttgtgtgggctgatttttctccatgaaagactctcagagtcctaaattcaggttttctgtctccttgggctctagcattctggaataagcaagagtcaagagattctccattcttatttcctctgcatgttagaatatctaataggtgtgagacagtttatgttgtgctcagcattggacagccaccatgtaaacaattacggcgttttttcatccaggcattacattaggtccataacactcacaggagctctgtaaggctgaaattgccacatccattctactaggagggttatggagttcccaagggctgacctgcctttcctgagtcacccactggagagccagggcattggatttgacctcatagccgctgctctatccactcccttgggctattaaagaaaagcacgggacatattgatggaaaaaatctgacagatgtctcaaggacaactttatcttttatcagactcatttcagggatttctgtattcattgctcctggacttttcacatatttggggagcttgattgagtttccctcagctcttccattagaaagcccatgtggtacagtggctcagagcttgggcttaggaattcacaaatgtgaatctgtgaatctgagctctgcatcttattacttgtgtggccttgggcaagtcacctcacctacctgagcctaggtttctttggctgtaaaatggaactcatagcacggcctgtgtggaagacagaataatggctcctccccttcaaagaagtcctcatcctaattcccagaacttgtaaatatgttaccttacagggcaaatgggactttgtagaagtgattaagtcaaatatattgagattggaagattattctgaattatccagatgggcctgatataatcacagggtcttaataagggggaggtgggaatggctgggttggagatttaaagatgctctagtgctggctttgaagatggagcaagggcccaccatgcaagggctgtggacagagcttctggcatctaaaacaaaaaaggaaaaaaaaaggcaaggagagaaattcagaaggattgcagctctgcccacaccttgattttagcccactgagacccactttggactcctgtcctgaagtgtaagagaataaagtcacatggttaagtcactaaggacatggcagtttgttacagcagcaataggaaatggatgtaaccttttttatatggtttgtgggcttgaaagagatgacgtgttaaatacagtagcttttgaccttgaaagagacgatgtgtgaaatacattagttttgggggcttgaaagagatgacaggtgaagtacattaactcttgggcatgaaatacattagcttcatggccgttagcattggccatgaagagctcttgaccaatagtagctggtgttaccaataataaaataatggtgagacttgagatgacacaggagtgttctaacagaggcacagtccacttgaccagatctttctcaggcatctccatcgacagtggggtctccctagaaggctgggtggctgccatcccacccaaccagcctgcctgagttggtaaaagtgcatgaaagtgttcctctcagggggtggccttccattggccctcacaagggcacagcggagctcgttggttatgcttcagttacataaatccagccttacaaaggctacacagagagaggggctccttgcctcctagatctgtaccttgtaggtgctcaatacacattggtaagaatgttcacatcatcaggtaagcaaggggtataaagtgaggccttgaatcgctcacgtagattcaagtagtgttgagaaactaagaagtggtgaattgtacccttttttcccctcccaaattagaactcctaagaaatacaggacaactggagaccaaaccgtaggtttcattacctatgaagctgattaggaaagccttgagtttgtacccaaataaatttgctaatacttttacctaaattagagagattcggatggggtgggataacaacacgccacatctacctgggtggagcccatctcaggatgcctctgcccaggaggaggggcagtgagaaggaggccggaaggggaagagaaacaggagagggaaaggaggaaaggagacatagctagggagatgccactcagcaatcagaaacctccattccttttcctggggtggagtggaggaaaagggaaggggcagggaggctcctagcccacaagccacttttgtgcaataggaaaagatgcttgaccagtgacgatgagcttttttccaaatgttttttggccacagaagtgtcttgagaagtttctgttcatatccttcgcctgctttttaatggggttgtttgttttttttcttgtaaatttgtttaagttccttgtaaattctagatataagacctttgccagatgggtagattgcaaaaattttctcccattctataggttgcctgttcattctgatgatagtttcttttgctgtgcagaagctctttagtttaattagatccccatagtcaattttggcttttgttgcaattgcttttggtgttttagttggggggtggggggcaagggaagggacagcattaggacagatgcccaatgcatgtggggcttaaaacctaaaatatgggttgatgggtgcagcaaaccaccatggcacatgtatacctatgtaacaaacctgcacagtctgcatatgtatcccagaagttaaggtaaaatttaaaaaaaggaaataaaagatgcccgttcctctgaatggacatagcccatgccaagggtaaggcttggtgagtggaacaggctggattttaatcctcaggttgctgcacccttggtgaagcacagggcactagagaagagtgttcacaacctccagcccctccacaaagaagcctgattctggaaagacagaggttccaacctcacccttacttctcttctgaagatctgctgtgcatgaagcattttggaggtatttcttcagctcagaacacagcaactttcctatgaaagagagcacaaagggttaatgccaccagaagacactcagcctgtccagtgtcgctaccactgggacgggcaatgggaggcatctgaggctttgctgacaacttcttctgctgtgagggtggaaagcaggccagatctttatgacctggactccacgttttgggattctagcaagatgggacccactccgggtgctgtgcccattctcagtgccagtggggctgatatggggtcatggcaggtagcgggagataacagcctcatcctcaacactagacatccagacagagtggctcaggccctgtaagcaactggtgttagggcagataatgagattttctggtgtctgcttggtgacaagagtagtggcttcaaggaatttttttaaaaaataacatttgtttatagttgtgttttttaaagtagaaaatatattcatacgagcaagtaattagtgtcctgccaggtaagtctcatggtgacatgtcaacgtaattattttttaaagtctgcctcaaataaagcatcaaaatttcctgctttaaatctcctttctctgtaaaaatggttaagaggagtgaaaagagaggatgggaggggtctgagagcattgatgcctcatcatagtcagccagctgtggcaccacctctgtctttgcctgtcactctcatacaaaggatgtgcataggaaatgtgatcctacccatcctcaaattctagatttggacttgaatttggtgctcttatttccacattaagttaaaatctagcctccagatccccaggcttcccctcccattgtacccagaagaaacaagaattgtttctcagttctaactgtcataatgcctagcgggcgttagcctacaacgaaggataattcaatctatcctcaccttagtgtacgctggacaacactaggactcagaagtgctttgctcttgatcttgaaaggccagtggaaatccatgcagattcctcccccaggaccctcccagccagcctgataatgaattcatgggaaacagcctacatgtgagcaccaaagggaacacatttagtaaactctgccaaaggagcacagttcttgtaaagctgatgaggtttgtgattaatccttttttttttttttttttttttttttttgagaaggagtttttgctcttgttgcccaggctggagtgcaatggtggaatctcggctcgccacaatctccacctcccaggttcaagcgattctcctgcctcagcctccggagtagctgggattacaggcatgcgcctccacgcccggctaattttttatttttagtagagacggtgtttctccatgttggttaggctggtcttgaactcctgacctcaggtgatccacctgccttggcctcccaaaatgcctaacccagtttaaagagatccaggaagcagattgtgagctgcagatatgatgtgattattaaaagcagcctccattgccaacattgcaaacgcatcagcatgttccttccttcaacattccataacgtggtggtggtattcccaccttaccccgggagaagctgagagtcacagggagtatttactttccaagttcacacattcagggaatgggtagaagtggaattcacacccaggtcagtgtaagaccaaagaggctgtcagaatggtttgctgttccactcatggcaaacaggatttgaagttgttccagtccaagggagaccatcaggccatgcaggaataaaaaggccaaggggaggaaagaagatgctgtcttcattaaggcctgaaggaaaaggctggtcagagtgaagagtatagacaagctcctctgtatcctctcaaagatttggagccactgatctctctgggggttggggaatggggcagttcctgggaaagggacttattggtgggaatccagttctgctatgaatgctcctgactcctgcactcaaatcccaacagatgaaagggaggagagactgacagatgcagtgccttcctttatgtaacctccttgatccaaactacagtctgacccatgctttctggctttatattgtaccactacgttcctaactcaccctcgttccaatggcatcagcattttctcttccctcaaagataatgcacttctgacttttgcatattatggtagccagcccccaggagggctcccagtgattctcacctcatggtacccatgctcctgcgtggtcccctcccacatcgaataggaatgacttgtgtagccaaataggacatggcagaaatgactttgtgtgaattctgagccttgtttattcttgtcctttcttgctacaggcaaagccaaatgccgtgttgtagggaagctcaagtagcttcatggagaaatccacatggcaaggaactgaggccacctactaatagccagcatcaattctttagccgtatgtgtgagccaccttggaagtagaccttctagcccccatcaagcttttagataactgtagcctcaccaacatcctgactgaactacacagctgagcagcttccatatctccaagccacaaacactgtgtgcaatcataaatgtttttagttgctttaaagcactaagtttggggtaattttattcagcattagataactaatacacatagtctgtttcaccagctaaaattgctgctcatttctctgttaccccccaaacctggtgtgagcagcccctcctctgtggactttttctggtcttctttgcatgactcaatccctctttcttcattttctcacacagattgtttagcattctattaatgccactgtcacaaggaaaagcaatatttttattacagtctctctcctctgtcgattctaggcttcttgagaaagtttgtaatgtatgcattcttcaaagaggtattgttattaatagaggctcagaagatggctgaatgaatgaagagtgtgtgttagaacctggggaaatttaaaccaaatacatttaaagccagtgacattttcaaagcatatttggctagaaagactaagttctttaaagtagtttagaagcagtattaatggtacacagtctttgtcccattcttaacagtacaataatgataattggttgctactctggaaacaaattaaagagcccaggaaacgtttccaaaggtgactggaatgcttaactgagctagactgttaatatctaatgctagccttcctgtgggcatagcaccctgaattgcctgatctcatctaatggcacatgctcagacatccttggttttaaataaaaattgtcttatcacttagtttaaaaatgttttgcttagtaaaaaatttatgagggcaggtgcggtggctcatgcttgtaatcccagcactctggaaggccgaggcaggcagatcatgggctcaggagttcgatgccagcctggccaacatagtaaaacccgtctctactaaagatacaaaaattagcagtccgtggtggcgggcgcctgtaattccagctactcaggaggctgaagcaggagagtcgcttgaaaccgggaggcagagggtgcagtgagccgagatcgcgccactgcactccagcttgggcaacaagagcaacattcggtcgaaagaaagaaagagagaaagagaagaaggaaggaaggaaggaaggaaggaaggaaggaaggaaggaaagaaggaaggaaaaggaaggaagggaggaaggaaagggaaggggaggggaggggaggcgaggggaggggaggagaggggaggaaagggaagggaagggaatacatttaataaatgtggagtctgccaaatcaggtcggcagtttacttctcctgtccccggttcaataactcacttactggggttctggaggatagcagtgagaagatggggtaaaaaattagagagaagttttgcgttgccccatggctgcttctgtagtgtagtccgtgcatccgcccttcgatgcttgggttggatcatagagcagtgactgttgatggctcacccagatccccaggaacccaccactcccatacaggctttcaacctgttaatccctgcagctgcctgcctggactttcctctgaccatgggagtgtgctcagtcttactgcccagggaacagccatcagcctttgagtggcaagagttggtagattaccatcccttcttgacccttggaataggacaacttcgagatatgttctcccgagtctcccagatgaccccagtgagtttgaacaccagttgtccacagagataatctgcccattgccacctgtgtattgactcttttacatattctgtctcacttctctttctccctcacttgtgcttcttaagattgtatcctgaataagctatttgcactcaaataggcagagagctagctggatccattattctctcttgtcttctatattttagatatcttgtaacaggcacaaggtaccgtgtagagctgaggtgtaatgacccagctgatctgtttgtactttctcatgctgctaatgggtacctggagttgagaatttatgcataggtgtgtacatgccatcacagctctgtgtgcatgagtgcctgtggggtctgcatagcatgcacacatcacagaaaccctctgccctcccttctcattcctctatttgaagccaagtttccataatccctctactcaacccccttcttccccagcccccaggggcttcccatacttagggtcaccctttcttacctcagagtttcaaagatgtaagagctgatgcccaccttgatggtattcacaaagtatagcagggaggcggccatggaaatgactctttacagcaggatgatatgtggaacatgccatggccagggaagtaactttgtctcaaggggatcaggaagatgcccaggtatgggataacttgagcaaaagatttttgagcactgatctgcagattttactctctgtaaagggccagatagtaagtattttaggctttgtgggccatatggtggctgctgcaactgtgcagctttacttttttgtagcacaaaagcaagcatagataccacataaatgaatgagcatggctgtgttccaataaaactttatttacaaaagcagatggtgggccagatttgtcccattagctgtggtttgctgacctctgatttaaagagtgggaagtagatttctggaaagggagaaaggaagactatttctagcagagagaagaaaacatataaaggcaaagagtgggaaaccagagggaataagacaaatttgatttaccaaaaagtcctttttggtggtagtaaaaaatactaataataaaaactaagttttattaaagccttattatgagtcaagcattgggctaaatattttgtggattctcatttaattattactctctctgagtttggaggaccttgttttcctcatggcacacacgaggagtaaattaagctcagagagggtagatgactggctcaaggtcacacagctaccagctggccaggtggcaagaccccggacagaggattgggagcatggtattgtagccagcgtacctccttgtgtctatcattagccctgctttaatggactttttcagaagtgtttttgcttgtgttttacaagtggaatgtgattccttgactcagcccagtagccctgtgaatggatggctgaaacgagtctgacggctttttctcctggggccattttgtaagaaataaaagcaaaacagtgagatatttaaattcttcagggatattattttcgagtggataaagtgaagaacattttttattcatattagaagtgatagttggatgtgtgtaatttttttgctctccgagatggagagagaacacagcacagatcttagaatgtaaaatatgaatttagatgacattttgagaaaactgataaacaccaccattccacaattggacttaacttgcctgtgaaaatccttctgcagcccacaaaatgatagagataggtggactacgtctaatggatattaaaaatacacaacacaccaatgaaggaataattttcttttgcaaagttttcatttctcaaaatgctaccaggaaaagagagataccttgacagctgacagtaaccctgggaataaggatatgttagaagagaagggctgcagtagttgtgaaatcctacctggaatctacccctggacaggagacccagggatcaagactcaaagctgatgctctcaacaccaatgtttcatctccagtgtaccacgaggtccttgtccacctacttctagatagagccaaactgtctaagccaaagggggtttgggtttctttcaccacccacctgtgcacatgattagtttgaaaaagtatgtcttaaagaaaaataaatgcagacaactaagtgagaacagttacatgtactaaaggtctttcagaaaatcagtaatgtaggtcagtgcatttcaggatttggaatttcacacaaaatttacccttgaaaactttagactgagagaagactaccatgcctattctgtcatgtaaggacatctaaagaagaactgcacacattggtattaccatcttcccacacacatacacggacacgcacgcatgcacacgtgtgtgcacacacagacacgcacacacatgcacgcatgcacacacacatgcacacatgcacgcatgcacacacatgcacatgtgcacacatgcacgcacatgcacacacgctcacacacacagaatggttcgtggccgggtgcggtggctcacacctgtgatcccaacactttgggaggcctacaagggcagatcaactgaaatcaggagttttagaccagcctggccaacatgacaaaaccacatctctactaaaaatacaaaatttagccaggtgtagtggcaggtgcctgtaaccccatctactcgggaggctgaagcaggaagattgcttgaaccagggaggccaaggttgcagtgagctgagatcacgccactgcacagcagcctgggggacagagtgagattccatctcaaaaaaaaaaaaaagtttcatactttcactcacatatacactcacacactcgcacatacacctacacatacactcatacattcccatagaaacaagtgagttataatctcagagtgaacaaaattgagtaaattttaccatacaaacatatttattatgcttgtctcactaaaaagcagtaaaaattctgatatgagcatcacacaggttaatgtaagatagtaagaagaagaaaaaagtataattatcctagaagtcctattgaagaatgaaatcgcaaaataaaaatggaaggggcaaaggtaggatccttagaatgcttacaatgggaatctgaatgtttaatgagaaataagcccgacacccatagcacataaggactcaggctttgggatctctcccttcctagctttgaggcctgggcatgttatttaacctctcataccctcgaaaggggctcataaaagcaatcactgcatggggcttttgcttggtgaatagttccagcacatggttagtcctcagtaagtgttagctaatagcattagaaactagcttttttaaaaaataaaggaaggggccaggcgcggtggctcacgcctgtaattccagcactttgggaggccgaggcgggcggatcacgaggtctggaggtggagaccatcctggctaacacggtgaaactccatctgtcctaaaaatacaaaaaattagccagacatggtggcgggtgcctgtagtcccagctactcgggagtttgaggcaggagaatggcgtgaacccgggaggcgaagcttgcagtgagcggagattgcaccactgcactctagcctggcggacagagtgaaactccgtctcaaaataaataaataaataaataaataaataaataaataaataaataaataaaataaaaataaaggaagggctgggcgtggtggctcatgcctgtaatcccagcactttgggaggccgaggtgggtggatcacgaggtcaggagtttgagaccagcctggccaatatgatgaaaccgatctctactaaaaatacaaaaattagccaggtgtggtggcatgcgcctgtagtcccagctgctcaggaggctgacacagaagaatcatttgaacccaggaggtggaggttgcagtgagctgagatcatgccactgcactccagccttggcaacagagtgagactccgtctcaataataataataataatataataataataatagtaataaagaaagtacatggggaaggaatatgttctacatgagctttcacaggggcaccgatctagaccagtgtggactagaagtagccacatcccctgagatcctgtcggtaaaacacattctcgggcctccccacaaacctcttgatttggaaccctgggaggtggcacccaataacctgtgttttcaacaaaccctctagatgatgccaagccacactaaaatttgagaacctctgatcaagccctgcaagctttttaaccctggtcctgggcagtcagctaaatccaggaagtatttcgcagattgggaataaataaaagaagaaaaaaaaaaaggcataagtgtctttgggttgaatctcattttaagccccagaattaggcttgtgaaaacaattcaagaattgtcttcgagcctataatgcctgctagtcccatgagaaaaagattttgaaacaaaataagttgaggttggatttgctttttttccaagcttcaaagcatcaaacaaagatccatgttcacatctgaatatctgagttcacatctgagtcagccgctgactcagcccctgaccacagagtgatgaacagagaggcaggcatcatgggacctgaaatggcattttctccaaaatattagaacgtccttagatcccttagatcaatggtgatcgtgggcctggaaaacttctccaaaaagtgcaaacttctcctgtagttagcatattagtttgttctcatgctgctataaagacttaccctagactgaataatttataaaggaaagaggtttaattgactcacacacagttctttgtggttgggaaggcctcaggagacttacaatcatggcagaagggaaagtcaaccgtccttcttcacagggtggcagcaaggagaagtgctgagcaatgcgcagggatagccccttataaaaccgtgagatctcttgaaaactcattcactatcatgagaacagcatgagggtaactgccaccgtgatccaattacctctcaccaggcccctccaacaacacatggggattatgggaactacaattcaagatgagatttgggtggggacacggccaaaccttaacagttgggttcaaagacaaatgccaccataataggccgcagatcacctttattgccagcctctctagtccccaagtagctgataaaaacatagacaaaaattatagagaatgaaggaaaaaaagtaaggggttattttgagagcaaagtttgcctcatctgtccaatagagactgtcttgtatgttaaaagttcatcatcaggagctgaaagaattgaaagtaaaatgaaactatcttgtgtgcctcgtaggaatacaacctggacgtagtgtccattactaattaaagccaatgtgtattgtactttcacagtgagacaggccctgctctttgttctctatatttatttacatgcacttaatcctcacaattactccatgcaataaatcccattatcactttctgtactaggttgactagggtcctccccaaattcatgtctacccagaacctcagaatgtgtcttttcagatgtaattagctaagatgaggttatgctggattagggtaggccctacgtccagtatgccttggagtatcctcataagaagaggagggccgggttcggtggctcatgcctgtaatcccagcactttgggatgccaaggcaggtggatcacctgagttcagaagtttgagaccagcctggccaacctggtgaaacccaatctccactaaaaatacaaaaaattagccgggcatggtggtgctcacctgcagtctaagctactcaggaggctgaggcatgggaattgcttgaacctgggaggtggaggttgcagtaagccaagatcataccactgcactccggcctgggcaacagagtgagactccatctcaaaattaaaaagagaagaagaggagagagacagagacacacagaagatccaggagagaaggccaagtaaagttggaggcagagagtgggatgatgagtctataaaccaagaaataccacgggtcaccagcaaacaactagaagctaggatagaggccgggaacagatgttccctcagaacttccagaaggaaggactcttgtagatgtcttcttttgtgcttttggcctccaggactattagagtaaatttctgttgttttgagcccctccggtttgtgacgtgtagttactgcagctcctggacactgagatgcccctgtttcttgatggcgaaatggagactgaaagatcatgtcttacccaggtgcacacagccagcttttggaggtttagggtcagaggcagcttcgggggtaggaatctagaatctggtttcctcatcttgtgctgtgtcgtaggtctgctgggttcaggttctggagacgtcattccatgtttctgagctctcttttctcccctgcagatgtaagaactctgtacttgaggactcatgcctcagctgggtggtgggattggattccttttaaggtctctccaaaccaaccctgagcctctttgattagaattctagaagctttgaaaccaccactacaaaattcatttgcacgacatttctcttttaagcattacacttctctctgcagtaactttgaagttactgtcgttttatgcactcacgaagagttaacaagcaataataaacagtcaagactgcttttcatttcacatatctgcatgtgttcagtcttttccgtgacacaattgaaggagcttctgtaatcaggagagaaactttatatcatgctgtaatttcccttgatacaagctagaaaaagatactggtttagattcactggggtgattgactagaaaattgccccagctgtcaaagtttccagtgttaaaaagcagtgtaaaatttctcaaatgcttagaatttctagatgtcacaacagagatgttaccaaaatatgagaatcaagttttttataagcaggacaaaaatacattatttttctcaagttctcaatatttggttgaattcatgaagaaatttttaaaacacaccaagcaaagcgttcattttgtttagaaataaaattaataagttgttttttgatattgtattaatgtgtcctgccacattaaaagattgcctatatatttataaatttaatctttatataggaattaaacagacaagccagaaaaagaaaagaaatgataagctgatatttgggtataatattatcttgttatccatgttctttgtattagctgaattatttccatttctgctccaaccaagaaaatcaattcaaacattgttcctcgtgatttattcaaaaattcgcttttccaagtttccgtctaagagcatgtggtgggttcttatcttcatcataaaagtgtataacataaagagatgtcctcagatagctcatggcatttgttagctcaggggggttgtagaaagtttcctgtaagcgttttacactcaaagttttctttatagtgccaaagaatgagaagcaaaagcaattcagcactggaaccgtttggggagtgtggctccattctgaggttctcttctcatcagagtgggggcaccctataattttgagaccttgagccaggctttcatgtcatctctctttatgaacactccactagtttctagcctataaaaatagtgtcaacattacagtaagctaagtataaggcagaatcaagaagccaaggatctgattttatttcagagttctgaaatggaactaagtgttacagaaagcaatttgtgggaaacaattctctacagtatgacttatagactgcttcaaaggagaggtgtcttctcttcctagacctgggattttaatgtgagagctcccttatcatgttgaggagaatggctgtctgaattgttctccctcttatttataaaggcaatgatcagaagataatttgtaagtacctactctcttccaggcacagtatttaaaatgaatatatagtaaaaaagccagctgcctcccctgtcatcatggaatttataacttagtagagaagatgtcaaaaagatattgcaaatgatctgagtgttttttacaatggcattgttgtgtacaacaggtggattcccaccttgttggggaaagcaaggagtgctccctggaggaagtggtatttattttgagacctggaaattgttagccaggaaaggagataaagtggcgggagtgagagcaaaaatattgtcaccagagaaatcagtgagtgtaagaaattgctggtgtagttaaaaactgaaaaaagtctggatacattgactgtcgtgttttcccagttgtaggtcttgtaattctggcaaagggaaatatgaagtgaattcctggaatctcttgctgatcccagagagactacagttctagcataaaaggaagctcaacagggtgactgtaagaggttccagagcagcaggtcatactcagcttagaagtgcttgcaagacagtttaaggatgtagactgtctaaaagaggctcataaagagattatcaatctaaaagcaaacttgaaatattaatcagggctagattaggttatgctgcagtaacaagttaacccccaaattttagtaggcatagcgcaacaaagtttctttcttgctcaagctgtgattccaacatgggtctgctggggagctctgttccacgtagtcattaagggatccaggctgacagaggctctgccagcttgcagcatgtggagcactggcctcctttgtgcctgtggcagaagaacaaagagttacagtatcaaaagcagcccttaaatgcttcaaccatccctttggctagaactagtcatgtggccccacctacctgaagggagggtgagaaatgtgagggaacacgtgggcaatcaccaggaagttcctttgtttgttgcagtgacagtctggaaaacaatgtgaactggttgacaagcttaaaaatggatctaagggcaaaaatgctaaaggagagaaagaattgttgacagtgtataagaagatgattaggaacaaagtgagatgggcagtttggaggctctttttttagctttaatggtaatagaatacacgtggcactctcactaaatgcaaggcattgggctttatgtagattgtcccatttaattttcacagcaactctgaggtcgatattattatcgttctcattttacagataagaaaactgagccctggggtgatgaagtgactaaccccagtgatattgtctggctctgtgtccccacccaaatctcaccttgaattgtagttgtcataatctccacatgtcataggagggacctggtgggaggtaattttatcatgggggtggttaacctcatgctgttctcatgataatgagtgagatatcatgagatgtgatggtcttttgttttgtttttttgagatggagtcttgttctctcacccaggctggagtgcagtggcgtgatcttggctcactgcagctctgcctcccaggttcatgccattctcctgcctcagcctcccaagtagctgggactacaggcacatgccaccacacgtggctaatttttttgtattttttagtagagacggggtttcatcgtgttagccaggatggtctcgatctcctgaccttgtgatccacccgcctcggcctcccaaagtgctgagattacaggtgtgagccaccgcgcccggccaagatgtgatgggtttttttttgttttttgttttttgtttttttttgagacggagtctggctctgtctcccaggctggagtgcagtggtgcaatgttggctcactgcaagctccgcctcccgggttcacggcattctcctgcctcagccttccgagtagctgggactacaggcacctgccactacacccggctaatttttgtatttttagtagagacagggtttcaccatgttagccaggatggtctcgatctcctgacctcgtgatctgcccgcctcagcctcccaaagtgctgggattacaggtttgagccaccgagcccggccgatgtgatggttttataaagggcttttccctgttttgctcagcacttcttgctgctgccatgtgaagaaggatgtgttggcttcccctttcaccatgattgtacgtttcctgaagcctctgcattcatgctgaactgtcaattaaacttcttttctttataaattacccagtctctggtatgtctttattagtagcttgagaacggactaatataccagactctacagtttgtaacgtaggcactaggattcacagatcctaggcacctggttctcagattcgctaaactttaccattgttctttgtccgtagcctggaagcttagaatctggaaggatagagaatagagttttatagggactgggacacactggaaatttgaggaattttagttaggttaggaggcagttcctacatataggtggaaggagaaataccaggagtcttgtcttgtctcagcctaacaagatgacttctgagaatatgatcaggcctgtttccgccctagcattggagtccagtgatatccaagggcctttatcaggaaaactgcaacatatgaacacaacacagcctctgttttggagtccccagaagacagctgattggtttaagtaatagtctagggacaaagaaagaactaatacttcaatgaaaaagaaacaaatacttcaatgaaaatgaatttcatatcgcacttctacattccttatttgagggtatttgagcaaactaacagaggaagaaaattagccactttaactataataccttgagtattagactaatccagttataagtttacagaccctttgatcagaagtcagagaagttgcctaggaaatgagttaaacctatttctaaaatgtccaaaattagctgttcaaagaaatcttttttatagagcctaaaatattctaggcaagagataatgaaggatgctctagggcaatggtgcggggagaggaaagaaaggtgcctcaatacaagcagcatggcaaaggtacaatcctcccagtgtgaatggtggggggaacaaggggaactgaaaaacatgcatgaggacgttagctttgaatgggtttcttagagctgggggacaaaggaagagtcgcagatgatcagaaaggagatgtgaaatcttctgcttgctatgttgagtttgaaaaataaatgaaaaaatttcaggtaaaaacagcaaatcatagcaaataaagatctcatattcaggaaaagggctaggcctgggtaacttcatgatataaatgttcaccattgctaaaacttaaaggactgacaatatcaagtgctgacaagtatgtagaacaactaggagtcttgcaatgtttttcaaaatggtagccccagtcttgaaacaatacatatgacttctaatgacagaataagtcaatgactagaggtaaacagtgatgaaaaagaatgaatatggttgacactcacaggctctaagtggagcaaaagaagccaagtgtacaaaaaagtacattttgtatgattccatcgtttatgaagttcaagaaaaaacaaaaaggatttatggtgatagagatcagaatagtgactaccttgcagagatggcagttaggagaggacataggaaagcctgctggagactgggaatgttctctcagtctgggtattagttacatggatatatacttaagtgggctgcagggtttgctctgagggagcaaacacagcttgggctgtgtttggccttgaatattgtgaataatatgtttaggcaaaaatcctctgtgtctcgacgtcattgcatggatccactctatggttggccttagagccaggttcttgtttgcatataattttgcggaagtgtttatgtttgccgctcaattgccaattttgattacagcttctcagcctggaaaattgtcctggaagggcttaatggaacacttgcaggaatgtggcatcatcaattttagagccagaacaggacgtggctagcttttcagctggccgggaagagcctggagagtgctgagggacaccagccagggacaggcacaggatccaccacatggctctggcctcagttctgcccagctcaaaatcttcatccaagttttatttaaaaatcctttgaagggagagcaatgggctgccccaccaagagaagtgttcacaggaagtgcctctcctcaggtttcaaccatcgcctcccaaacttcaattttttaaatttcacctttgtaatgtctgctatttctaacatctgttctaatatatacttcatgtgctttttaaagcaacatgctctcttttacttcagtaaacatatttaggtaagacataccccatcaccacagtgccacagtaaatggaaaaccagcactttgctaacacgttttaaatttaaattattgcatgtactgccttgcgtgttagctctcagtaattatttttcatcctcttaggtttcttccagctttaaggctttattattttaagttataaagtaatcggccaccctgtatgactgtgaggtccttcaagagagaaggtactctttgctctttgaaatttaggaaaaaaaaaaagaatggaaaaaccaataatggaaaaaaaattgtatttttatgctaatagagtagtagcggccaggtgacctttagcaggttccttaatagtgtgtcaccaccaacacagtgtaaacaccaatacggtgtcaacaacagcaataaaatgcagtttaaagacagcttatcccagggtatgctatgagaattggatgagaatattgttaaatcccttgtgagttttaaagggatgtaaaagtcttagaaatattgatgtgatcattggcaaatgcagatggatattagagaaatcaatctaaattgtatatgtagacaccagccacccccggaaaagaacatgagtgggtaattcttccacctatgggttttcccatgggatgcaacctgggtgcatggaaccagccctggcttcagagttagaggggcctggctagtgctggttctgccactgaccttgacctgagtgaccttgaaaaagaaatctaacctcttgcattttcaataacttcacctataatacagggcaaatcatcctactatatgaggtcgttgaagtttaaatgaaagagtgtagagtctgcccttgaaacacgttgttatttttcaagcgattttctgaagctagagcccctcatgtgagggatggagagatgaatccatcagctgttaaatgcctgcattcgggtgccaggccaccttccttcctaggtaaggtctgcaaatccagttctcccctgctgcgcagagtgcaggtccagctctctgcccaccgggtgctgtctgtttagaggagccagctctggcttgcgctttaatgtcatgtttaatgcctgctctgctgcagcctccacatgtttattgaatctttatggaaaggccataacagctgcttcgggtccattataatggatcacgtcaaaatgtagcctgccattgttttaaagtcatgtattattcacttgatggagtgtatacgtccatcttatgtcaatttgtgttatggactgtcaaaattaacatgagtatatgaggtaaggcatattggggaagaaagttccacagcgcaatatgcaaccgtggagtttctaatcttaataattcagtgggtgccaacaagacgtggtctctattacagacttgaagctggtaatacttcatttttaaaaatgtaaccatttttgagttacaggaaaacaaaaatggtctgtggccaataaatgtctagttttataccgttctataaatgaaagtaataaagcacagcaaagttgccgagcgcagtgggttcttaaacacctgcagcgtcatttctcatcagcaggtgggcggcagagttcacatccctgggccctgtcggggtctggccatctccaggtggtgacaggtggcatcagactggcctgaattcagccttggggctgtgcattctcctggggcttattacagaggctctgacctccacctataggttcaattcccctccaccccaaggacttaaagaatttttccagacactttatgactcaccacctagtggctcttcccagtgtgactccagctagccacaccaagtccctttcagactcatgaccttagcaggtgctgttccctctgcctagaactttcttcctttatgtcctcacctggctgaattatactcacccttcagttctgctgaaatgtcacttctccaaagaagcatttctggacccccggcctccctattccaccctcctctggtaccccttttataggtgcttcttcctcatgcacctgtccaggttgtatctaaattagtaataaaagtttgatgtcatcctctctacccacaaataatgagtgcaggatccatgtctatggcgtccaccctgtagctgtagcacttagcattgtgcctgtcatgtccataataggtgctcagctagcatttttgaataaataaatgagtgcatggatggaagaaagcaaggttgtctggcagactgtcttggttgaacatgatttcctattcatgatgacctagcccatgctcttcaatcctgatagcttttttagattttttaagcccaaggctctgtcttgtcatatgtaccctacccttttcattatccttgaagagaaactcacctcccaccctggaatccactggagcagcctgtaccctgccaaccagtgccccccacaccaggactctctgccacgtgtgtgtactcaccaagtgctcctccatttcccattcctgagttggatctactccagggtcactcccttgcttcatggtagacccttgatgtcagttccctggcagctggcttgggctcttcctagcgctcagattccacctcagtgggcatgtccggttgcacatcccagaagtatatatcttccccattctgtggcatggttgcaaggacaacattgaacattgggaaaaggaggcaagaacgacaacagtccccatttcaaacacttcagtccctcgttatgcagctcctagaagtatccattgttctgggaaagatgaagcatccagaacctgtgtcaggactctagaatgaagattcaccttctctgcaccagcccagatggagagcgtcctgggcaaccaaagtccccaggagtatttgcacctctcaaccaagattcttagatcacagctcttaatcacttaccctgcagtccacccacaggagatgagctttatttcagttgtgtaaattagtgaaacagaaccccgaagagctgaaatgtcctcatatctgtcacgaccttaccatgcactagatttgtttccacagataagcttgtgggtttgcacgacaaccaagagaatttgcagttaagagaataaataatgcattattagaagaataaatcagcatgcagtgtacatgagtaatatattcataccaggcccagtgaaggagtagacacttatttagtgtgtttatgcagacatagatttaaaaatgtataaccacattattatgggttctttacaattgtaggagcaggaagttcacacaggtcttccagcctgtctagcaggtggactgagagtcatgaatttcatgtctttttcttttttctttttttttttttttttttttttttgagatgaagtcttacactgttgcccaggctggactgcagtggcgcgctctcggcttactgcaagctccgcctcctgggttcacgccattctcctgcctcagcctcccaagtagctgggactacaggcacctgccaccacacccagctaattttttgtacttttagtagagatggggtttcaccatgttagccaggatggtctcgatctcctgacctggtgatccgcccgcctcggccttccaaagtgctgggattacaggtgtgagccacctcgcccggccaaattgcatgtcttaacaccccctcttactagctgagaggtcttggcaaacctgtagcactgagagtgtcaagtttatccatctttaaatggggccaccatctaacacagaaaagccacagggatcagagaagaaatcatatgagtgggttccgtgggctgtaaatcctgaatgcgcatgagatgggaaggtcagtagaccaatgattttctcatcatagattcttgctgtgtcaacttggacaaaaaacttaattttcggggacgctgattctttttctctgtaaggagaagttattggtctgatgcacacagtggaatcaaacggcaatttacttgtaatgaaaacctctctctcccggtgtccttatagcaaccccagggacagactccagttggctctatctgtgcctcatgtccatcctttgaaccaaccacgggccagtagaatgtagtactcggattgaccaggcacctgaagtctaagacagcttccatcagtttcctgataactggcatttactgagcactttgtctgcactagatcctgtgtgtcatgcacactgacttatttaaccttctggacaacaacgtaaaataagctttagtacaaagagaagttctataacttgcctgtggtcacatggttaaaaagtggtgaagctggaatttgtaaacaggtttcttggactcctaagcctaatttgtaaatgctatgttatactgacttggttgcagtattggtgggagagggcatcctaaacagcacctgcttgttgccaagcccttgtggatttaagctcagttccttccccagaccttgtcgtgtgaacctccattctgacttcacatccatagtaggcaagataatggccctcccaaaggtgtccatgctttagtgccccagaagctgggactatgttgcctacctgagggacattgcagatgtgattaaggagtccttgagtcggggagatgattctgagttatcttggtggatccactctaatccaatgagtccttaaaatgaaagaattttttctggctcagagaaaatgtgaagactgaagaagagaacgggacagattgcagcataaaaacaactttgtccagcactgctggctttgaagacagaggaggggccacaaaccaaggaacatgggcagtcccaagaagctggaaaaagtgaagaaatggagtttcccctggagcctctggaaaggagtgcagcccttccagtagctagatgttagcccagcatcctgtgttggacttctgatctgcagaactataaaatttacagatgtgttaagacaccgtgctgtcgtaatttgttacagtagcaatatgaaagggatgtaacattcaaggcagaaccaaaaacaccaggaaatgctgcagccaccaccttcgaaccagcttcaaaggtcagccagtcatcagagtcagaagttttgttttgtgggggcggtggtggttattgttttgttttgtttttttcctctttattctgaaaagtgccagctctcaagctggggcaaaaatagctttgtgttgtagcctcaatcaatagtccgcaacctttttggcaccagaaaccagtttcatggaagacaatttttccagtgggattggaggaggatggtttccggatgaaactgttccacctaagaccatcaggcattagttctttagattctcataaggagcatgcaagctagatcccttgcatgcacagttcacaataggttttgcactcctatcaggatgtactgccattgctgatctgacaggataccgagctcagatggtaatgctcgcttgctagcccactgctcacctcctgctgtgtggcccaattcctaacagcgtacagactagttctggtccgtggcccgggggctggcggctcctggcttaaatgatgaaatttgctgccactgtttaaacactgactctttcacttccccagcccagcctgtacaatcttctgctttaccttctttaccttagccctttgtcccagtttgggaacagtgaaactgctggcaatcccagtaattgtcttgaagcaggcaggcagacagaatgggaattcaggccagggatggtggctcgtgcccgtaatcccagcactttgggaggccaaggcgggcagatcatgtgaggttgggagtttgagaccagcctggccaacatggtgaaaccccgtctatactaaaactacaaaaattaggcaggcgtggtggtgcgcacctgtaatcccagctatttaggaggctgaggcaggagatcacttgaacccatgaggcggaggctgctgtaagccgagattatgccactgccctgcagcctgggcaacagagcaagactctgtctcaaaaaaaaaaaattgttttaattaaagaataatttaaggctgggcgtgctggctcacacctgtaatctcagtgctttgggaggctgaggcaggcagatcacgaggtcgggagatggagaccatcctagccaacacggtgaaaccccatctctactaaaaatacaaaaaattagctgggcatggtggcaggtgcctgtagtcccagctacttgggaggctgaggcaggagaatggcgtgaacccaggaggcagagcttgcagtgagccgagatctggccactgcactccagcctgggcgacaaagcgagaccccatctcaaaaaaaaaaaaattaaaaattaagaatgggaattcagatacaaaaagagttgtcttctgcgttaaccgcagcacagggagagaaaaactacatctacccacagcattatagaaacggcccagggcaactacatccgtttgatggcattatagagatggcccagggcaacctgagtctgctttttcatttgtaagttagtgatgatatatacacctgacccaggtgctacgaaaggacccagtaagcaaatgctgagacaacacccagtctaggacttggcatcaaataagcaaccctataaatgccagcacctattacggttgttgttgtcatttgggtgataatggcactcaccaaattaaagacttttgagatcactggtatccatatcacactgtaaagtagaaagaagtctatattttctcagtaccactttaatgttaatttattacttaagtaccaacaaaacttcaaacaatattagagccagaggaaatattagagatcttcctcgaatgagttcggtgactttctaagggcacgcagggagtttatcgggaaggccagggctagacaatccaagttcccacagagctgataatgagccagaagtgggccccctacacacaggcatacctacttagccccatctgtatatcccaaactcacacagcctctttaataatcctcttaatagcagtgataactaaacatattcagctttaatcacacttgcacgcatgccttcttccttaaatctaagtaatatccctgcagctattccaaaaggaacactataactggctatttgccataataaggatgaggaaattttggttgatcacattttaaatgggaaactgtatttagagagattttaaactgcaaaattaaaaatgcaaacgtgaaattatttttccattaagtcttctccttggggaaatctcttcctctgttgcagttgggcggtctggatgggctggttacccttgtgtggggtgtatagtgaaacatcaactcccatgaggctcattctcaggggttgagataatagtagtccctagtggggtcgtctaagagcccttgggagggcacttatcttcatgtatatattacataaatcttatttcaaaagggatttctactataaatattagatcatctgtctctaaattctccaactgtttccatctatctctaaatttcccaactatctccatctatctctaaattctctgacagtgctgagatgtaacgaacagcattaaaacactaagcactgaaaaagagttatcatgctgaacacagtgttgtttttattctaatttctaaatccatgtctcgtttagcattggttgtagtcaagagagagactgttcaatcccagtctccccatgccttttttctttgttcattatggtgaagggatcatggctatataactgtttaattagcaggagtcaccttgagaaatgtcaccagggtggtcctgctcagttactaatggggtagttatatataaattgcttggtccacctgactgaaatatagtggattcagtttagggagtatgaaaatctcagattagaagagaagatggaggtcattccacccaaaccccctccccatgaatacctctgtcttttttttttttttttctttttcattgtagatctaggcgagcttgcttcttcaggaagttaagccccattgttaggcatctctgaagtacaagcagtacatagtatttatggttggaggtcagactctgaagtccagtgtacgtggattggaatcctagctttgcagtgtacaagctaattggatgacatatattaaacttattaacaggctttgtcttttgcccagaaattttacttctgaaaactagcctaaaaaataataaaaccttaatatttgagtttatatgtataaggatgtttgttgaagcattgttttttgtaggtacaaaaaataaaaggttagatctccattcacactacactgtactacatccattctaggaaatactatatggctttaaaaaataactgataatatctatgatttactagcccagagcaatgtacacagcttacataaagaaatgtgcatgccatttttttgtgaaaaaaatcataaaaattccctgtgtgtgtttttataggattctgtaaggatagtaaaagacatggatgatctgtactactgttttctgagtaatataaatggaaatagagattttaatacaagcacaaaggaaaattatgcataacagaattttatctattaaacgaccacataaaagaaaaatacaatattgatattgattttaaaaaagatgaaaataaatgtcaacatattgaacatttggtcaggtgattatggagcgctaatgtttttcttacatttctgttattttcatatgtatttgtaataaaataacgttattaaaatcacttataaaggaaaattagaaactacagtcctagttaagtaggagtgcaaaagaacttgtgaaatggggtcgggtaagaatctagtgacttctctggagttgcaagcagagggtgcctgatgcagacactgagctggacatgaagcatgttctctgaagattattgtctgtcttccttctaaacccatggctctgcgtacctgttcctgctggcccttgaagaggttcatatatttgaaatgagcattttgggggtgttcagcttggtgctattcatgataatttgtaataggttaaatgctttcaattaaagcttaagtcagtgaagctctcagttgagaaatatcagaaaattgagtgcactgtaaagtcagtctctgtaggtctccatagcttgaattttgtggagtcaccactgagctgaccttgtgctgagttttatgattctcatattagacaccttcttacacattcagatggcatttccagctggctgtctaaagttgcttcgtagtcacggaatcaggaccccagaacagagagccaaaattgagcactgtttcctgagagcactgtggctctgtccttgaggacagatttggcctgtgttaagttgttgatgagcaattgttaggattaatggtctctgtgagtctactccttctataacccagcacccaggctttcacatcaaccacgcaccaaccatcacagcagctgttttcaatctgcccatcatcttaaccacacacacaaggctgcagaattcatctcattaacttccttattttgtaatggaagactgaggttcacagagggacagtgactttcccaagtcactcaactggtcctgacaaagaaggactagcctatggcaatctcagattgccacctctatgttgaaatgacatttaccagtaactagccccttggcagagaggaacccatcaggcaggcggtctgtgcatggtgggtcagaggcagagctgtgcattcacacagactggattcaaatatcggttccttcatgttttagctttgtgactttcgctgggtcctttgatgtctccactcctccatttcctgtcctctaaagggggaatgctggcagtgtgttttcatgggatagttacgagcattaaataactttcttccggtaaagttcttggtgttgtttctgacatctaataagcaatcaaatgttacaactgccaccaccatggtagcacatcctcttctgggtaacacctatgttaaatcaacgtacatggcttgactcaggtgatatctgtaatcttgactttgtctgtttacatgtaactaggcctctggtctctgccatcctataaatccattcagcctttcagcctcagtttctcctggtagagcctggcatggcctgaaggcagcacagtataatagaaataggaaggtgtgtgtgatagactaaaagatggctcccccagacacccaagtcctgatcctggtacctatgactatgttaccttacacagcaacagagactttgctggtgtgattaagtcaaggatcttgagatgaggggtgaggggcttataaagcggagtttccctgcacaagccctcttctcttctctgccgccatgtgagacatgcctttcactttccaccatgattgtgaggcctctcagccagatatgctcaattatctaagttgtccctaaatgtaattacaaatgtccctacaagagggaggcgagtggtattgactgaagaagagggaggaggcaatgtgatgtggccactaacccagaaatgaattcagtctctagaagcaaaaaaggcaaaatatacattctctcccggagcctttggaagcagtgtggccctgcggccaccttaattttagcacagtgaaatggattttggactcctggcctccaaaactgtaagagagtaactttgtgttatttcaacctaacagtttgtggtaatttgttagggcagtcacaagaagctctgatatggtttagctgtgtccccactcaaatctcatctttaattttagctcccacaattcccatgtgttatgggaggcacccggtgggaggtaattgaatcatgggggcaggtctttcctgtgctatgcttgtgatagtgaggaagtctcatgagatctgatggttttataaaggggagtttccttgcacaagagctcttctcttgtctgctgccatgtgagatgtgcctttcacctgctgccatgattgtgaagcctcctcaaccacaagggactgtgagtccattaaacctctttcttttgcatattgcccagtctcaggtatgtgtttatcaacagtgtgaaaacagactagtacaagctcatacagtgtagaagtcactcctcaaaggtgacttctgtcaccaccctcaccccaagattagaagagttcccattgcaccttgaaattcattttcaaagcattcattgcacttgggactattagtttaatgcccagcacctggaaccagtgcttggaacatgggagtcccttaataaaatgttactggataaatgaatatttgtcttcccagagagacagtgagcttcctagaagccacatgcgggctctttgctgctgcatccagagtgcctagctcagcgctagtgcatggtagcttctccataaatatttgctgaatgaataaatggctgcttgtctcctcaagtagcctatcagctccacattcgccatgtcagtttcttcctctgcaatctctgcagtggcttgcaccatgcctggtgccttgtaagttctttgcaagcaatcattggccatctgcctgagtagtcacgctggtccggacttgagcgatcctctccctctgtccctttgcactagagcagttgtcccattaagccatgtgaaccctaccggtgtgtgttatgagccatgcgttgtgccaacatcccggcagacggaattcagcagtgccacgggagagagccagcggcctcccctgcatctgagcagcgtggcttgttagttcccagtccttcagccaccagctgtttctaacacaaactcgtggtgacagagctctctgtaggagaagctaactacaattgtcagtctgcagagcatcaggcatctctaaaaggattccaattattgttctgttctgcctgctcctattacagtctacctcaacatcagctcttattcagggagaggagagcgagatgctaactctgtctccactcactcttatgccagaggaccagcagatgccagcagctggtgtcacgctggagaagggtaaacataggtaaacttcccctcaatgcgacggctcacttttcattggtgtgtattgcacttaaatgtgctcggaaaatctcaactcagcgtgactcgcaacctcaccactgagcggaagataaatactgagatgcccagaggtgagtcatttttacagggcattccccaaagacaagatgggaggtgcctcccacactcttcacctcctcctctgtgggcagcaggtccctgcctgaagccgacagacaggaagtcggatctgtgtaggtagagttggcaggtttctcagctctcataatagctcatgggcattgcagtaaggacccagcacaaggaggtggtggaatggcacggcccacggcttccttagttgtggaagttgtgaggatttaagtataatttacattatcttttttttttttttttttttgagatggagtctcactctgtcacccaggctggagtgcagtggcacgatctcagctcactgcaacctccacctcctgggttcaggtgattctcttgcctcaccctcctgagtagctgggattacaggtgtgcaccaccacgcccagctaatttttgcatttttagtagagatgggatttcgccatgttgcccaggctagtctcaaactcctgaccccaagtgatccgcccacctcagcctcccgagctgctgggattacaggcatgagccacagtgcctggcacgttaatctattttaaaaatctagttggacttatttttaaacttgtttgtcaaggcaaaattcacatgacataaaaattaaccattttaaagtgaacaattcagtgccatttagtggatggacagtgttgtataaggcaccacctctatctatattctcatcgcccccaaatgaaaaccgcatacctgttaagtagttgctccccatcctccatcccccatgccctttgtaatcatctactttctgtctttaaggatttacctattctggatgctccatacaaatgaaatatgcaaagaggagcgcattaggaaggtggtctgttcatggtggttcagaggcagagctgtggatcctcacagcctggattcaaataccagtcccttcatttttcagctttgtgatcttggctaggttctttgacctcttcatttttccttttcctgttctacaaagggaaaatgctggcagtgcattttcatggggccgttacaagcattaaataaccttcttcaggtaaagttcttgctgttgaatctgacatcaaataagccatcaaatgttacaaccactacctcctcttcctggctagcacctatgtgaaatgaatgtacatggcttgactcaggtgatgcctgtcttttgtggccttttgcgattggcccctgtcacttagcacaatgttgtaaggtacgtcatagtgtttactgatccatatgatagcagaggtcagcacttcttttcatagctgaatagtattccactgtatggataggccacattttgtttgcctatcctttcactgatggacatttgagctgcttctacttcctcactattatgagcaatgctgctatgagcatgcatttgcaaacagttattcttatttaaatgtgaattagcagtgcgtatacacacccaaaattgggtcatcaaagccatgattttattgataatgatcaaggatttcttctttacacaaattcattagagcacaaatgtcaatgtctaggacaattttataggacaatctgaagaaagcaacagctcagctggaatgtggatatggttgaagtcattagtttaatcatatctgcagagtttcttttgccatataaggtaacactcacaggtcctgggaattattaggatcaggatattgttggggtcctttttcagtctgccatatacactgtggcctgaaggttcattaagagttaactgggagaccagagcataaggggtgctccaggcagagggcacagcatgtgcagaggccctggggcaagaggcagcctggtatgtgcaagaagaaaagagatgcacggctggaaagagacacaggcttttattggccaaattaaggacttgggtcagcatccaaaggacaaagagataccactaaagaatctcaaaaaaaggagtgataagttgattggcattttagtagatgctgtggccacattgtagatgggcaaagtagagggaaataattgtggattcagaagaagttaggaagctgttgcaatagttctggtgagaggtggccaaggcaaaggttagtgtgtgaccgtgaggaccaaaggaagaggacagtcacaggcatctgtgacttacagctgaccagctctgctttgctacttcattcgttgattccacaagtgcgtattgagatctcaacatggggaaggtgttatgcatggtgctgggaatgaaatgctgagccaactgtgcagtcctggacaggttaattaacatttaggcctcagtttccccaagatatgataatgttcattttttttggagtgtcatgaatattaagtgagtgaatggaaggaaagagcttaggacagtgcttgacacagaggaagtatttggagcagcaagcaagagaaaaagaaggaacgaaggaaaggaaggaagggagggagggagggaaggaaggaaggagagaggaagagaaagagaaacaaagaaaagaaaaggaaaaaaaggaaagaaggaaagaaggaaggaaaggaaggaaggaaggaagaaaagaaaagaaaagaaaagaaagaaacccatggacacccacagaaacaaccaccctggctttggccctcctctctctagagtagtcattgaaaaattcacccaggacaacatttgcatgaacacccaggaaatgggtggcatatggcatttggcattatgaggcattgagaaatcctttccgtaatatccactgagtatatactgtgagccaaaactatgatagcggctatgggggaaaaatgagtaaaaaccaacagtcattgtcttcatagagcttacaatgtagttggggggaccaatattagtcaaataagcatagtaagaaagatagtacaaggtaagagggggaagaccatgttgcaagagagtctttggtgggctgagttgacctgaccacggtagtcatggaaggtctccttgtggacgtgatccttggggtgaatcaagaggatgaggtggtgttaactgagcaagaatgggtagaaagaacatcacagggagagagaaaagggtgagcaaaggtcctgtggccagtgggaatgcagtgagtgtgggtgtagataaggctggagaggccaccaagagctgaacacccatggaaccttgtagaacaggctgatgggttttgtctttatactaatggaaatgggaaatccttaaagtatattaagttatatggagatatatacagagatgcatctttggaaagatgattctggtttgagtgttaaggggagatggagaaggagataagagaaatgtccactaggggactaccatattggttcaaacaagagacagcaattaggtggtagagatggggagaaggtgccacttcgagggctgtttaggagagaaaatcaacagcagcactagtgataaattgagcagaagaggtaatggagggtcaggtggccaggataacaccagcatttcttgactggtgcaatcgaaattgaaatggggatgttgcggatggaggtaactcatgccacaggtgtttcatcttctcagtaaagcagaagcctggctcatttgctgaaaaagagtgcattgagaactaaggcagaattttaaggacgtacaaacatttttgaatggcagctgtggggattcgagcaacaagaatgacttgcagaagtgatgacttaattgaaatcaaattgaaatacatagaaaccacagatttggagtaggcatttcatttgatatgtctcaaaggcccagcaggatgctctatctacaaagaaggtacagaataagtatttgttgagcaagtagataaaaccaaagagcgattttgcatgactttcctgagccaactgggacaatgaattggctgatctatgcacaaaaatttgtcctgctatatttctttccatggcaatccctgtgtagaactttaggctgcaacctaaaggtgaaatgcacttaatttggcttgaataatttacttggattcttccttatcaacaagacttgaatatataatgtatttgaatttgaatttggtagttatatgattgtttaattcttggggattggaatatgagggagataggaagaaaaggaaaaggaaccatttgctcacactctggcagatctaaagaaggtttcattactgtagggcttctcagaactttcagtaccctaagacagaagcttcttagacattatttgttctacaggaaaaaaaaagtgttgcaaagaatagctacatatagttattatctaatatagtggcattctatggaaagaaataaatctatattagattaccttgaatttgagaatatcacattttagccccttggaaggaattgtactctggaattatatctttggaatatctgatcaggccattataccaatcttcccatgtttcctaccatatttctaaaagaatattattttataccataactatattcaacatagtgcctatttctctattgccttcctaggaatttaattttgttgtctaaatgggggaagtctgtttcctttcccagttacggcccaaataataaatgttgatgttaccgtgctataaaaatatgtcctctataaattgctttgcttgtcattaagatgtttcctaaacaagttgaatatgcgctatgtttttgccagacacttgaagcaatcttaaattacctgctgtgtctacacatattcagaaggccataatagaaatgtgccgagtggctcaggagaaaatcatttataaagattagaggaggacttgggaagctctgcctcttgttgcttggattgtgcacaaatacatttatttctgggtatgtttaggttatttcttttcagatttattttggtttacaccgtttcccaagcattagtcatcactgtcccctgaagcagtcacactatactcatctccgtagatgatcaatcagaatcttgagagtgaaatgaccagttaagacagaccaacaatttgttgatctagtggaggcggaaaaaatgcagtctgaattgaaatgacttttatgagatttcacccaggtggttgtttctaaatttatactcaaaatatagagtgaaacttgagagaacatttgcaagaaggaatgtgatcctaaaataataggatgtccttgttgggtgagttgaggaagtatgatagagccatagaggaaaagggtagattggcatcgacttagtagcgctgacgatcatttttatcagggatgtggatgtaggcacagaaagaaaggcatagctcttagattagcagaagagacaaggttggaaggaataattgtccagttagaatgcataatctgtttttaaagacatattaaactggaataacccatgtacaagtatttatccagcttggatacctggaagtggaattcctggttgaaaggtatattaatataaaattttgtaaaaaaatatatgttagataatgcttagtcatccttcgcaaatatcatgccaatctacatttcaactaccagggcacacacttgaacccatataaacagtggtctattctgaggacttttcagaacttttattaaaccaagattcattgtaaatctttgagggagtcatctggcatacaaagtgttttcgaaactttgattttaaaggaactcatactaacatcttgagaatctagtatccttagaacagtggtccccaacctttcttggcaccagggaccggttttgtggaagacaatttttctgtgggcaagggtgggggatggtttcaggatgaaactattgcacctcagatcatcaggcattagttagattctcataaggaacatgcaacctagatccctcacacgtgcagttcacagtagggttcacgcttctatgagaatctaatgccatggctgatctgacaggaggcggagctcaggtggtcatgctcactcacttgccactcccctcctgctgtgcgactcggttcctaacaggccatggaccagcactggtgtgtagccagggggctggagacccctgccttagaacacaattcaagaaatgctagtccacatgaaagtgaaaggctgaaaacttgcagaaaaggaaaaccgaaacattgaaagagggaaaatctgacaggagaaggcacagagatgagcatgagggccatttgttgaagtgttggtaacagcgataatgataattctagctgatattttcagagcattttctacgtgtcactcatggagtcctcacaagaacttcacgaaataggtactgtaattattcccatttcatagatgaagcaattgcagcatagggagatgaagtaccttgtccaaggtcatgcgaataggttagacttattcactctgtgtggccccagaggaggaatggttctagaaagaaatattttagcttaatatttgaagaagggctccagcagtcagaaactgggcatcatctattagggatatctccctgagggagaatttgagcgtgattaattccctgacattccattggtggaactcattctttgactttagataaaattctcttgcttctgaatctctgctaatttaggtggtttgtcctggacaagactgatttttaaaattctttatgttattgtcaataaattttttttttttttttttgagatggagtctcactctgtcaccaggctggagttcagtggatccatctaggctaacttcaatctccgcctcccaggttgaagccactctcctgcttcagcctcccgagtagctggtgttggaggccgaaagattgagggtcgtgatcaactcagtataccactggaggctatatgagtaagcgccaaactggtcttcataaatgcagaatgttggcagaccgacaaactgcgtctgctgccccgaaggagtgctgaagacagtcacccccgatgcgcagtgtttcttgtgattaggtacatctgaagcctgttagtaataatataaacctgtgttcagttaagcagctgaccagtcattaccacctcctccttgctctttctacccaataaatacaaagggctctagaagctcaggggtgcctttgctcactagaagcagggagctctcttcttcttccccagacccttcctttaaaacagtttcttttgtcttaagtttccatttctacgtttgtccctttgttcagtctcgtaatgacactctcaagtagtaacagtagtaactgtcctaatgacatctcaagtagtaactgttgtcatgatggtctcaagtagtaacagtagtaactgttgtagtgactggtctcaagtagtaattgcggcagtcagccacagctggaattacaggcatgcaccaccacacccagctaatttttgtatttttagtagagatgggttttcaccatgttggccaggatggtcttgatctcccaacctcaaatgatccgcccgcctcagcctcccaaagtgctgggattataggcgtgagccactgcacctggcctattgtcaataaaatatttttatatccatgatgccagtttgtttggtaaatgtgactacagagcccagggtgaaaagatgtagaaattgtcttgggatcatcttgacgtctcctggttggagtattcatgttcactcccgctcaatccccaggtcatatggcagtctaatctcagactctcagcccagctgccacctccagcctctggcctacactagtgcccagtggtgagcaaagatgttgggaagaaatctggatgcatctaaccctgctgcctgttgagtatcaggaagctgcccaacactcttccttagaaaggttttaacatgtcataatattgaggcattgaaaatctaaatgaattcttctgattgttccagagaagctatggaaatatgatcacttcattatcctttaccaaatgttcattgcatgtcttcagtccctcacattcccaccagctcctctcttctttgcctgaccaaccttactcatcctttgaggcatgtggcagagatcgtgtgttcactaaactctgtttgttttcactcttggccatagttagacttaattttccaaagttccttgcagttaggcagggccatgaaacagacaatggaatttggtagaagtcatcaaaccactccttcctctcctcaccttctttccccatccacaagctgaaccaaggactccaaaggtctagaggaaggcacagcccaagatggaaggacctgaatccctgactcccccaagacattgagcaaagtggaagaaattcatggttggtttttaagctctttagaaacagtggtttatttgttgcagcagttaatgttgctctgcctaacataagactctgctctaccacatcaggtttcttcatgggtaaagtaaggtcttctcctatgagaatgtatagagccctagacagagcttgcatcatagctttagaatgcaagccccatgggacagaggctgtgtctttcttatccatcattgtacccattccctagcaagtgtccagcatttggaagcaagtcaataaatactagctattattgctattagtattaatgtgttagcgttgtctgacccttgctccttacagtgtaggccatgggccaccatggcatcaccccagagcttgctagaaatgcagagcctcaggcctcatgctagtcttattgaattagcatctgcattttaacaagactctcaggtgaggccattcctgctgaggtgcacatactaatatttgaaagacatcactctagaccagcagttctgagccttggttgcaccttagagtcaccctatcagaattcctatcagaatctggttttgtttttgttttaaggcttcccagatgaatgtaatgtgcagccaggattgcaaactactgctccatctcagtagttctcaaacactagcctgcggcagaatcccctgggtgttaggtgcgtatcacaacacagattgctggatcacctccccacactgcctgattcagtatgtctggcatagggaccaataacgtgcatttctcccaacttcccaggtgcattcgtttgcaacggctgtggtaacaaagcatcataaactaagtggcttacaacagcagaaatgtattctcccatggttctggaagccagaactctgaaatcaaggtgttggcaaagccatgctctggcagctagtccaggggagaatccttccttgtgtcttccagcttctgatgtttgccagcaacccttggagctctttggcttgcagaagcatccaccactccagtcctctgtctttacacggctgtctccgtgtgtgtcttcacattgttttccttgtctgaacatctgtctctgtgtcctaatttctcatttttataagaacaccaatcatattggcttagggcccgtgctcatgacctcattttatcttgtttacctctacaaagacttcactttcaaataaagtcacattctgagatattaagggctaagacaatcaacataagctttttgaggggacataattcaacttacaacagcaagtgatactgatgctgctggtctagcaaccccagcttgagaacgactgccttgttgtgagctgcaaaagtgcaaagacaacattcctttctttcagtacatcctacccagagtgtagcttggcgcttggcacatcgtatgttttaagtaactataggttgaattaattaatattctttccacacagcaatttggcctgcataaaagacttcgatattttcctgatgttgccagaggcttaatgtgtgacatttcgtatagcaaatgctcaataaatgttgggtgagtgaacatagctgtcactcctcattacatattttaaaaacaaccttagtgggccttcatgcttttattccaccttatggagcccaatgacagaatgctgattaaatgacatggctcctttaatgggaaattaacaatctacaaaatgttgtggattcagtaataggcatttgaggcgctgactatgatgatttgttgcttgccttgccttgattccccagtgagaattcatctctatttagcaagtgctgtgatctactccagtaaaggagatctctttctttgaatcccagcaacctctagcttggtctttagcttcatatatcactgttaattttcacctaagtcagtggttctcaactgggggtgattgtgctcctcaggggacagacattagagacatgttttggttgtctgtcgtgagagcagagtgtattcccattccccagctgggaccagcgggtatgctgctctcatctaatggacagtggccaggggtgctgctgaacatcctacagtacataacacagttctcatcgctacagagaatctctggccccaaacgtcagtagtgccagcgtagataaaccctgacctaagcaaagacaaaatggacatgaagttgcctcaatgggcaagaccaagacttctgagccaccccatcagtgacacttgatgtagccggtagcaggagtgccagggagaacacagctttgttgttccatatccagctgtttggatcagagggaaatgggatctttcaatcactactgcagtatgagaaagtgagctgcacccagtggttactaggtggggtgctctgtgcagtgtgcttcgagcacaccctctcactgaatgtgagatgatgctcccactcgcagtgtctctgaggtgagaactattacagtccccacattgcagaagaggagtctccagcactgagactgagtagttcacccaatgtcatatagggtggagtgttaaagtcctaaataaaacccagtctataggacgattgagtctgtgattttaatccctgtgtagtctgggtttacatttccattcagattcctgctccaacatttcctatagatgctcctcaacttacgatgggtttatgacccgataaacccatcgtaagttgaaaattatcattaagtcaaaaatgtatttaatacacataacctgctaaacgccatagcttagcctaccctaccttaaacacactgagaacacttccagtacagtattcaataaattacatgagatgtttaacacttcgttataaaataggcattatgtcagatgattcatcccaacatcacaagaggatatggcaccacatgttgctaacccagaaaaagactagaattcaaaatttgaaatacagtttctattgaatgcatatcactttcatactattgtgaagtcaaaaaattatgagtgaaatcatcgtaagtcagggactctctctagctgcattgtgttgggcaagggatttaaccctcaccgtctttgtttcctcatctgcaaaatgaggatttataacagttcaaagggtatctactaggattaaaagatacaaaatacatctaacaatgtctggccacagtataagctcaataaatgttagttcttctccccgttagccgtcattacattcacaggtattaagaaagagaaatgtataggtatgatatgtaattctcttagttaatgagactttccttaaactaactagaagattccattcactggaaacatacttaatgatgaagcttttattctgttcatctccttcagggagtacttaaaaataactcacaagcccattgttagagctcatgttctttacccaaccaggatttaattagtccttcagctccttagcccttcttagaagttgttcgatgttaaatcccacatgacccttgggtgggaaggtgtggaaaccctccaagcaccatctgacatacccagtgactaggaagacttcacagtaagagttaaggatttttaaagattgccgatgttaatgaagaaggaaaaaaaatagtggatgtgctaaattagatatttacaaattatgttcctctctccaggggaagattcattaattttcaccgtaaccagcttcattctattgggacaccagaggaggatttgcagattacagatccagccacatctttctcatgcttaaagaagtctcattgtctgcactgtccagagaggggaaagtccactgcctggacaaggccttcatggctgttcacaacctgccccagcctccagtccattacccttgcctattttgttgcagtgatggaattaaagtccttctaatgaaaaaggctgtaggtgaattttaatccattagccatctaccagacctcctctgccatcctttagactctccatacagttcctctccctgccgtatcttcttgtgtgtcaatatttatatcaagcaagccctcctcatctgcccaccctttatctgccaggctaagtccaactcctacttcaagaccgcattcaaataatgcctcctgtctgcagctttcctcagcttccccatggagaattgatggctccctttctttgagcgtattcattcattcattcattcattcaatgacaactatctaccaggagctgttctaagcattggggtgtggaggtgaacaagaaagcatagagccattgttctagctggggaaccaatatgaagtaaaacataagctaatacttaagtccagaagttcagaagtgataagtgctctgaggaaaatatggagtgatgaggaagagtgaaattggcagagtgaagagtgatatttgatgaggcaatcagaaagagccattgtgaggtgaggtttgggctaaaacctgcataatgagagggaagcatccatcctccaagtgtagagcgtgggacgtcttggtagatacctcaccagctcttcccttctcagaggctctgaactcctggagggtggcactcttggcatccccagactcttggcatccccagtactttgtccggaattcatgcatagcagcagatagccacaggtgatggctcaagtgccttcatttaatttaacttaaaattttattttcggttgtacctgttatgcatttgttagccatactactggttttttttttttttaatcaaagaagaaaatagctattgcttcttttttttttctctgggttcaagacgttctggaaacaaagtttgaaaaatccatttaggaaatgcaatttaagtgccagataacatcttgggattggcgccatgatcgatgaggtctgggtataaccaacgtcttatgccatgtctctgatctttactcaaattcacctcctattctgggtagcgaagtttggggagacccagtggtgtggagagagggttgtgtttagcttctctttccctgacctcagagtaaacaccagccatctgcataacagcagtgcccttccatagtacttattaggctattgttactcagttgatgtcagttggtgccactagacagagggcactgcagccccatggccatgtctgtctttctgaaagattcaagtgccagtctctttgcatctggcacacagtaggtactctgaaaagacttgcaaaatgcagaaatgaatgaatgaaggcacaacaaaaacacggaccggaagggacacctccggtcctgaacagcctggcttcaacttcaaggaccacagttggcttgaattttaatccatcaggtcatctccatgtgttcactttcttccataaaggtgaatgtgtcaagcactgtgcaagctgccaggagaatggtggagtatgataaccatctagtgggggaggcaaacttgaatcgaatgatggcacaaataagtgtggaattatagagtatggtaaaagctaagaaggaaaggcaaacagggcttcaagagtacacagcagtgagcctggacccagggggatgtgggaagcccaggaacctggataagtggctgttgttgtttaatctattttttagctttcattttagtttcagaggtacatgtgcaaatttgttacataggtaaactcatgccatgggggtttggtgtacagattattttgtcacctgggtactaagtatccaatagttgtttttttctgatcttcttctcccaccatctaccctcaagtaggccctagtgtgtgttgttcccctttgtgtgtccatgctttctcattatttagctcccacttataagcgagtacatgcagtatttggttttctgttcctgggttagtttgctaaggataatggcctccagctccatccatgttcctgcaaaggacatgatctttcttttttatggctgcatagtattccatggtatatacgtaccacattttctttatccagtctacagttgatgggcatttagtttgcttccatgtctttgctatagtgaatagtgctgcagtgaacatatgcgtgcatgggtctttgtggtagaatgaagtcactgttgagccttgacctccaaggctgaaatagataaaggagtgaggagggtgttgtagtgggaagctgtggcctgcagaagctatcctggggcatcaggagctgctgggggagggaaatggtataagacagcagaccaggcagaccaagactgggttctgtaagctctgctaggaatcttccttggtatctgcagagcacaggaaagcttttgagagatttcagtggggagatgatatatgcagagctgagtctggaattatcacctgggctgcttgctgccagatagattggagcaggaagggggggatgggaagctagccaagagcaggtgtccaggtgggagagaatggtcacttaaacctagtgggggtgccagggtggggagaggtagacagattgaggtgatatttaggaggcaaactcaacaggccttggtgatggcttatttagctcagtggtcctaaaccagggacagttgtgtcttccaaggaacacctggaaatatccagatattttttggttgttgcaactggctgggagattggtgggaaggggatgctactagcatttcataggtaaaaactaaggatgtggctaaatatcctacaatgcaaagggcagcccctcccccaacagcaaagctttatctggccccagtgtccgtagcgcagtggttgagaaacctggcttcagatgtagaaacatcagagatgcagtgtcagaggtgatctttgggtcttgtcttgctaacaaggtgaaaggtcatgccattctctgagatattgggaccccggatagccagttcttttacaaggggtatgtggtgtcaatggagaccagaagatgggttcctgaggcatttggagacatccaagtgaggagatggcttgttttcttcctaaattttcaccatcccccacaaggcagcctttttttttctctgttaatgaagtttccagccaccttacccttgattctcaccttccaaccccctgccttccaatattccacccctcttttttctgccctagaggagaaacctatgatccttgcattagaatggttttcctgccatcactattgcaaaatagacaagggtaaaagaaagccttcagtagaatttcatctgagtattttctttgcccccttgtgtgtcattttctccttaagaaaactgaggaagaagtgtgatttagtcccctcatctgcataattttcttccctgtgtggctgtgtgcttgtcagtgctctgacagatcaagagtgctctgaaagctcagaggagcaggaagagacccaggtgacctggtgagagccacgctgaatctcggttcacatgtcgttaacggagcttggtccttggagggccttgtggggaaggacgcagacaagctgtgatggagtccttgggtctcacctgggagagcccacgggagcacctgtgagttggttccgagaaaacatcccactctccaggtcacctctctgtgcttcaccccacctctcattcttcttttgtgcaaagcacctatttggaagtaaaatatcagctagaaaggaaaggagtttcagaagaaagtaccacatcagcgttttgaacaaattaagttgtgtgcaagctgagcagcctgtatcaaggggaacgtggtagagggatgtgagcctcaggctgcctgctgccggttgcaggctgccatatgcttcacctgcttgtgccctcgagggtccccttctggggtccccagtctggcttatgatcatattccagcatagagcactccctaaccccactcccgtagcactgggactatagctttatttcttgcatcatttttctctacgctcaaaaaaaaaaaaaagcaaaaacaaacaaaaaaaatctgctcagcatgagaaatcaagttaatgaaaacgctaccgcattgaatttccaataagagaaaggcaaagcaaaacttgtcaactaaagaaaggggcattcactgtaatcccttcgaggagaggtggaagcaggagtaatacaaaagctcattactgtaatcaaggcatttgtaactgttggtggcaggaggtgaaagagagagagagacagagaggggaagactctgacggaggttttaactgtatgcatgccagtctttcccactcgtcttgctggtacaatctggatcgttcatatagaaaggagacagggtttgccaaacttggctgaccaagccaaaaacactaattagcagcagctgctcaaaattggggatgctcttgccttctagtgcaggggtgatgacttgttctgactcttcaagattcacaaccttagactgcaggatgcactttgccaggggaaatgtattctccaacgtggctgtgtgcattggtgctcaaacattggtgaagccccaagtacttgagagggacaaacaaaacacctgtggaatctcttggtcagctggccagcaggagtttgaagccagggtgaactcaaagcattctcccaaagaagcctttttcaaccagggggcgctgacagaagttgtcaacacgtctggcaaagctttccagcatctgctatgatgtcttaatcctcctgtgaggagtgacagaggtaatgtgtggcatggagccatcagtgacatttggtgattgaatgttgctggtggcagtgtcttaatgatggagacaattgattgataggaggtcaactgccaagcagttaatccgatggcaaattccgctcataatggaagagctggcccatgcatgcaaaccagcatggtgggggattcctgctgatgcagctgtgggcacatgaggagggggaaagatatcaatgcctctgatgaatgtctagcaaagttttccttgtgaaacctcatggaaagttccatgaggccagagatcacatctactttgttcactgttctatcctttgttgctgacacatagtggccattcagtaaacatctgttaaatcgaggaagcagtgaatgagttggaagctgccttccttaggctgttttacttccagaattctactttttcactgacagtaagcctaacctctcaggttagaaatctaagttgccttgcattcctccctctctcttccccaccaagctctgcatattccatctcaggaataaatctctaacatttctcccttgtcttctttctctgaagccaatttgcatctcccaagtagtcttctgatgagtaagcctacccccatctctgttccatggcccccttaagtcatttatatctatctatctatctatctatctatctatctatctatctttgagacagcttctcactccatcatccaggctggtgtacagtggcatgatctcagctccctgcaaactccgcctcccgggttcaagtgattctcgtgtctcagcctcccaagtagctgggatcacaggtgtacaccaccacacctggctaatttttgtgtttttagtagagacaaggtttcaccatgttgagcaggtgaccccaagtgatccacctgcctcggcctcccatagtgctgggattacaggcatgagtcaccgcccctggcttaattcttttaacatgtaagtctcatcatgttacaaccctgctttacatagtcaaagtcaacaagtgttatttggccatagatatctcttaggccatgacaacccacctcctagtaccttcccagccttgggttaacttcatgtcagtgctcacattggtgcttcactgtgtgctgtgtcttacgtttcaaacacccattctgcatcttcttgtttcctaatctttgctcatgtattcactcaggctggacatccaagcttctcttttttttcctagcaaaacactgtctttgtttaagatgtgtcatctggggacctttttctgattcttgtcctcccttggagaaataaatgcatctccctttcctttcttccatttttcatcactttgtacttgaattgtcaatttgtctacccatctcacctgctggcctatgaaggtgtcaagtcaggggccataacatctttttcactgttccttccagcaactaatatggttcctggcacataattacttaatgttagttgaaagaaaaaatggatggatgaatggatggatggatggatgggtagataagtggataggtggatggatgggttggttagcgggttaataagtaatgggttagatgcatgacaaaatgaatggaataagtaattgaatggattcataaactgattcattccaggggaatactaagaaaatagcaactccaccacctcccaccttgggataaatgatatggccctgtccagggaaggctgagtgccctttgtcctcagacagtgaattctggagttccaggtacatgagcatcagggtgtgatctagaaaggagcctgtggacctagttgggcgtattctcttggtcctggggattctttgtgccatggagaagagcatagtttgagggaggtcagaatgggaggccagaacccagctgcttatgtctaaagccattatcttaccaggaaatgactaagacatatgggaaaggaaatgccaatctggtaactcctgtaactgtcagttccagtggaggatgcaccaattgctcgtgctcacatgctaaatcctttctccagacatcaccctggcatggccctccgtctcctagtcaggcattaactaataggggaaatgcaaaatgttgataccgcagaatatagagacagaagagattcacactgaaagtgcaaattactttttttgcagtgaatagaaagtcacattactctaagaagctgcctaattatctgtaattatgcccaaaatagtcaagctagtttgctagccagttgaagaattgcatcttaaatgaatttgtcactaaagaaagaatgttgaaacctggcaaaagagattactgcatttcaggggaaagattagaacatatcatgcctgtgttcagtctttcaaagacgtggttattggctgggcgcagtggctcacacctgtaatccagctctttgggaggccaaggtcggcagatcacaaggtcaggagttcgagaccagcctgaccaatatggtgaaaccctgtctctactaaaatgacaaaaattagccgggagtggtggcacgcacctgtaattccagttattcgggaggctgaggcaggagaatcacttgaacccaggaggcagaggttgcagtgagctgagatcgcgtcactgcaccgtagcctgggcgacagagtgagactccatctcaaaaaaaaaaaaaaaagtgactgtggttattgtaaacatttttgcttaggaagcatttattacagctgttcaatgtagcattttacggtattcggtggaaactctaatgtaagttcggagcagtcctaacattccaagagttaaaattatccatgattgggatgtaatatctaaattgaaataaataaactgtttttatatgaaggattttttcctgattcaaataaaggaatctagtttcattgtaggcaacacaggaaatacaaaagttataaaattcacatctgtaatcccatcaaccagagaaaactcttagtaactagtgggtgtttcttgctagctcttttctatgcatatgtttttcttataacactggaattttaatatatacaacattgtttagttacattcttccatgtaactttcatgagcatttttatctgccctgtaggaatcaaagtgatgggttttttttgttgttgttgtatttttttctcagatggagtatcgctctgtcgcccaggctggagtgctgaggcacggtcttggctcactgcaacctctgcctcttgggttcaagccattttcctgcatcagcctcccaagtagttgggattacaggcacccaccaccacacttggctaatttttgtatttttagtagagatggggtttcataatgttggctaggctggtcttgaactcctgacctcaggtgatccacctgccttggcctcccaaagtgctgggattacaggcgtgagccaccacacccagcccaaagtcatggtttttaaatgccaacataatattcaccatttttacatactgttgtttacttaaccaccaatttattgtagataattttgtgtcttttataggtatttataaacgattctgcagtgaacattcttgtacagatataattgcctgtgtctctgtctgttttcttaataatgcctaggaatggaattactaggtcaaaaggtatgatcattttaggaggttatagattagacctcaatgtagcagtgccatttctgtctgtgaatctttctttctagatctttctaaaccagggtatagaaatagaaggtaaaatcctcttggacagaaaagaaaagaagcagtgaacacttacttaaaaaaaaaataggcaatggaggagagccaaaatttgaactccagcctgaaaatcacaggatccctggagacaggaatatgcactggcaggcaacagaaagccaaacagaaatgagatcgaagaagagataggaaaacaaaacatttcaaaggaggcatagaaaggagcatataatggtgatggaggcaacgataagtaggcaatggaaagtagagaagaaaaatagcagcatggctgtgaaggaagggaacacgaacttctgcaaaagctgtcagaatcaaaatgaagccacttatgttaaaattttttttaattaataatcaatttaaaaccctgaaaaatgagctgaggagggttatgaagaggggagtctcacacttggttgcctgataacaaaaactgtcacaaaagactgcaaaaaccacaaccttgcacaaaggccatcacaaccttacacacacacacgcacacacacaaatacttctgcaaggacatctgcccagcaactgcctgtccaagtacagactgatgtcacccttattattgatctttgtagccagcaataactacttcaaagccattatgtaatcttcctcattttttccttcaaaaacatttgtctttctttacctccctgcacacacatacaaagttactgcagcacatgtattcccattgcaatgccctactgctgaatcttttttttttttttttttttagagaacctctccctctttgttatttaggttgatgcttcctgaggccacccctgtgccacacagacagaaccctgcggggccagaggtggagggtaggagccattgagtgaaaaagcaagtcaacatctaccagcttgcagcccctcactgaccatgttgtatacagagagagcgagctactttggtacttcatcaaccagacagttcagcagcttgaaagaggggagatttttccatgttgcagagtgacaagttgatatacaatgtttatggagaccatggtttgtacagtggtaaactcaagcacagaaacaggcataggggtatcttagaaccttgctgctcaaagtacagtccatggaccagcagcattgaaaacacctggaagatttttagactttcagaaaccaagaccctgcctgccccaggcctgtggaatcatagtttgcagtttaactgattccccaggtgattcatatacacattaaaatttgagaagtgctgtcttaaaagacatctttttatatgaatttcagactttgctggtgcttggatttccagtgttcactggaaaagccgaaagatttatgtgagcacttagttgactgaattgcatgtgattttagaagagggatttccagatgtaaagttaaaacatgatgtgtgatacttagcataagtggagaaaaccaattgataagcccaaggctaagtggaaccattctgactttttgagaaacgcaatctgtttgggggatagtttctaaagttcatcagaagaggtgtcattaaatcagattttaagcagaatatagcagtttggctaatgttggatagtctgtctgctcccaattccagaaagtaaaatattttgcaattgaggattgtaaacatcttagacagttgcaaggactgtacatgacatatccatgcaagagtattccgttctgtttctatcagcttcttatgctttttcaatgggaaatagttttggaataatgggctcattagagatagacaaagctatggcctgggggaagtaacactggtacccagagggttttaactgtttcactccctttcccagtgactcaaactatgcaccagtattaattttaaatgactttacaaaaagacttaatgagataaatcgtgtaggcacagtataaaagttagtctttcatgttgtgtctgcctgcagcagcgttctaactcaaacgttaggagaggcttagagacaatttgggtctagcatcaaatcagataaactatcatttttaattattgttattttgataaggacttcatagtctcttaagtaagccagccctaaaaatccttgctcatgtttttaaatggtaagggagattctgcaaagatagtatgaggaagcaggaggaggaggcaaatactggttaaatgccttgtctaaatccaccacagtcctcagcatcatcatgaacaaattgcagcagttatgcaccaagcaggatgcaaagcaggaaacacacattctcacatgcggtggtcaatcagccaagtaaagccaaagttgttgttgttcccagttcaaagatgaggaaattgaacctcggaggggtcaaataactcatccccaatcacaaagccattaagtggttctgtcaggatttgaatccatagcctaagttcatcaccacattcttctccttgtctcagtttcggtatttctcacaaatcaagggacctggagagaaacagaaactatttccacaacatcaagaatgtcacttagaatcaatattggcctggcttcgataacttacctaacagagaggtaatcttttcatggggcaccccacacttcacgccacacttaggcaagaagaaatgttcacagtctcagctgatgccagggaactttacagcaaaggaaacgttgaagcgcctcctgggctgtgtccctccatccctgtgcctctgtcatcctgtctacagattctcatgacagcaatgacaactctcaaccgattttctacataaggggtccccgacccccaggcctgtaggaaccaggccccacagcaggagaggtgagcagtgggtgagcgaacgaagcttcatctgtgtttacaggcactccccattgctcccattacttcctgagctcctcctcctgtcagatgagtggcagcattagagtctcataggagtatgaaccttattgtcaactgcatgtgagggatctaggttgtacgctagttatgagaatctaatgcctgatagtctgtcacgtctcccatcacccccagatgagaccatctagttgaaggaaaacaagctcaggactcccacagattccacattatggcgagttgtataattatttcattatacattagaatgtaataataatagaaataaagtgcacaataaatgtaatgggcttgactcatcccaaaaccatccccactctggtccgtggaaaaattgccttccacaaaactggtccctcatgctgaaaaggttggggactgatgttctatgtatatgatagaacatgttactgacatgttacattatatgtactattctgtgttgaagcaaacgaagctctctgtaagcctttcggaaatagtacagatacggaaacaggggcatctaaaagtcggccatcaggcactcagggtgacatactctgcttgccctttgttataggaaatgccctggagttgagtctgggaggtactgggaggtgtctcagcaggagataagcagcggggacttgccgtcttcctagatagtactgttacttggttggtacctttcatctcaatgcccatttgtgataccagtttgaccccagtagcacccaatttcagacttccccagccacctgtgacttagagtgagtagagaggcaattagggcacatgcttcgatcattttgagtgacagagtcttccagataaaaacaatataaaagagagactgctaagggtctctggggtgaagggtctatagatccgtcacttccacagggaagattgcttttcttggttgtttgctgagacctggggggcattgagcactgggaaatcaatgattgtacagctttatataaaaagggcacccagcaatgctcacacagtctacagggctcatttcttcctgaggcagaagagttttgctacactgacaagaatccttctggctggacacagtatgtcacctgttgtagaggggctagagtttgagaccatcacatttgctttctgcaagccctgaagatttaagagtgaacctacattgtttattgggatgttcgcaggttgtagtggtaagattggatcagcgcggtaccagttagcagagagggatgatgtttttaaagagtcttccagcagccacaaacatctatgaaagatacttccatcaaaaacaaagcttgaagtcaaaaaaaatggggaatttaagagcatctagatttgtctgttatgtgcaacaacttcttacctgactggttgtgccttgggtagtatcactggtgccttatgcatgaataatgtatgtataatgtatgtgtcactgccttagaataagcaacgtggaccacaggtcttgggcaccttaaataatttatatttaaaatctacatctagtcagagatgcatctgcatctacatgtaacatttatgaatgcaagtggaactttttttcccttttttttcaaaagctaaattgcctgtatttgagtgttagtgttccaattaatttagttgacatcatttcaactttgttggaatacctactacttacagtaagttatgtgggcccttgttatgaattaatgagagcaacagagaaataacttcagggaaagggtacatctttaaataatttacccacgtgggtaggtaggaaaactggatctgtggtcatgcgtagtgtgcgggtatccgaagctgggtgtccacagtcacatcgggtcctctgtatctgtggcacaagggcagacagagaggtcagtgtccaacaccatggaggaccacaggctcacctccctcaatggggtcagcatctcataaattagtcatgctggagccctctccaggagttcctggtgggagctaaagggaaggtgaactcctttcttttaaacactgctatcatgttaagatccactgccaggaactaggagggcagagtgaagacagagaaatgcaaagactgtattctgaaaagttaaggaagcagttctgtgggtgaggatagtgaataataatgttgtgagttgttttgatgagccaggcaatgtgttgatcacttcacatgtagtatggtctttaatttttatttgaaaaactgaaggccagacatggtggttcacacctgtaatcccaacactttgggaggccgaggcaggtggatcacctgaggttgtgagttcaagagcagcctgagcaacatggagaaaccctgtctctactaaaaatatgaaattagctgggcatggtggcgtgtacctataatcccagctactctggaggctgaggtgggagaatcacttgaacctgggagacagaggttgtggtgagccaagatcatgtcattgcactccagcttgggcaacaagagcgaaactgtataaaaagaaagagagagagagagagaaaagaaggaaggaaggaaggaaagaaagagaaagaaaaagagagagagggagggagggagcgagggaaggaaaaattgaaaaccctgaggtaggcaccttaattctacccatttttcaccttaattctaaccactttccagataacaagcacagagtggccaagcaactttcttactgtcacaaagaacagggattggaagccaagaagccgaaggcaccacagcgtctttttgaaacttggtgctttcgtgcctgcccaaattctctgattaagaaagaattagtttcctaattcttttatttttaaaataaaaataaaagattaaatcagatcaaacagttggccaatatacatgttggttattcacacgatggaggcctcattgcctgatacatcccatactgacagtagcagatttggaactcatgaaaccctcatcgcttcaacttcctgcaacaccccagctccttctaatagaacccagtgtctccttaattctttatgtgatgaatacgtattgagtagctactctgtgttagtccctggacaagagcagagcaaaggcaagaacgagataggagaggtctccctctcacagagtttggaatatagtagacatattcatagttctgactgggcaaaattcttctctcttacttttatccatagtttccagctctgaaacctaatgctacaaagataaaagttgcatttgatagataatgcaatggaacactactcagcctttaaaaaggagaaaatcctgccatttgcaacatcatggatgaacctggaggatgttatgctaagtgaaataaggcagactcaaaaggacaaatattgcacgttaccacatatgcagtgaatctaaaatggtcaaactcatggaagctgcatgggaaaatggttgcaggggcttgggggaggggattggtgtggtattagacaacagtacaaagtttcatttatacaagatgagcaactcctaaagacctactatttagagtttcacttaacattgtttctctgtaatgttgatgagaaaacaaaaatggtcattggtccctgggcctccctgctgtgtgctctgccgttgatgttacttagcttctttctctgtattgacatctttttgccttgctacctagttactaagtctctccaagtttctattccaaattcccaagagatcacaatgattgacgcaaccttaatcatatgagttggttcccctttggggtatgcccacctctggcccagtaagccatggtgctgtggcaaggacaagtgtaccataaggttggccccccccccgccccaggggctgagggttgggcagattaacctggaagggaaagggtatgtctagcaaattagaacaagtaagaagtatgatcacctgtaagttcatgctacattttctggaggtttttcttaattatttaattctcctctcagaccttctgtgactcccaaaccaataaaccatttttgtttggatgttgttcttttcttcccttgaaaaatactcattcaggttcttctctcattccttcaaaagagacttcaggccgggcgcagtggctcacacatataatcccagcactttgggaggctgaggtgggcagttcacctgaggttgggagtttgagaccagcctgaccaacatggagaaatcccatctctactaaaaaaaaaaaattagccaggtgtggtgacgcatgggaggctgaggcaggagaattatttgaacctgagaggcggaggttgtggtgagctgagattgtgccattgcacttcagcctgagcaacaagagggaaacaccatctcaaaaaaaaaaaaaaaaaaaacttcaagcaagggaggctatgctatcaaagtatattttcctcctcttctgcaaggggtctacatttaagtcaatagtagcacaatataagaagaaagactattaccagctaacatttattgagtatttactaggctatcagcactggtctaagcactttacaggttaaattcatgtattttctacaatgatcttaagcagaatttccttcattttcttatttccaaaattatactacctaatatagaaggtgatgatgaattttgagagataatgtacctgaatttcttattgttcatggtatatgcggaataaattgtgcctgctgattgctgtagtggtatcatcaactacaacattgttccacagctgagtggcatcactgttttgtagttccttaaaagagaccactgctctgaatctgactaaactgaagacagagcaccaaaatcaaatggggattcagatgtccaaaggatgggaggtgaatgataaaaatggttagagtcacaaattggaatccagtggagcgatagtgccgcagagtcaagatcctagagagcagaattctgagaaacccatgtccagagaatgtggtcaggaccttggagagctcatggtgatgtccaagtgtcttccacagtttagatctcagactagtgcaaaagtctgcatggggctccagccttgtaagggtctcatcttgttttatttggaggctctgacatagtggaactctgggtgccaaagggatagttcagaacaggaatcttctgacctggatagggcaatcaaattcttgattgtgttagtgcatcaggatccttgtcagataataagaacttttcatcttcctgtgtcagcagagttcagctctactaccagaatagaaaaaaaaattgcaaagtatatagcaaaaaattagcaaacagcaccaacttcttttcttatgtaacccacagtgaacaagaggcaattgtctcaatcggattcaggaacaacactgggttacatttggattctatgtatttttagatgtttaatttctatttgcctatttcatgaaagattggtaatcacacataaatctgcatgagtaagaagagacccatgaaaataaatagtcctacagatgtaagatttgagataaaacatatcttaagtgaatagattgtctttgttcttcatgaaccttcaaccttcatgccacataggtttggtgaagaacgtttttgatgtctgttacccacatggagggtttctgcctgtctattttgggtagaagatacttagaacaaaagtcgtcttgaagggaggagaatatcaagaaataaatcatgtctgtgttcctataaaactaataacaaacttggtaaacatgcatctgaaaaataactagaagtgctattctactgttactataaaggaccctgagtactgtagatttggttaaactgtgggtagccaagagggacgaggacctggattttgtcctgagcttttggcaggctggtagagggacaagtcccctttggataagtccccttttctctctgggtgtgtctcctcatctgtagtagaaggaccattggattagctggtctacaagattcctttcatgatcagaagtacagagtaagtatatgaatgatgcgtgaattaatgaacaaacttctccctgttgcgacattccaggaatagcccatggacttgcaaagagaggcaaaaaatggcatctaccagctgcttcctcttcttaggagtctccaacagagcctaataacatggggaagcattactaaattatgactttgtgcaagattattaactcggagtgaatggctattctttttggagattttaagcagtcatggaaccaggatggactcctgagatggacaactgcatttattcacttcaaacacaacatgataaaaatgtttttgaagctgtaattttacatcctgaaaaaaggttaaatttaaggcaatgtacaaagacaaagaatgactttgagcaaatgcattaatttggtttgagatgttcagaatttaatgttgactaaattggttaatctgaagtcttttgggagtggtgacagttatcctgtccttactgtaatcaatgtgcttgatttggtggaaattttacatatagccttacgaatccttttgactgaagtgcaagtttcctctagaaacgaccagttttaggagggcgtgtgtgtatgtgtgtgtttgtgtaagaacacatactggacaagacttcttgaaaaacagactcagtagtgtcaagcagcatataactctccccaaaccaaagcctcctgccctattttctgcctttcctctgctccctggcagagctgacctaccatctctctcggtaacttggcaccactactatccagaaactgaagtgggatgggtcgttttgtttattccgtgaagttactgtgagtgcacatcctggaatctgagagatccagatctgaatctcagtctcttgtgtcttcacagcctgcctgtatgactgggataaacaaccttaaccattagtttcttcatctgcaaaatggggatgtagtaccttcctcacagagcaattatgagactaaatgaggtcaaatacgtgaaatgattagcaccttgcctggtgttttgcaagtaagtgttcaacatctgagaggcactactagtatcagtagtactgttggtatttatcaggtgccttctgtgtaccaggtaccaggtgaatccccagagatgaaaattggaccgagtctgtattttcaagtagctcaaaatctagcaagaaaaaatggcaggcaagcaagtaatcagggaacaattgggtaagtgaggtgacaataaggcattaacataaacccagacaaggggcagtaaggaggggaggggctgcttcttgaaaaaggtgacatatgggatgactctttttttttttttttttgtttttgttttgagatggagtctcactctgtcacccaggctggagtgcaatggcacaatctcagctcactgcaacctctgcctcccgggttcaagtgattctcctgcctcagtctgctgagtagctggtattacaggcatctgccaccacacccagctaatttttctatttttagtagagatggggtttcaccatgttggccaggctggtctcaaactcctgacctcaggtgatccacctccctcggcctcccaaagtgctgagattataggcatgagccattgcacccagcagggatgaatcttaaaccaagtgacaaaaaggtaagaataatgactgatacattcagggatcagggatagtctgtgcagaggccagagagaagagtatggaggttggagaaaggcagccctcctctgccctggctccagagaccccatgtctgccacagcacaattgtctgagtcctgcagtaaatgctgtaaactgttgttgttggttttgttgttgttgttgttgttttgtttgtttgtttgttgttttcagttagaagcagtgtcattcatacaaatgaaataccaaacaggacccccatggcagaggcaacttctcattttatctcttgctcctcagcgcttttgagtctctccctgcatcacttccctgccctacacctgccaggtctgtgggtcctctttcatgtttgtagttctccaatactcttcaggcccagtgatccttttcagactcttgtcctctagaaaagcaattcagatctcgcccaaggcttacttctcggtttctggctataattgccctcatagtaccctgaccccagactcctactggatgccatccgaaagagttctcgaagccctcatctgcgctataggcacagaccactctccccagccctgacaaccctgacctcacatgcccttgggatttccgttcctcttccactgttctttttttttttttttcttagttgcagagtttttcggaaggactgattaccgagtctcttctttccccaagagtacttctttgtcacaaatgattccactccttgaggacatttggtgacatttaattcatctcctgttctctgcttggatgaattctgggaactccctgagaggaaggacaaggcagtggaacatctgagcaatgcgatctttatgtggtgggtgaaggtgatggattttcatctccttcttcacgttttttcctgctgcatggggacctctgggcattctcctttctcttccttgcttttaactgatttattcttttcaggcttatgacttttcttttgtgataactgatttattattttctgataagttattcttttgtgataactgatttattcttttctggcttctgacttttcttttgtgataactgatttattattttctgataacttattcttttgtgataactgatttattcttttctggcttatgacttttcttttgtgataccagtttgtaaatgtgtaacttgtctgatctttcttctttcagcacccacctctcatgctatagcgtttgcactccattgcatattgtttaagactgggactcatttgagttgtaacgcaggtgtgagaagctttgcaaggctacagaactgtgttcatccgtctcttgacttggactatggaagttgccacctgctcagatgccctgaatggtatgttgggctctaaattggcctgacagtaccacagtcctcttccaatttcttggggatgtccaggcattggataatggcagcccagttgcttctgcttgcagtggaaggaagggttggcatcgttccccagcacccaccatttgctgggaaggaaggactgttcttccctttctttaacttgcacctcaatgcataaagaatatctgccctttccccaacatggggcaggggtggcctgctggaatgggagttccagcttctttctcaatcccttattcactcctgtcataggaagacaagttgctaaatgactgtgggaaaccgaaacacccttccagccacatatactgttagataaggttcctggctctcaaaggcagagccccacctccattctccattctccctcttccactctctccatccaggtgcagcaagccgttttgtgcttcctgttccctggacccgcccaagccctgagcaggcatgggtttaccctccttgtaccatctaatgaggccgggcagagcatcagatgggaggttctggtcactctcaggcaaagccctgctctccagctcactttatgacagcactctgccttcagggttgtcatcacctgttcagataataatctagctcatcatttttcatctgcctggtgttctttgcgtgttgcttccagaggcagaatcccagagaagagagggaactgtcagctcctaagaatcactcctccagaaaagctcagcaaccaagaggaaaaaaaagaagaaacacagtgaaagaggaatgctttccttattcccaccctcatccctcacctattctttctctacttcctcacgttccctccatccctgggagatttaccatctgccattccctgtgtgtcatacagttctaggctctgtgcttctgtcctgcctgtgcctgaaattccttacaattttccccatttgccatccagccaacccctgcttattcaaaactcagattcagcctcccttcttccaggagatccttgactccccagccaggcttagctgccactcttctgggctttcccagtgcccagtcatggctctcatcagtgtattctctaaaaccattgacttcttcgccttccctagcaatctgtgagtctgtagaagaaaaggccatatcaatctaactttgtattcctggttcttggcacatagtgggtgaactcacacagactagagataaatcagagatgaatgagtgcccccttgagtccagggcgtacctgtaaaattgcaaatatctgcatgtacgagttgcaggcagggaaactgagtcacaagaagagttgcttgcataagacttcgctagtaaatggcagagctggtgcatgtgaaaatttctaaggcagaaatatgtacttatttaaaaattttttaaaaagcaagaaattgtctagacaagttttttctttgttcgtctgttgttttttgtttttgtttttgttttgagacagagtctcactctgttgcccaggctggagtgcagtggtgcgatctgggctcgctgcaagctctgcctcctgggttcacgctattctcctgtctcagcctcctgaatagctggcactacaggcgcccgccaccacgcccggctaattttttgtatttttagtagagatggggtttcactgtgttagccaggatggtctcaatctcctgacctcgtgatccacctgcctcggcctcccaaagtgctgggattacaggcatgagccaccacgcccggcctagacacaagttttaaccctgtaaattctgttgcctctaactgcaaccaaagccccaattcatcgcattctgcagagtgctgcccacattcacttggggaatcagcagcatgtacacctcattacttcacctccaaacccagctcacaagcaggcaggatgcgcaccaactgtccggttagcagagcttcccatttaaatcaaattctcttctcctcccaagctcatttcaaaggcattcattggtctgaatacatgtgctggtggaacgaaatgacactcaccccaaaacaaaaggaaaaaaaaaagctgatctgatgtaaaatctgtctgcatttcagagctgtcgagatgaaaaatgaagccacgagtttggcctttaaaaatattaatttcttataaagatgaactggagagtggtaactagaaaattcccttatctcctaggaagaaaacacaggatgaaattctggtccttcttcttgagtcttgtatgtcatttccaaattcaacgattacttgttcacggttcatttatgaggtttctgagcataatgaatgtccgcacatgtcactgagttattgatgaatcattgtttctattctgagctcagttcacgtagttcaatgtgctttggcttggctgtcactttaggagatgatagttaacccaacggagtaaatctggccagttcccgagtgggggcagggggttgggctcaactaagggcaccaacaataaatgcctccttgctggtagatgggaaggactgagaagacagaggggaaattgcttgcattctgctaacatctgcaacgtctgtaacagtgtcttttccagcagttgtaaaggatcctcactctccctttcctccctcagtcccagttcctcctccagagctcctcgtgatcatctcccaaagccactcacttgctgttctgtcctttgaggcctctgtccacttccagctcctgcctctctttcctggaccattgcagagtctcagaactgcctctctgctcccacttccatccattctctcactgcctccagaacattctccttttctgaaacactctcctctgcttgaaagtactgaaggcttcatcttgcctagtgcagcaattccacattccttataatctagtcccaaaccactgtctggcctcctctcctttccctccttctgaacaccctagattcctgccaaatataatgttattccacaaacctatgaggaccttgcctgccctctgtgctttgcacatgctcttcctccagcctttgcactctttccttccctcgtccacctgggagactcctgctgatcttttcagactcagcttaaatgtccccaccaaacctcccctccctctccccattggaaccagctccacactgcactccaccatgttggcatgtacagtacatgtggctaccagttgattgacagattgtccctgtaagccagtctgctcagggctatctctgacaaaatagtgtgttccccttccttggggagtaactttagacaatttgcagtggatactgggctgcagccttgatgctgttttttctctggaaactatgcttgaaatatatttgaatgaataaaataatacatctagtaaaaatacatttttctatttttttctaaaagtatcttacacattttccatcaggctcaattgtgaaatccctccagattcctaattatcttcttcccaagataacaagatttctgtcctctcttcacaaagacataggacatggactcagagacgtccaggcatctaactctctgcctgtctgtctctctggggaagccaatggtttttttgtttttgttttgttttgtttgagatggagtctcactctgtctcccaggctggagtgcagtggtacaatctccgctcactgcaacctctgcctcccgggttcaagtgattctcctgcctcagccttccgagtagctgggactacaggtgcacgccaccatgccaggctaatttttgtatttttaatagagacagggtttcaccatattggccaggttggtctcgaactcctgacctcgtgatcttcctgccttggcctcccaaagtgcttggattacaggagtgagccaccgtgcccagccaggagccagtggttttaaactgatcatcatccattccctttctcagacttaggtccctggtcctgtgtagcccctgttttcttacaaaacaggaagaagctctattgttggccagaaagcaaagcaaaggaacctgagcacacaggattctaactcatgctgttgatttcattagtataggtcttgcatcgtagatgccaaacagagtatccacttaccttggtggccacaaaaccaccttgaggactagcaaaagagccatatggggtcttttctgtctgttcaccccaccttctaaaatccccacctctcacacctggtctctgatgacacttgtctcggatgtgactctgtgtctgccccacaagatgatgtcttcatctgccatttaacccaaccctttctgagttctgatcatgttcctgcaccagggagtgagaatggcaaagccaaggaaaaacgtactgctgccctcaccgtactcatggtctagcgtggaacagcctcgctgctttactgggctgctgtgggaaggaactagcacagtgtatgcaatcactggaaaagacggctggggagctcaacagcaggagacaaagtccatcctagtattcccagagattctttctcatccttttatatatataaaaaaaaatttaaatttattatttatatatttatataaattattatatattttctatatattttataaaaattatatatttatatatatgaataaaatatattttatattttatatttataaatatatatatttataaatataaataaaaatttatatttttatatatataaatataaatatatttatatatttatatttataaatgaaactgtataatttttatataaattaatattatacattcatatatttataactcatccatatatatatatatatatatatataaaaaccttctggcgccacccaagggccagcacctccagctaaacattcaaaagcagaggagctgcattcctctccagcgtgagggaaccacactcaccaaagaaagccaaaacagaccccgttgacatgcacatatttccacaaacatcataaaagtccttttcactttatttcattaccagactatcagggagaatttcccagtggaaatcttcacccaatttgctccatatggattttctaccttattttactactgagaaagcagtctacatgttttatttgcaagagaatcaaaagatggaaaattgtcacatgagggacagtgagaacaggtagctgatagaaatacaattgacagttgcatcctggaagaagctctaacggtcttcatttctctcagcttgatgttgggccaagtttttacttctttaaaagaaaaaaaaactggcccttaaagcaataagatattgatcccttaaattatctgtgtattgaattaggctaacagaatctaagtttaagcaaatttgaaagaatgatcttgaacacgagataacaggccccgagtttgtactcccaggtaatggtgaccatacacttttaccataccagataatcaagaaatattgggtctgccactccttaatgtaacgctggcatgtgccttgagaatccagcacaggcagtttgctcctgaggaggaccaggggtaaagtttattctccctttttccttctcaactgtaattcacccctcaattactccctctcttgtattcccaaactgcattttcttttcgctcatatcctgtggtttgtctcaattctatgcagctaggtgcctgagctagaaactacctaccaaactggtgcctcattcccctggctcctcacatgaaacgtgcactccggccacagaacttagcagtcgctctgcatggggacagatcctggctctgtcatttcctctggactaactaggggaagtcatttaacattctgagcctcagttttgtcatctatgaagtgtgtcagatggtgaggaccatgtcacaggttgcggtgagagtcaaatagggataacttccagaaaactcacaaaggctgacatgtgttaagtgatcagtagatgttatttatttttacagtcatcatcaaaaccctaattgataactaggtattttttattccactttcctgtggtgtgtgtgtgtgtgtgtgtgtgtgtgtgtgtgtgagtttcactattgttgcccaggttggagtgcaatggcgtgatcttagctcattgcaatctctgcctcctgggttcaggcgattctcatgcctcagcctcccgagtagctgggaagagacagggtttcatcatgttggtcaggctggtctcgaactcctgacctcaggtgatctacccatctcggcctcacaaaatgttgggattacaggcacaagccacagacctggccttttgttccactttctaaaactctctttcattcctctgctactctccctcctggaccatctcgtctcacctggatggatatactgtcagtgtcaggttcgcctcttaagtcctcagtactgagcacagtgcctggcaacatatggccccaaaataaatccctgatccattgaattgaatattctagccctcgctcaccagttaattgatgttattcctggccacttccgggacatgggcagaggaaaagctattgaacatgtataatagccaaacatggcattcgtgatttagaagaattcggaacagacccaaaatatgctttggaaactcaaatcatccatcatttctcctataaatttcagtaatcatttctgtttggtttgttttaaggatttgatgcatttaaaatttaaatgtgggaaagttacgccttttgttttatttcctagtagtatgaccaatgaggcaaagaatccaaactcattaagtttcacacataaaggattgaaatgtgtacagtacttacagcgagcacaggctgagtgatgaagctctctttttaggccttgaacacgttgacatacgcaatatttttcatccacagaatatagtaagaacatcatctcacaccatgaaacattaatattggttttatgactgtgcacaatgcagtaacacattgctgagctgccaagaaatttaaagaataaaaaagatttagacactgaaagaaccttgaatcattgaatttggggaggtagggaggaaggttggagtatgcctaggagctgattatgtggcttccaacaagtgaactagagccaaactatgtgtattttaaatgatttggatccttaggtttagtactggtgggtgtggctcagttctgcctagtcaccattcagtggtgggtcaggaagccaatgggttcagcaaaaaaaccggaatgacagtctgtcagcatggaggtgaccactgaacctgtggaaggtaaggaaactactagaggaaggacagtgaccagcacttgtgacacatgctatctcttcccttttttgtacccatagtagacatcactaatcaatggcggcacctttgccctttgagtccagatataaccttgggatcctacttaacaaaggggcctatgcacagttgccataattgatacaatttgccatataaactgaaatgtaacattcctaaaatttttaaaaataaaaaacaaaggtagaaggaagcccaagttttgtcaatgaggctgcatttttaaaatgtaggtaactcttttcttatcacccagtagattctttaatggcaaaaaggccaggcttgcttaactactgtagttctctgtcaaatcactacactcatttatttggtaactattgaacacctgctttgtgacagcaacatacatgctaattggtagctgtcccattattttggcagttctcagttctgagccttgggacagggaagcctggaccatcttgctccagatttcagtaaattgggtccccgggatttaaagaggagatgaggatccccagatacgcttggaggtataaaggtatctccaagccacagttttcccgagacagtccttaagcgccgtgcccctcaattttcccagctgcgaaatgggcagctgctgaaaaagagaccctgcagcattgtcatgaggttcagatgagagagataagtgcctgggtcatagaagatgctctggaaatggcagcagatattgtcattatgctgatgttgctattgtcgtcattattttttgtctcagtgtacacccctgatgcatcggatgggagcaccttgctctccattcttagaaactgtgctcatgcacttgagcttgcctccaaagtctagagcctcaaggtcggcctgattattgacacgtttgactacctagctccaagcagggagagccctccaggccctcagtggtggtgttctcttgaagcctgtgcctcaaaaacactggtgaggaaaagcagctgtgactgcaggctgagaaccaaatacccaggtctggattaggtgtgtcacttacagttgctgctctgagatcagacccaggctcaaatcttggcctcaccacttaccaaccacacacctgtgagtcactgcagctcttgcgtgctcagtgtcctcatttgcatcacagggatggcattccgtgcctgcgattcactatgggtcttaacaaatctattccttctcttcccctcccacttcagtggtagcttcgcgaatcacgaccaagtcataccaggccctgttaagattcccatgtaacaacaactttctatgaaacaagaatttcacatacaacttctggggccaacagggctccagaatttactccctgcaatatccatgaactccagttttaaaactccaacccatgaaaagtaatttctaaagggaacaatgtgaaatacccaagagaaatgaaaacacacatccacagagaaaccatgaacatgaatattaatagcaacattacgataatagctaaaaagtgggaacaacccgaacgcccatccactaatgaattcataaacaaaatgggcctgtccatacaatagaatattatttggccataaaaatgaacgaagcactgtgagatgacgtatttttgttgctgaagccacctggcttgtggaactttgttccggcagccatggaaaatgaaggcagatggtgactgctgatggatatggaatttttctttggggtgatgaaaatgttctaaaatcaattatggtgatggtgatggttggacaactctgtaaatatgctaaaaacaattgaattgtacactttaaataggtggattgtgcactatgtgaattatatctcagaaagctgttacaaaaacaaaaacaaaaacaaaaagtgtcccacactatagccagaataatcttatcaagtcaaccgcctggttaaatcaccaccgcagggatccttttcctctcaggagaccaatctgagcctgtccatagatctgtaagacaagtaccatctgacccatctccatccagcccctgctcacaccacgtgtccctctgtctcggccctccagcccgggggtttccatcttcacccatgcccatcccagggcctttgcacatgctattcatgacctggagtattttttcaccttgctccatcctattgtcctcattacctcttaacctcccgtcagattttagctcaaccatcagtctcttgagaagcttcctggtctctgagagacggtcaagtccttcatggaggtgctttcattgcacccgaacctcttcagctatcatttcaccattagaatttagcataaacttatatgattaatatctgcctcccacactgggctatagtttgtgtaagagcaaggtccaggactatttcactcacctttgtacccccagaaactagcacatagtactctttattgtatttttttaattgatgtaaaattcacataacataaaattaaccacgttaaagtgaacaattcagtggcgtttagtacgttaattgatgtaaaattcacataacatgaaactaaccatgttaaagtgacaagttgagtggcatttagtactttcacgatgttgtgcatccaccacctccagctggtcttaaaatatctttatcatcccaaaaggaaactccagagccattaagtagcctctcccacttcttcctccctgaccccagtccctggctaaaaacaacctcctttctgtctctatggatttatccattctggaccttccatataaatgaactcattcaatctgtgacattttcgtgtctggagtttttcacttagcataatgttttcaaggttcttccatgttgtagcatgcatcagtatttcatccctttttatggctgaataatattttcttgtatgggtggagcacattttgtttatccattcgtctgtttatggacatttggcactgtttctaccttctggctaatgtgctgttctatgaacgtgtgcatacatgtatttctttgagtgcctgtttctaattctttggggtatatatctagaagtagtagctctatgtttaactttttgaggaaccatcatactagcaccatatgtggtattacacatagcagtgataccattttatattctaaccaacagtacacaagaattccagtttctccacatccctcccagcccttgctattttctgttgttgctgttttttatgctagccattctagtgtctatgaggtgccatctcatagttttgacttacatttatgtcatgattagtgatactgaacattttttcatgtgttcattggccatttgtatatcttctttggagaaatgttgattcaagtattttgcctacattttaactatgttgtagagttataaatgttgcctacatcttctggatagtagacccttatcagatgtatgatttgctgaatatttttattccattctgtaagttgtcttttcactttctttataatgtccacttcattgtatttttaaccaactaaataactaataagtccagtgacaggcatttagatgacatttgtgggcaaaacaatcaaggactcccatatgcaattactaatttatagctccctggatacctgggggtcaggaatcagtctgttgattggctgcgggctttcacttccatccaagcatcaggtcacatggtgccgtcatagctgcagactcacttgtgaataatggatgtcttcatataggaagggttaaacagcccctgtcctactgtgtccactgaccaagtccccttcatgatttatggatgatcacattgaaggaagaagagaggaataggagaagatgaggtttcccagcacgtccttttcaggacctccatgtcacgcctcactgccaattaacatttacttgaattcttggttccctccccagcagctgttgggtccagctctctggggatgtctgagatataaatgctcagacctgcacactgacatttaaagagccagtgaggggtctgcattctttatttaacaccttctttctgttgcaatatgaggtcctcccagatgcccctatgggaattactaatggccatcacatcttggttcagggaatggttgtctgcttttaagcaaagcctgagactcatgggtttgtactgcttcccagagggctgaggaggagaaaggggtaggaaggccacatccgtcaccctgtgatggatgcaccttgtgatacatccccctcgaaatcacgtagatgcatccaaaagcccttaaccattatattttgctctgataataaagcttagtcttttatgaccactaaataatacgtgtttactgtaaggaaaggacacaaaggataaaatgaacattgcataactacatcacccagagataattgctgttaatatcttgctgtatataattctcctgctctatttatatattgtaatacataaataccttttccacaaaaatgagagttcactattcatacagttgcataacctgcctttgcttctcaacaatataatagaaacattttccatgtcattaaatattcccctactaagcatttatttttaatgtgggtgcctctggcttaaacagcagcaatcttcagtgctgcaaagagctatgcttggtggatttgaatacattcttctgctcagagtattatgagtttgtttaaatggtacccgggtgaaaatatatcgctggctagccattcctggagcaggaagagtgtctagtcattcttgacttgctcaaatcctgtaaaattaaccatttctcacagccgcgggctacttttctggatgggaaaatttgctgggacttaaggttccagggcacagaccgggcggtcaatccctggcagatctgtagctctgttaaaggagacagggctggttaaaatttaaataaccctggaaggtcccaggctgaaatatgctacagggagacacaaataagagagacgcacaaatgtcatgagtgttcaaaagcagaagaggtcacattccacaggaagcaaaaggggaggagaagcctgagctgacccttcaagggcaggtccagtttggagaggtactaagggcagtaaatattcattcaggcattgactccactgatgtttaatgagcatctattaatactgcatgcccagcagtgcccttgctgtcaaggatatgacaatgaacatacatagatggtctccaacttcaaacaccttacagattggcacaattcagagcaatagttagcacaataggagagactactggatacagtaatattaataactgctcaataaatgtccactattcggtgtcctatgtgtatcatttcattagtgctcacaacaatgcggtgaggcagattctattattctccctatttgcaaactgaggcttagtgaggttaacgtacctaaagtcctatgtgcaggtagttagtagcggagtcaatctttgaacactttccgcctactgagtgtctgttcctgttatgaaaagcattttgcacatttcctcttatttaatccttctgacaaccttgcaaaggcaatgataaaattcccatgtttaaagacagtgttataaacacagagaaagttgtcatttgtccaggcccacagtaagaagtggagcagggctgtacctactgtggcctgaggaccactccatgcccactctacctcactgttaccacctcagtgaggcagagatcctggctggactaggggagagtgaatcaccccagggagagccatcctaaggctgacttcctacactgtcattgtgttagttctcatattcctataaagaaatacctgagactgggcaatatataaagaaaagaggtttaattggctcacagttccacaggctgtacgggaagcatggctagggaggcctcaggaaacttacaattatggcagaaggtgaaggggaagtaggtatgtcttacattgctggagaaggaggaagagagagaagggggaggcactacacacttttaaacaaccagatctcacaagaactcactatcatgagaccagcaagggggaaatccacccccttgatccagtcacctcccaccaggttcctcctcccacattggggattacaattcagcatgagatttgggcggtgacccaaatccaaaccgtatcaatcatttatttcattcacaagtgcgtattcagcacctgtcatccctggagctgtactgatgtgaatggagtcacagcccttgataggctcacaggacacaggaagccaaatgtgccattgtgataagtcagatattatgttaaatgtaggcatgggtataacacagtgtgggggcagaaaactggactcccagttagacagggacaaattagggcaggcttcacaggggagtaacatttgagctgacacttaaactatgagcatgtgcttacctgggagacacctggacggaggctgtcccaggcaaagggaatggcgttttcaaaggctcagaagtagagagagcatggcatgtttggctaactacggccaggaattaagtactgctgatagataatggatgaggggaggagtgggaggaaatgcaggcagagggggacagatctccaagggcctatggtgctgtccacagagtttaaatgttatcctggtagcaacagggagtcatgcaaggttgtagagaagtgtagcagagtgattggcattgagtgtcagcaagatcattttaataaatatgtgcgtgaggtgatgctatggaaccactggggctattttttgtggcctgacttacaggagaggtagtgagaatagaaagaagacaggtgtgagcaaattaaggaggtagaattgatcaacttagtaattgattaaattggtccaggaaggtccaaaatctaagactctaagatcaaggtaactcagcacccagttttcatttctgttcatttctctctctctctctctctctctctctctctctctctctctctctctctctctctctctaagtcaggtcagggtctccatctgccacccaggctatagtgcagtggtatgatctgagtttactgcagcctcaaactcctgagctcaagcaatcctcccaccttagccttccaagtagctgagactacaggcatgcgctaccatgccctggcttatttttatatttctttgtagagacagggttttgctgtgttgcctaggttggtcttgaactcctgagctcaggtgattctgcccgcctcccaaagtgctggtattacaggcctgcaccaccacacccagcctgttcatttctagtaagtccattattttacttcttttatttgttcttattaaagtttccatgctgttggagttaattgtaagtagaaagttgagaacggccaaatgtttggttggttgctgagcagaagagcaatacttagcatctttgttacataacagatctctatttgtgggagttaatatttataaaagaaagaaagatgcattacccatagatggtgccatttattctgtttatttttaaaatgcttttatgttgttaaaatcctagcctttggttttgcatctataatgaaagttgggcagattgtatttcagctggcatggaaggagaagatcttttctcttttacaaaaatcattactgcatttgttcattgatccaacaaatgcacgtgggcatttggaaagcaggtatggtctctgcccttccgaagctgacagttgagtcatttatccctgagtacagcctcagtatttacccctgttttaaacagctactcttccttaaacattgatagaatgtcagaaattagtcatcaagaaccaagggtgactttcagtggttatttaatatttcagacttaaatattcttcccacatgctcctgcctcaagacttttgcacttgctacctcctttttctgaaagtttctcctccaaaatatccacatctcctccttattcctttcatgactttattccagtgaagtcttctcaggccaccctatttaaaacagagccttggccaggcacagtggctcacacctgtaatcccagcactttgggaggccaaggcagtgggttgtttgagtccacgagtttgagaccagcctagtcaacgtggtgaaatcccgtctctacaacaaaatgcaaaaattatccaggcgtaggggtatgcccttgtagtcccagctgctagggagactgaggtgggaggatcacttgagcccaggagttcaaggctgcaatgagccaaaatcatgctattgcactccagcctgggtaacagagcaagaccctgtctcaataaataaataaataaataataaaagaaaactgagtctccaccctagaactttctccctttttatttcatctcctccttagcacataccactgttgatcttctttacaatcattctgctcatccagaatgcaggctctaggatgagggcatctttgtgaccttgtctatggctctgtccacactggctaaaagattgcctggtcctgggtgggtgaatgtttgtggaattaatggatgacccctctctgagccttgagtttctctcctgaacacagggttgtcaggggggtggttagtagggtgtaagggaaaaagagtagcagggtcccaggatccttggctctgtgagggctgctcccagcattttaggctgatcagactacttctgcagggcaatgctgggctggagttggtcttgctttacgcagatgtttctgggttacacaacacttggcttaatccttttttttttccatcaggcccataagacaatttaaaggaatgaaaaaatatgtatgttttaagggtctagacctaatgctagcagcatccctttggagaggttttttttgtttgttttgaggggtcttttgtttgttgagacactgtgcctttcaaaatttaaggtactgccttgttatgcaaatcacacatgtttctagtagaaaaaaaagtaaaagatgtagagaaagcaaagcaggcttcccatggagggataaatggatccttcccagcccacccactgttctgaggctgctgcccataagggttgttaggacacacaggagcctgagtggccaggtctctcaggagtggagacattcacttcccagccgtgggacatttacccaaaccactgcaaagagccacaaatagcataagaccgtgtgctgacggccagtggaaatggagctcagcgttgacagagcttcctgaagactgagctctcttgaaaatgtaaaattgctgaggaccttaagcagagtccgatcaaccgtgttggcccagttggactttcagcctgaactctaagaagcatggtccatccactgagcagaatggccattggtggagtttgcacttaaccatgtttgttaacttcctagggatcctgaaacaaatcaccaccaactagagggcaaacaacaactgaaatttattcagtttattgacaatcctagagccctgaagtccaaaatcaaagtgttggtaggccttgctgtctctcgtggtcccagggaggatcccatctgcttctgccagcatctagaggccccagttccttagtttccagctgcaaagctccagtctctgcttccaccttcaggggcccttctccctgtgtcttctcatcttctgtctcctataaggatacttgtagatttagggcacacccagctaatccaaaatcatctcgtctccagatctttaacttaattacatctgcagagacccatttttccaaataagatcacattcgcaggtactgggggttaggagttggatgtatattttgggcgaccaccattcaacacatacaagcccgtggagatagcactcacttcactttgaggagctatcattcttagttcctttgattttaaagctcatatctctgtccaggatttattgcacatctattctgtagttttaactgtaatagcttccacttgctgattttgttctgtgcaccaggtcacatggtcaacgatgtatagggattatcccattttatcctcataatagtgatggagggaaggtaagattgctttattttgcagaaccaggatgtgtgggcatcaaagagtgtgatttggtggctcacgcctataatcccagcactttgggaggccaaggtgggcagatcacctgaggtcaggagtttgagaccagcctcgtcaacatggtgaaactccatctctactaaaaatactaaaaagaaaaaaaaaagccgggcatggtggcatgagcctctagacctagctactccagaagctgaggcagaagaatcacttgagcccacgagggagaggttgcagtgagctgagatcgcaccacagcactccagcctggatgacagagcaagactctgtctcaaagaaataaataaataaacaaaaatttaaaaaagcagagctgagatttgtatccttattttggcttaaagtccttgctgttttcactatgccataagtgagcaaaagcagagagttaaagcatggtttctggctgggcgcggtggctcacgcctgtaatcccagcactttgggaggccaagatgggcggatcacgaggtcaggagatcaagaccatcttggctaacatggtgaaaccccatctctactaaaaatacaaaaaaaattagccgggcatagtgacaggtgcctgtagtcccaaactaaggaggctgaggcaggagaatggcgtgaacccaggaggcggagcttgcagtgagctgagatcgtgccactgcactccagcccgggcaatagagcaagactgcatctcaaaaatttttaaaaaatgcatggtttttgcttccaagcacctcataagcagagaggaagggacagagaactatctatggtttattgggacacgatgtaatatatgctacaagggaactgtgtcaagagctctgcagtctttctaccctggaaattttagtaaaggcttcaaagagaaagtgacccctgaggcggtcatttgggaacagcaggacttggctgcgtctgaatgtagagaattgcattctgggcaaagggaacagcatctgtgaagaaaggcaaaagtgagtggaccacccacatgatccctcgatagtgtccaggagcttctgtaggatgtagtgttatgatgctgagacactgtattaggctattcttgcattactacaaagaaatacctgagactgggtaatttataaagaaaacaggtttaattggcccatggttctgcaggttgtacaggaagcatggtgccaggcatctgcattgcttctgatgaggcctcagaaagcttacaatcacggcagagggcaaagcgggagtgggcacgtcacatggcaaaaacagaagcaagagatagggggaggtgccaaatttaaacaaccaggtcttaggagaactcactcactactgtgggggtggcaccaatgaaagctctgccccaagatccaaacacctcccaccaggccccacctccaacactgggggttacaattcaacatgagatttggtggggacacatatccaaaccgtatcagatgctcccgagccatgacttagatttgaattgctgcagacacgtgtctctggtggcttcctgtgtgccataccctaagctggcgtgggtggccttcccttcctgaacagcgtgatgctggtaacctgggacctccttccaccttcctgcactctataactacttcccagatcactccgaatttatatttgccatctcaggatatggcaaagtaagacacaacagtaacccaaactaaggcaagggcagtggggatgaggaggttggagtcgtgtgagagtctgtttggagaaggaaatcagtgatactctgttcagtgggtgtgggagaggaggcttgacacgagggggccccagttttgatgcatctaccagaacagggaaggactgtgcttggctggggagctgctgagcttgctttgggccatgctgtgtttgcagtgctcgtgacacattcagctggaaatgttgaacaagcagttagaagtgtagatctgggaattaggagacagttggtaatggaagctgtcagagtccacaggggtgggtggaaccaaagctggaggaataagcaggatatccaagaagaaggctgaccattagagactcggtggagattgcttaaagagctgccaggagtggcaacctaccaaaaaaaaaacttatcattctcccagcccaacccatacagggctcgtggaaagagctgggaaatgggctcccacgtggaatctttggactagtaccaacaggggttttggctactggggaggtgaagaatagtactgtgtatgccccagggtgtagcagttgagagtataaggtacagacccaagaggttgggtttctatcccagtgccaccacataggagctatgtgtcccaggacaaaagaatcctcaactgcacaatgaacacagcaaccacagcaacttcacaggggtatgttgaagaccaactaaggtaacccacctaaagggttgaatactatttccaacatgtagtaagtgctctgtgcacgtagccatgattattataatgacagcgtgtctgagtggagcccggatgaactggcaagcgatgaccacctgtggactgcagcgggaaggtccgcagcctggggctagaaccacaagggagcgtgatgcacacaggtgtgcttgcacccacggctgaggtttttcttcccaccggcacagggcgctgaggcagggatttcctcccagagagagggcggttgagttcagttcccctccactttgaaaatggctctggaggaggggcggaggaaaggcagagactccgtttattgttatttttaaaaataaaatgaaaaggagccctccaagggcttgtttatgggttttattattggcgaagaagagcacacttgtctttatcaacatcctgtctgtctgggagtctgagccgagaagggcaagaccaaatgttaagtcgtaacatctgacttgttgttccttgctctgctaacgatccaggctgttaagaggcttagcccttgtcagcagagccaatacaatttcaagaacaaaatgactgctggagcccagatcagaaaagggctgcctcgtgggagcaggtcagggcagtctattaggcatcttgtgcaaataatgctgaagaaaggtggtcagagaagctgactgtaccaggcataaaatcacggggggagccttccagaataatctgtggccgggttatgctcactgctttttctccctggtccacgaattagcttttggacaacagctgtggtgtaactggaatccatcttgtgtgattttttttccctcagatgatttagaattagttcaatttattttcaaaaagtataacccaatgacagcagaaaggccatgtctcaaattgctttcctgtccatggctagagtgggtgggtgtcatttgctgatttattactctctccgtgggctcctttcgtttctaaagccacctggaattatggccagcaatagaactctaaaccaaagtcagctttgcacgaaaatgcatttgacttaagagaccacggaaaatgctgattaaaagtaaccctgcatggcaaaatttgattaggagatcacatctgaatgggaacaggttcgagggaacggaggatgaatcaggctcagcaaagccaactttgattgcgcttttctaaggggaggatgtggtgctgattaaacgtctgaaattagtgggcagggaccattaacatgcaaaggactgatattaggcaaaggttgtaaagctggaatggctgcaagtcgtagacatttaaaacctagttttagaaacatccaccgacccctcggtgagctcctgtgcttctgtcactgggagtcagtaattgaattttctggacgttttgaccagtatgtaactgtgtggagccgattacacagcagaacgcaatttttagcctgaccttaaaagcattaccttctgctgcgtgattagaaaacatacagagagtgccgcccttctaactgcacttgatttggggaagaagaaagaaaaagaatcaccttgctattttatgaaacctggtaagattcatttagattccacacagatcatttaataacagattttgtaaaatcttaacatacggagccaccataaaacgtattatcttttattacccatacagagaatgacattttagatggtaataaattgaaacccaaggaaagctatttgctttcggagagtgcttggcgaatgacaggaatagcagtttcccaattttacacggtggcaaatatggccccccagggtcattggagccagcccccagctggctttgttgagatttatctgagcaacattctcttatacctcttttttttttttttgaaagatcatttccgtccaaacctcaccacatgaggacccagttgtcataccataacatccctccttccatcccgtacacctggagatgtgtggctggcctagggctgagcctggggctgggaccagccagtggggcatctgcctcaaggtggaaaagagcccagcccatcagctccaaagcagccacagcctccctctgcatagacacctctccaaaggagaaggaccttccctgcacactcttggacagccaaagcctcatcaccctgccacgccccgcaaaaccaggctttctagagactgattcagcctgtctaacattgcccatgcctgcctttggacctgtaacatctgcagaccatgagagcaacctgaggccaaatttgctgtgtggtgatcaacataaccgtttcttgatttactcattcattgaacatttactgagagtgactgagagtgaactagtttgtgtgatttttcccccaggagatttagaataagttcaacttgttttcaaagactataacccgatgaccacatacaggcagtgtcttgggacctcagtgtctcaaggggcaaggcactggggctatggcaggaataagttaaagacagaatccttgccctcaccaagggctgtaataaatacttagaaagtgactgacacattggaaaccacaggcaccaaagggaagcttctccggtacttgatatttaccactttgtagatggcaggacattcatcttcccactagacagattttgaaggaaaaggtctggttgacatcacacttcaaaggattgaaatggaaatattttccagagaaatgacagaggatgtcatcctgggaaggcaggccccctgggaagctggcaggtgggcgaggaatgaggtgcggctggtgaggccacgcaccacgtggagccaggaggctgctgggcgtctcagtgttccaggaaactcagcggtcaccccccagagaaggtgtactcgtttcctgtggcttccataacaaatgaccacaaaatccgtggcagacagcagcacaatatattatcctacagagctagaagtcagaagtccaaaataagtctcactgggccaaaaccgaggtgtcagcaggtctggattatttgtgagggctccaagggagaatccattttcttgctttttctatcttctaaaggcccctggaattccttggctcatagcctcttcctccatcttaaggccaacagtgtaatgtctctcctcgtctccctgtctccccatccccctccctcttctctctctttccccttattctttctccctttcccccccccggacccctctccctcccttcttcccctctccccctccctctttctctctgtctccctccctcctccctcccttgccctctccctctcccccaacaccatcttctctgcttccatcacccatctactcccgctgacactgatgtttctgcctccctctcatgaggactctcgtgatcacattgggcccattcagttttccagggtggtctccccatttcaagatccttaacaaagcctcttgtgccacctaaggtaaaatattcacagattccaggaattagaacatggccatctttgatagatgtttttctgtgtgccatagaagatacgagagcttctagatccaaaagcctggtggcatttagagctcacttccactgtgctcgatacatgaacctgacattgagcatctcacagcataatcacaggacggacgtgtgaagggaaaattgctatacagtgtcattatctcaaccaagagagaaacactcaccgtgccatacagccagggctaatgcagggaaggcaggagtgactctgggaagacaaaccttcatgatggaggcaaccttcaagcaagtgattgtttgattatcacttgcttgaagtgattatcttccaaaggataagtgattgtttcctggggcttaggaggtgggggcgggaaatgtgcagggagggcagagggtacagcataagccaagctgcagagatgcggaggagtgaaaaagcctaagaaggtatgaattacaaatagctcagctttacagaatataacactgagtgaggagaacaaacagatgaggccatgaagagtttgtctttcatgcttgaaaaactcagacattatcctgtagccactgaagggttttaaggagagtccttggtcagatggtagctggacagttcgctctggctggctttggggtggagaggggcatagaagaaggcagggggaccaacctggaagctgttgcataagtcaaggaagaagagatggggacttgacatcatgtgcacacagaggtggtggagaaaagaggacagactcgagaggaaggggaggtaaaatcaggagcactggatgagcagttgtttgaggtaagagagagggaattgctacagagactcccaggggccggctggagatgatccctccgggaagaacggccaggttgtggggaagatgggttctgatattggcccatggaggataagggagagcatctagtggagacatccataacaagattgaaagcaggcgagatgctgtttggtgtcttagagagagtctgttttttctcgaaatggacgtaaaaaaaaagaaagtttcaaagagaacttttggaaaactatgattttcatttttcatttaaattgcatcataaatgggtgagttttaaagtaaaacatctaagggtacatcttgacctgcattgagtcatacattcattcagaacaatgctaaccgaagtgtgcccctaaatcgacgacatcagcgtctccaagaaacttgtgagaaattcagatgctttggccctgccctgaaccttctgaatcataaatgctgcaggtgggctgtcaatctgtgttttagtacacccaccaggggattcttttttttttttttttttttttttgagagggagtttcgctctcgttgcccaggctggagtgcagtggcgtgatcttagcacaccgcaatctccaccttctggtttcaagtgatcctcctgcctcagcctcccgagtagttgggattacaggcacctgccaccacacccagctaatttttgtatgtttagtagagatgggggttcaccaggttggccatgctggtcttgaactcctgacttcatgatccacctgcctcttcctcccaaagtgctgggattacaggcatgagccaccgcacccagctggacaagcactttcaagaagcagtgactctgactctatgtcttacgtacctgctatgtaccaggcataatgttgctatgtcagggcccaggtctagaaaacaaaagctaatgtggcaaatagtacttgagcatctcaattactttttattttacttcagtgttacaatctgtacttccttgtctgaatctaacagattagcctgttctgttctgctcctaaccagccatgtgctcctgggattcactctgtttcctctcactgtgagttccttgaaggtagggcaggacgagaaggcctcgaaggtacttttgagaacttgtgtctcttcacctcacaaaccttgactccaggcacgctggtggccctgttgcagcctgatgtctccactcttattcccaggcccttcttccttctctgaattctctcccctcacacccatccttcaaagctcagctgcagtcttacattaacctgaagccactgaaaagccaccgaagcactcccagttagtagacagctaacttagcacaggctgcctgctgccctggggagccacttatatatcttttatcttcacccaagccgtggcttccttgaaggtcgagagcgtactttttcttgtccctttggtgtcctgaacagaaccagaatcagccttcccttcttattcaatgactacttttaatagagtttagggattaaaggtctcccaccttcttccatataatttgactttcagtccaagacaccatctctaatcctatggtagggtatgcccttctgcaggaatcactgcttaatctcttccggcctccacctctccacctataatgtctaagtcaactgtcccctcctttgtaattccacagaactctgtgcttaccccatctcattgtgctgagctcatcagggtgttggtctctcccacgggacttgattcctgttacttcttcgcaccatcccgcacaatgcctagcacacagtaagtgctcaatcaatgtctgatgaattaaataagctccatatagctttcctgagcaccccacattctgacccccttcatgtaaaccttaattggtattaataccattctgataacacttatctcatctgaccttacgtacttgccttttgttcatctctctggaccagaaatgcaccaaaagcagagtctgtatcatttatcacatcctagcagttatttgagcctaatagacactaaataaatgtttcagtgaactcacactgaatgtcaagtatttgccaccttgagcctacaggagatgctttttccaggggttctaggaacgccattggcagtttatttactgtaactcatcagtggcagcagaagatgcacacattgcctggaaatgttttatttgattttggtgtccctcaaccgcaaatctatcatttaggctattccagccacatatgtctaagagacagtgtttatttcccctgctgcttctccaccctgccagctttgtcgcagccagtaaatctggagaaatgagcgctgccttctccttgcccaccagcccccagccacgaatgcaaaaataaataaataaaaaataaaaaacagcaggtgacagccaagaatgtgaatgttcacattcgtaccaagaggtaaggtgaaaagaggcctaaagacaaacacaagtcaaaccaggctcaccctgctgcctgggaagatggaagaacatcgctcgacctctgcagtgggaataaggcacattttatgaggatgtgtaagcggttcctgctggatttatggactacctattcccagtgttatgtggccagagtggttaaatcaaactccagacagacaacaactcgttctgcttcagatagtgttttcaccaatcttttgcaatatttatagactaggtgtcaggtgcagccagcccggggaagaatgtggtccctgtttaggcttcatattgcaaggacgcttgtgatgcccagctgatcgggacaaagctaaagaggaaacgaatgaatgaattccattacatctttgctatgtagctcatgttaatgtttctcattaacgataccttaaatgttagactagaaagggatttgctaacaaaaatgccttcttacagccttccttgactcctagagcagcatgtgtgtgctggagcccattctcactggctcacaatagccaactggtgtctctgtttccaactaagtgcttttggagtggaatcatctgggtagcttgaaatcagctatggtaggagtagttaaaccaccaaaattgacaacagtacaaatcaggagaatctgttcttaaacagctacaggtataccactctattcattattttttatatattatatataattgtatatttatgtaatagtgtataaacatacagtatataaaacatgttatttgtcctgtaataattgtaatcaatattatgcaataatatgtaatcatatttatgtaatagtgggctaattgtgttataatatgactaattgttacatagctatgatgtcccaggcagtgaattttatctcccaggcagagacataaagcctctaaacaagaaaaggcccctgatctcaagaagctcggattgtcatagccacgatagccactaaacaagtaatcagtaaacaagcacattatagactgtggtagtggtaggtgctggggaaaacggtactcattatctattgctgcatgaaaaattgtctcaaaacttagtgacttgagacaagaagcactgattatctcacagtttccctgctcaggaatctgggcatttcttagctatactctgtgcttaatgggcactcacagagctacaagcaatgtgttcagaatctgctgtcttgctggaagatttgtctaaggaaggctccacttccaagttcactcagtggctgttggcagcatggttggcaattgcttttggctcttcctgaaggccaccctcagtttcttgttacatcttcgaaagacttcccaaaaattctactaaataatagcagtagcatctctccagcatttacatatgccaagctctgtattcagcactttacctcttttaattctcacgtatcctataaggattattctcccccactttacagatgaggaaatggaggcagtgagaacataagcaacttggctgggatcactcagctactaagtcatggagccagggtgataataattgatcacatattgattgactccttcttaaatgtcaaccatcctattgtgcaccaaggtccctgccttcgtggagcctctgtgctgtgaataatgaccatcagcaaaggagcaggaattcacctggagcaagaactagaggtgaaacattcgatatggaaaaagtggggtaccatggaaagaaattcggtctagacaaactgtaaagagagatgtagagtgcagttcaagaccaggcgagagagagatggggtactgtgtgggttaatgggaaaacctttttccacatcacatctatttgttgattttccccccacagctaccactatgcttgttattagtgataaatgttctgttaaatgcatacctgtgtggaagtcattgtagctgtgcaaaacgtcgagggtctggtgatggattaagtgccagatttaatgacatggcttgattcttttttcaagatgagatgtttgcttttcaaatcagtgtgatcagtgaacctggcctgtgtctgtggagattcactcgaggctttttcttgcagacataccatcttgcttttgtttctagaatatatattagctggtagctagttgacacccaggaggagacagcaaatgcaatagaaatgcatgactgcagaactcaaaccaggagagcagcttgactctcttagatatgtcttacaaatcagatagcttcaaataaaatcagaggagccaatttaagttttccagttttgacacagtgcatttcttcctccaaataaaattctatctccttgagctgcagttccgcaaagtataagtcattccctgagaataaatgactttgctttggaaatgccactgatatgctcagacctttgagacataatttagttcagggaaacagtaatatatcatcattatcaataatgaaagtaaatcgcccaccttgtgtgctgactactggctaggtgttgcagccaaaggcatggtccttgcccttgaaaactttgtcatccacttagggagatagtaaatgggcattcaaaataaagcaaaatgggacacatagccttcatattaaacaaggtaagctaagcacagtcataagcagcccttaaacctaaaaaatggcttatgtcttgctcacatcacagtctaaagcaggtcaccaaaggggctttgagctatatagtcatttggagatccaggtttcttccttttgaggaaatagaaagtgtgagaggttacatgggaggtttaagaaccacaccaagtacataacttctgctcacgttccactgaccgcaatcagccacacaagtccatttgactgcaaggacgcctgagctgtacagtctagccctatgcccctggaacccaaggaaataggatccagtgaacatacaacattgttttcaccacaagttcctttgcttgcaagtaactgaaactcattcaggctggttttggtacctaaaaggagctcttgagtatacagtggaatgagttacagaatcaacgaaagcgttgaagtcaggggccatcaaagctccagtccttggcagccaagctgcttcttcccggcagagcagcaccttttgcaaaattcagctcaaaagctgtttggagttgcagttgattacattcgtctttcctctgagccttgaaccaaagaaacacagaatcaggtgaggcccagggagaatacaacttgatcttgagaatggggttgaccttgataatggggcccccttctcactgatgagttcactcacctagtgacagggcagctggacaagtgaaagtgaacctggacaagtgaagaggcaggttgccttcctcatgggcagagagaagcacaagggtggtgagtttcctcccaaaacattcaaggcaaaaatccctctattggtcctaggagttcggggtttaccctacattcctgttttcctgactctcagtcccacatttcctcttttcagaatccagttgtcccagcttgaattagggagttacctgtgaatttagtcaattcttggcaagagagacaaacatgacaagtggccactgggatctctttctctgcatcaaaatttcctcctggagaaagggcatctgtgggctggacacctaaagagcatctcttccagcagagtaacaaatgcagagtggccagcgagggatacagaattaaaaatacatgtgtatatttcaagtaagagtgactccgagagctaggaaattagggggtgactttctggaaaaggctctgaggatcgggaagtaggtcagaggcaagtggaaggtattctgatcatgtatgagcaagggagttcatgtggcattttctctaattttcaagtgcaaactgggtgttgtacattccaaaggaggttactttcattatcggttttggggattttgttactgttctccttgtgaaagcaataatgttcattacagaaaaatccccaaatcataacaggccaataaactttttatattagaattgcttttaaaagtgaaaacttgggcagggcacggtgtctcatgcctataatctcagcacttggggagcctgtggtgggaggatcacttgagcccaggagttcaagaccagcctgggcaatacagggagaccctgtctctacaaaaaatacaaaaattagccaggtgtggtggcacatgcctgtggtcttagctacttggggtgctaagttgggaggatctcttgagcctgggaggtcgaggctgcagtgagctgtgatcatgccactgcactccagcctgggtgacagagcaagaccctgactcacacacacacacacacaaaaagtagaaacttagaagcaacccaaatgttcatccagtagggattgactaaataaattatagtggatctgtacattggactattagacagctgttaaaatgaacagctctgtaaacactgagataaaagtgatatggtaaaacaaattgtgtcgctatgtaaacagtattactttgatgaaatgtgtgtgtatataaatgtgtatattaaatatgtgggtatttaaaatgtacctccgtgtgtgtccacttgtataggaaaaaggagataactatcaatatttacctctcacaggtggggttgggcaagggtggaggagagttctttgaaatgactgttttatttttatgttgcttacaataattggatattacttcagtactaaaaatatttttaaggtcagccttaagtttgccagaaaatttagacttttgaaacctcatcacaaactttgcagtttatctacataacagtctaattgattctctactaggttaatcagtctatttctcattataggtgcaaagttttatttacttcaggagatagaaattggttcattttctaaaattatttataaaatttgttgaactacgagagttatgccaatgtatccttcccttgtgctaccgtaagaatttgtacatacctctgctaagctttgatttattttattgcactcatatgtgaatatgactgtcctcaacgctaaactttgacctctttggagaaagagacttgttttttgatcactgtatctctagtatccaacacgacatttagacaagaagttcattaactgccaattaaatagatgcataaactagttaaagaaagaattagaccaggtgcagtggctcatgcctataatcacagcactttgggaggccaaggtgggcaaattgcttgagctaaggagttcaggaccagcctgggcaacatggagagaccctgtctctacaaaattacaaaaattagctgggtgtggtggcgtgtgattatagtcccagctactcaggaggctggagtgagaggattgtttgagccaggaaaatagaggctgcagtgaaccatgaccacatcactgcactccagcctgaacgacagagtgagaccctgtctcaaaataaataaatatttttaaatagataattacagtaactttccctggctacaaaaaattttctgtttaagggaaagtattaaaagagaaaacgatgtattcataaaatgataggaatactgttttgaagaacctattttgatgctattgtatggtgtgatagctcctatgctttcttgctaatcagagaattgatcatagtgttattgcaatagttgcaatattagtcaaaactgccttattcctacctacggaacatctgaatcaagtgtcttgaggaaagccaaaatgtattagctcatagaattcacaaaatctaaggaataaattctggcttcaaggatgacaactcatccttgaatgatgattaacaacaacaacaacaaactccatctctacctcttagtctgtgtttccttcattctcaggttgactttctttgtgtggttacaggtggccactactagctccagatggatgccctaaccacctccaagtttaacagaaagataacttcctttccctaagcgttctgaaagaactaaaggacaatgtcctggaattgaatttcactcccagggtggactcacttaggttatgtcctcatcgcatgatgataggaatggaaagccctgattggccaggcctgaaccatatgaccatccctagatcaggagtggggtcagccccacccacctgaactgtacctgtactgagggtgaggaaggggtgatgcccgagggaattataacataggtaccagaagaagagggagtgggtatcaggacagttaagcagcatactcctgctatagttagtgcttgaggcagtcctgtagcacatccccacagcaatctgtactggaagttgaagaatgaatgctatgagaactttatctccttcttatgccaccatcatagagtcaccctagtctcccaatttgcttcaccgcgcaatgtcaggagctgtcctttagagaccagccctgtctgagatcaaaagctaaacattctcgtaggactggtataaaagttagtaacatcctcttggataaaaacattgaaatatgaataaaaagcctgaaaacattcatactctttatcctagtaattccacatcttgggatctatcagtcaaaaacaaaccaaaaaaatttttaaaaagcagccaaaatgtatataagccttcatgaataaagatgttaattgcactgttatttaaaattgtcaacattttgaaaaccacaaataaccaaaaggcctaataatagaagacaagtaaattataaaatatacatatgattatattgtaggcaacccttaaaataacatctaggaattatattggtaaatattatatgtgaaaaataatatgatatttaccataatctcttcaatattgggggagaatccacataattttttgtcagtaattgtgtgctttcaaaaataagtaacaatgttttatgacaaaagtgaaagcgttatgcaagaaattagacctgtgctgtccagggtagtggttcacatgttcagagacactcgggaaagattttaaaggtagccaatttactggtttcatatggtccagctgcagaaattatagccaatagtacatgcagtccagctcgtcagtgatgacaagcagaaagccacttccattaggctcaagttttccagcttcagcctgagaatagatgggatttcaagcatctataccgagagatgccaacgaaaccagccaggagcaaaattaccagaattcttgaaccaggcagaaccagggcagatggcatctcaagcaccttcgcagaccagcgccggctgacccagccagaactggaactgggtacggtgtcaattccacttgtactcagcagtcagagaaccgtgtgaccttcgatcctggcggagctggaattgaaaccgaaacatgaggcgtagagccatcacaggagcacactaacttcccactcatcaccgtgaattgaagtggagggccttaacaaaccacccagcagaaccaggactccttaaaatagtagctcagaaaccactcagaagttaaaggaacagcaatgaatggtgtccctatgagcagacagccagttgcacttcaaaatacttaaaagtttttgagagagctagcgttgagctattgaaatttaccatgtaaacttaggacttcagaagaaaattggacatcctccattgcttttttgttccttgcttcctgtggtatttcttaattattggttggtataaccagctgtttttgaagctgtcatactggtaggactatttatgtgattgtaaacacctattatttttgttactaaaggtagttcaactcggactctctgtgtgatgattaagaaatctgtccaacgtgagttaagcaaataagggaaattattgccttcattagctgaaaagttcacaggcgggtctggcttcaggagtggcatgatgaagcggctccagtacaaccactaagaaccatttcttttctgagattccagtataattaattctcttaggatattgcctttgttcttggatgcagggtcttcttctgcattacccctcctgtggtcatgagatgactcctctagctccccctgccaaatgcttccaggtccacaccacagggaaacagaacttccttcacctaactgtcaaacacagggcctggacttaacattatatcactggaataagatgcactgactgacttcttctaattaggactcattccaaaagttcaatcggtaggagatagagaaaggcaatcctaacccaaaccacatgagcagagaagaagtaaaggataggtccccaaaggaaatgcggggtgctgccttaccagatgaatggtatgattgtggaccaattcaagcagaaacctactaccaaagataatttaaatataggggctgttatttaccaatgactgcactcttcttcatcttaggatcagggctatttggctagttgttttgagtatataaacatgatagccaaatctttgtcaaatattgagatgaaaaacacttatgtgaagagagagaatagtgcaatattgcttgtgttaagtttatcaaatcattattggattaaatgcgtcttccacatgtgacagcctgtgcgacaaaaaagacatgaaagaagtgtggtataagtgactctaaacttcagtggggtttcttccccatctgtaaaatgggaacaatgattgcaagttgagctgcttgttgaaaagattaacaaggatttctataaagtgaggtaatgcaatgcctgcctcatcagattttcagtaaatgtgagttcctaaagctgccatctttgtcctaagctcatcatcaaaggtaacctcattttcagatcagcttcctgaggtctctgaaatagcagatatggatgtaaacattaaaggacaacgtaggggccgggcgtggtggctcacacctgtaatcccagcactttgggaggctgaggcaggcagatcacgaggtcaggagttcaagaccagcctgaccagcatggtgataccctgtccctactaaaagtacaaatattagccaggcatggtgatgggcgcctgtaatcccagctactcaggaggctgaggcaggagaatcgctggaacccgggaggcggaggttgcagtgagccgagattgcgccactgtactctagagagtgagactctgtctcaaaaaaaaaaaaaaagaacaacaacaaaaaaaaaaaaaaaaaaaaaaaaaaaaaaaaaaaacccaaaggacaatgtatacccaagcccaggaaatggaacattctgtgatatatcaaatgtctccctaaaaaagaacagtaaatatattgtccccatggcaaactccagtctttgaatagtgactgtcttatattgaagagattccaaaggcacatttatacacaataggtaaaaatgttatcactctttaaagatgcctaccctagatggaggagggggagagacagctccagcaacacgcctgccacctttccaaagcagtaacccaaatctaaatgtcatattatttctttgtgcttgtgctttgtagactctggaaaatcccaagtatgaactgatcatcgaggctcaagatatggctggactggatgttggattaacaggcacggccacagccacgatcatgatcgatgacaaaaatgatcactcaccaaaattcaccaagaaagaggtaaacccctgtgccaaacaccaaccaccactgtggtcacagctacaattactgattgatgttaattcacgtaccacagcacctgctggcccccctttcaaaatcaaaatactcctttgtgggagagacgatggtgttttgctggaattctttctcacatttttattttgtgtttgtgtgtgaggctaaaatactagagcacggtgagaacaagagcactgaatcttgttaaagtccataagaaaataacttttaatgcccaagtgccattttcatagttttattgctgttatttagcagtgagttatgagagtcccactgtgattttagcataacaataactatttttttccagcaagtgcagattgagaggccagacggaacagtagcaaggaggtaaagcagatttcctagtccataacaatgtggcccaggagcttataaataacaacaaagttagctcatccaggagagccattattcattctcagtccctgtgcttttatgattatggatcatggttgttgtttcccatttattccaagggagcgatgtttggggaagggctgagtacacaagatcacattcagttgctaaatttgtacccaaaccaggaagccatttgcactaagcacattctgatggaaatgtgctaagattgtggcttctttaggggcctgggccagggcatggatttgatgcccttcttactgaccaagtgaagaatatggaataggtacgatggcccctgacttttgcagagtctttactgtatctaccatggtgtctccccctgagatctgttgcctgatttgactgtgtgagcctggctttaccattttacaaatgagcttactgtgatgctcagagaatccagagaacaagctccaaggtcatggacagaaaaagtggcagaaacaggaagtgaaccaggttcctgtgattcaaaagctgcagtcctaactgtgatgctgtgctttcctcatctgccatcaatgcttccaacctccagggtgtttggagaaaaaaacctatatagggacctgcagttgccccactgctctctggaggaatctcaaggctacccagggtggcttgagacagatggatcctctcaacccccgagttccccaatggcctctgtattagttcattctcacactgctataaagaactacctaagactgggtaatttacaaagaaaagaggtttaattggctcatgattctgcaagctgtacagggatcctggctggggagacctcaggaaacattcagtcatggcagaaggcaaaagaggaagccagcacatcttcacatggaagagtaggagagagagagcaaaggggaaggtgccacacacttttaagcaaccagatctcatgagaattttatcatgagacagcactaggggggtgggtgctaaactattagaaagcactcccgtgatccagtcacctcccaccaggccccaactacaacactgggaattataattcaacatgagatttgggtggggatgcagaaccaagccacatcagcctcttcacctcggcatccccctgcatggctcactcaggaggtagacgtccccctttctccctgtggtgtcttgggcactcaggattccaacctcaaaacagcaaagtccacgggagcttgatttgctccattctctgacttcccatggcagggttcctctagctgctaatacagactgctcactcttgccatggttccaaactggcatttcaagaacaccagttctaattagttccaaacaattctaattcacttccaagaaattagtcacaaaaattacaccaccggggtggggataggaatgaaaaaaatatacttcagggtcaagtagatgtgggaaacactgaattgattacttttaaatggtttatttaactgcaggatttctgattaactttaaaatgctttgtgtttctctaacagggttaggtatggtctgtggggtttctcattcttctttggcctgggggcttttttttctaggctaccttatatggcttatggagctggtgtttcatggaatgttcactgggggatttttgtttatctttataatttcttttcaacctatttcaaaataaaaactcagagcacattgtaatattcaatataaacttaacgatgggaacaaaaataggataaccccaacccaaaatatgaagatgaatctgtgttaccagctgtgtgagattaattagttacttcaatgccactgtgaatttgggtcctgtgacttaggaaaaaaagaaatctttgctcagttgtggactaaacactgtgaatgacagactattgtttttaatgtcattgaatccaaggaataatttaacatggactctaaaggttagctaccattccacaatatcatattgatttcaaaatatcatattgtaaacactaaaagcatacaatgttatctgtcaatcttaaaaaataaattttgaaaaaagagacactgagtagcataaggaaaatgtatctgcctgtaaataccagcaaaagcacacacattttcttcaaatggagattagacaatgagtttgagattcccaaaaggcagagctgatacctaaactcataaagagagataagtaatcagatgaaaggaagtgataacaagtacactagactctcatttggatattaaatgtcccaaaggagtctttgcccaatgtttgataatttaaattcatgattaaactttctgtcgtgttcctgaaaggctgatgttctttgttgaaggggattcatacactttggatagtaacactgctgggggtaatgtgattgagaagtaaggagggggcgctggagccggaattgggttcacatcccactgaccagccatgtggtgggagcatgttaagtgctctacatcccagtctcttcacctgttaacgggctgatcgcagagcccacctcattaggtcattgtgaatgagctaatgactaaaagaacctagatagtgcctgtcgcccagtattttctaaagtatagagatgaggacagtggtgatgacaccgctgatgaggatggtgggaggaaggccatgatgaagaagaagattgtgatgagaaagatattattatgacagtgatgtttccaaaatgtcagaggccaaattgacattcttatcgaaagggccacctcccctccaggttaaaaggctactcttttcctttaaagtgacatatgaatctgctcaagcacttcaaaatacatggttaggaccctagagttctaggggagaagcaattctgcaggagaggtggcagaatctgtaaaatgcatcactatgagatcaggcctcgggacaaaagcgagagagaccaagagaaacctgctggggagaggagagctcctaatgaggactggctcagatgcagtggcctctaggatatggaagaggtaggaaaacaggatgccctagaaacagagaggaaagatggggcttatgatcttgaagttgaaacaaattttagagatgaaaatcaaggtttagtcattccaaaatagaaatggtgatcatttggagttgaggatgtccagaaagctctctaaggagatgttgtcctaagtaaattttttcatatcttaggacatttcgaagttgataagaatacatggtttttgggaatatatgaggtttttaaattctatcttacatgactttccctctccggagagatgtatccttttatctgtttttgaaatctatataaaagaggagttatgattgatcacaaataatagagactagaaataacactgttgaacaaaatagaggtagtttctctcacttaaaagtttggaagtgaaggctgggagtggtggctcgtgtctgtaatcccaacactttgggtggcggaagtgggaggattgcttgagcccaggagttcaagaccagtctgggaaacatggtgaaactctgtcgctacaaaaaaaaatacaaaaattatccaggcatgtagtcccagctacctgggaggctgcggtaggaggatcatttgagcctggaaggtcaagacagcagtgagtcatgatcacaccactgcactccagcctgggtgacagaatgagacccagtttcaaaaaaaaaaaaaaagtttgcaggtagacagacccaggccagtttggtaatgacatgatatcaatttcccaggttccccttagctttctgctccgccgccctcacggctgccttgtggtacaatagggtcactgcagcaccaggtataacagccagtaacaggaagtaagaagcagggaatgagaagaacaaaggagaaccggccacctgagtaaatgtcacttgaaaacttccccagaagactaagtgacttctgcttgcatctctgtagcctcccttacctgtaagggaggctgagaaataactacagttgtcttcagttggtatgttgcatttatagtgtttgtttaaggaaggagatactttaaaggttacttttaaaagtaaattcttattgcaaagtaagctcatccaggcacggtggctcacacctgtaatcccagcactccgggaggccgaggtgggtggatcccctgaggtcaggagttcgagaccaacctgaccaatatggtgaaaccctgtctctactaaaaatacagaaagattagctgggcatggtggcacatgcctgtaatcctagctacttgggaggcttaggcaggagaattgcttgaaccagggagtcagaggttgcagtgagctgagatcacaccagtgcactccagcctggtgacagagcaagactcggtctcaaaaaaaaaagaaaaacatgtaagctcaattctttagtcctctcgtgttcatttacaatgactatacacttgctgagaagcaacagccacatctctcctatcctctgttgtatcccggcaggcactcaataacagagcatttgctgaacgcttcctgaagataattttaacttcagaacagcttcactgcatacgatgaacgaagattgtacttaaaattgccgctgatacatgaaatcaattttcagtcattgatgttcatgcaaatttaggttggaaacgctagtttttctctgtggagagttttctataagttttcctaatagcttgtacgtatgacttcaactaactgttagttttgaacttcttacataaggtattttgaaatgatctgagaaaatctagttaaactcttcaaatacagactttgaaatatacatgaaaacttcagcagccccatttgtggctttttcattcttgtctcttaggttattttattaaaaaaaagatttctgatttgtagctagaacatggttgatgcccaacaaatactgattgaataagtcatattttcacataaatctcaggtcatggggattaataaactcgctattaattaaagaatgtgtttgcaagtgattataaaatttaaaaaaaacagaaaatttcaaatttcattttccagttctaccttaaaatggcaattggtcatttagatttaataatttaggactttttggcaattcaatgagttctttctaaggtaaatgttttggtgtttaagctataacattatcatacctataataaaaacgacataaaacttataagatcctgtcctccagctggaaaatgagagatgggcaaatgctccagttttcacaaagggacaaaggtaaatggtaggagttaggagctgtcaagctgcaagtgagccataggcagaaattcacatcaggttatcaaatgaatgctggagtccaggctccaatttctaaaagtcagtgtggagtcctgaagaatacatggtgcctcaagtatcttcttttcctgtggggtattagcattttttgttttttgagacaggttctcattctgtcacccaggctggagtgcagtagcacaatcatagtttcggctcactgcaacctcaagctcctgggctcagtcagtcctcctgcctcagcctcctgagtagctgggacttcaggcatacaccaccatgtctggctaatttttgtatttttttttttttttttttggtatttttgtagaggcgaggttctgccatgttcctcgggctggtcttgaactattgggcccaagcaatccacccacctaagcttcccaaagtgctgggattaaaggcatgagccactgtgcccagccagtattcgcatttttaattaaaatattgtgttaattaactgcctaatacaacctctaatagtttttctcttccatgtctggctgcaaactctatggtcacttcttcatataacaattacataagatcattgtctatagaaatataagaacaaaaggtataggctttcttctagcagggttgatagaaattttctctgtgtcatcaagagtttagaaactttttttttgtttttgctttcacaacacattttattattggaaaacttgtgcacattttgaggaatatcatcaaatttaaggacgtttctgtcatatatatgagctatgccaagcttgttcaacttgcggcctgtgagctggcagcatgcagctgaggatggctttgaatgcggcccaacacaaattcgtaaactttcttaagacattatgagattttttttttagctcatcagctatcatattagtgtattttatatgtggcccaagacaattcttcttccagtatggcccagggaagccaaaagattgggcaacccagaactatgcaatttccagtcttcttgtgtaaaaactaatctttaaatcaatgacacatattagctaagttgtcatccacatcctcgtatgaggcatattatgagttttatgttatctttattggagtgagcatggaagatcaaatcggcaagaatttaaatctttttccaatgtgtttattatgattcattcttcttcattagtggctttattaaacaatcaagaagctattttatttcttgtgttagaaatttaccttttcctcttaataaattatttgaggcagaatgatgtcaggatacctgtttatttcattttttaactttatcacttttgattataggccattcaagttttttactaacagctttattgagatataactcacatgccataaaattcacacttttaaaatgtacaattcattggttttcattatattcacagagttgtcgaattatcattactgtctaattttagaacattttcatcgtcccaaaaagaaacccgaacccatgagcagttactccccattgcccattcccccacgctggccaccactgatctactgtcagcctctatggattagtttattctggacatttcatatgaatggaatcatacaatacgtggtcctttgtgactggcttctttcacttagcattatgtcttcatggtctgcccatgttttagtgtgtcttagtacttcatttctttgtgtggctgaataatactccattccatggttataccacattttatgcattcatccactgagggacatttaggcagtttcagtttttggctattgtgagtaacgctgctgtgaacattcatgtaaaagtcattaagtctttatctgcgttttctctcacatcctaaacagctagaataaaaaaaaaaagtacccataatatcactccaaattagtaatctgtaattcctcagttgttttattgaaacatttcaaaatgcgtttctaaattgcagttaatatgacttattcaagacttatcaacttctttttgtcatgtaacttccatatgaaaaaagtacacaaatcctgagtgatttaattctcaacagatcaaacacaaaacccaaatcaagacacagaatatgatcagcaactcaaaagcttcctagggttcctgctagtcccaccacctgctcggtaaaacagctcctctcctgacgtctttcactataaactaatttttttcctatttttaccttatttatataaataatcatagtgtggacccttgggactaacttttgtgagacttatctatgttgttgcacatagccgtaatctattcatgttcgttaccatgcaaatatatttcagtttactccttcatcctactacatgtgggcatttgggttatttccagtttggggataatttaggtaatagtggaataagtattcttgaatgtgtcttttggtgcatatttgaagcttatatgtgtttctgtttggggtatatctacaggtgaaattgctaattcaacttcggttgattccaccagagtagttaactccagtttacagtggaacactcactgagaatcttgactgctatatattttccccaacatttggttttatcagttttttggtttgttattatttttagcctttccaatgtgtatgtagtgacatttccctgaggctttaatttgtatttctctggtggctgatgaagttgaccatcttccatccactggctgttgggattctacttttgggtaataccttttcaagtctttcaaccattttttaagttgggttattagtctttctcttatcgacgtgtttatctttattctggatgtgagtcctttgagttatatacatgttgcaattttttttttacactctggctttcctcttctctctctgaatgaaggtagagtcccaattttaatgaattccaatgttggttgatggttaatgtcatctgtgctctatttttgcctaccccaaaggtttaatttcattgatggatatgaaactatgtatatttcaatttgccaatttgtgtttttccaggaatttgtccatttcattttttttctctatttttcttggttggtcctgccatggagtcattctatccactttattaatcttttcaaagaaactactttttgttttgtggatttttctctattgggtgtttctttgtttttttccttctatctctttgggtatctttcaccatttatttttcaaacccctccctagaaatgatactttaatcattgattttcaatctttctttttttctaatgtatggatttaagactatataaattttcccttaagcatgactatagttgcattacataatatgtgctatgatgtattttcattatcattcagatcaaaaatatttttgaattttcttgggtcccttttgtgacttgtggttttctagaagtatattgctaaatgtgacatatttgggagtgttttttattcttttccattaatttctatcttaattctacagtggttagaaagcatccactatatgattacagtcctttgacatttgctgagacttgctttacaagctcacatgtaatcaattttgatagatggcccatgaatgctttaaaataatgttaattctgtagttgtttagtatcgtgatctatatacatcagttaggccaaggtttacaattttgttgttcaaaccttctatatatgttttattaatctgcttattgtatcagttactgaaagagtgatatgatatctataattacagatctatctatttctcctgttggtactattaaatttttaaaaacttaatttgaggctgtcttattagatgtatacaaatttaaaattgttatatcttcctaatgcattgactctttaccatcatgaaatgtacctctctatctctgcaaatgctttctgctttaacatttatctcatctcgtattagaataattatcttacctttcttttggtcagtgtcatcatggtatatttctttctgtcatttttttctttctgactttctgtaatcttatatttagtctgtgtctcttttaagtggtgtatgtatgggctttgattttttaaaatcaattccaataatgttattgttactggaattattttgcccatttacatttaatgcaagtacaacatattcgggtttcaatctaccagtctaagtatttgttttctatttgttgctcctttttgataaatttcttttcctcttatctcttatctttttcacatttacttgggtttttttataatttcatattcagctctaataacttattagttatacttcattttcatattcttgtagtgggttctgagaaattgcaatatatattctcaacttttggactctaacatcaagtagaatttttaggacttactggataatccaaggactttagaaaatttgagctccttttatcatcctcctaccttctgagatattgttgttatgttttaattctgtatcagtttatgtttttctacttatttaccctttgtattattatttatttatccctgtttttgtgcttccacatggaagaattttcccctctgattaaaaaattccttttattttaaaaatactgcaagtctgctggtaataagttctctcatatattatctaaaaaatgtcttttttgccagaatttttgaagaatattttcactggaggtaaaatcttggttgccagttattttcttagagaacttcaaagataacatttcattgtcttctgacatctatcatgtttgtcaaaaggtcagctgtcagtgttacttttatttccattgaaagaaacgtgtctcttttctctggctgctttcaaaaacattctttgtctttacttttcagcagcttaactgtgacatgctgaactgtggtttaattcgtattaattatacttgttccttaaatatctcaattcataaacccatctcttcaaatatttcttctgactcattttatcttcactgggaccctaattttatatatgaatgtgtttgtgtttgtatgcacacatacatatacaaacatacatatacacacacacataaatatatatatagactttctatgcttctgttgagctatttttaagctcaccaatcctctcttctgtctaatctactatacccatttattgatttaattacactcaggccaggcacggtggctcacgcctgtaataccagcactttgggagaccggtgggcagatcacttgaggtcaggagttcaacaccagcctggccaacatggtgaaaccctgtctctactaaataaatacaaaaattagtcaggcgtggtggcgcccacctgtagtctcagctgccttggaggctgaggcacgagaatcacttgaaccccagagttggaggttgcattgagctgagatcatgccaccgcactccagcctccatgacagaatgagagtctgcctcaaaaaaaattttttttaattaataaataataattacactcatattttaaattatgtaatttcaaattcttttttgaataaaattatcagctgaaattctacattttacctattttcatgaatattttagtcaaattatttacaattcaatgtctgctaactccagcatccattaatagatacttctgagtctatttctattatcagtccttttctcctggtttttggtcattggttatagtcgcctggcatacctaggaattttttaatttaattttggacaacatatatgaaaatgtttagagattagtagaggctctggctgatgattcccccagagaggattcccttttgctttctgtaaacagataagagtaggacaggatgactttaagtcagtctgagatggagttggtttgtggtgggactcaggctttttcaagggtgggtctacttcccagtgttcccttctcctcggatgcagctttcctggggtcctaactgaaagtctggtatgtttccagggctcctccactttggccgaccttgcatttcacttctcagtcccttgtctctgctgaaagctctccttggccctctggcctcttagacagcaccttctgctcagatgcttagcctgctcttcctctgccctcacaatctgggaaatgccttcaagggtaaaagttctatggaatattggcctcgcttcagtgaattttccttctctccaggatcctggactctcaagtattggctgccttaccagctcttcggcactttcaaataagtggggggttttatattaaatccatatcctggttgttctagatttgagggttggtcaggaagaagctttccccaatcatcataaagagagaaaaaatctggattagctttttaatctggagtatcaggaaaatatcagtagacatggtgcggatataattcctgtggcagaaagcataatattttcatttaaaatgtggagaaatataattaaatggcttcacagtacccactccatctcataccatttgcttcaaaatcaacttatttcagtaaaagtttaaaatgtttgaagtgtctcctacttgatgatatcgataagcaagaagggaactctaaatccaagaaagctaaacttttctttctgattcttcacttgatttgacatgaatatctacagttcccttaactctttgggatcttttcctctgtttttgatagtttggtgactccagctatgaagttagaagacacacctttgtgcttccaccctttgccagaagtctaattgaagtaaatatatttatccagtcctccaggattccgtgcaatatatttgagtgcttcaaagaaaagcctcctacttggataagcgtttacttcctttaggagaagagctctttaacatcagatgcacttgtgtctaaaccccgaccacgtaattacacattctgcttgctccaaagagattaatccagaaagccaaccacatatttcttagaagatggaacacatttcaattatctgactcaagtgacttttctggagggtggagtccaagacattttaagtaccagataaatctttgaagccgattaaatgtttttccaaatagtctagactccctcttcctatgaggctttttatagctattatagtgatatatgtgaggcttttttttcctgatactgtaaaatcacatatctgacagttttcagtgtggctgaggttttaaatcaacccaactatatgctactgggatctctatctcatattttgtacagaatggtggggaatatcaatatttaaagaaatggtatttttggagagaagagaacagtgtgatttcagtgcatgggtactagcagtttccaactctgtaaacagtgccatcactcatgattacatcatttcctgttctttcttgtcctggccaacactttgtccaaggactctaagagatcatctactgcaaattgcattcccaacttcccatcacataatcgaagagaggtttgctgcaaaaccgccaacaccttcatttcacatttatcttcacttgaaaggggtgagttcatcacttttttctcctgcaccaagaccataggaagacacgaaatcatcaactaaatcttccagcgttcaaatatcggaggccctggaaacagcaggtatgccgctgaatgtttttgaataaaagagagtgaagggaaacgtttgtacaaatataagcaacgatctacaaatagaagccatcatccaagcagtacagttccaactaaggaaaagggtggtatgtgcattcctggatttaattgttcatacacacaaggatgagctgtcttgcgttgttggaaatgcccacgctgattataaactctgtgtggaatgtcaaaacatctggatttttaagtgaaaaaatatataatctaccatgtggctgtttcttcaagtcactcctaaaggtagacaaggcagccagatgatttattgcattaatcactctttcataattatattcgtgatgtgttgatccccatcatccctgtgtgaacctctatgcgaattccgtgcctttgctaaacctctggttatgctcaagggtcagtggcaactcagtgacaataaaagcaatttttcactatagctggcagagtcttaccaccgagccactccatagcacagtggcctctgaagacttcatccacctccttctattcaaagataatatcctcatactaagagcaacaaccacaaagccataaaacatctacttttttaactctaagaatatgacatgactacacctccataatgcagtgtgcagaatgagaacacaggagttcagaaatagaaagccaagagcagcataaatggagcctgttggaagatgaaacgtccaggtccacactgcacctggaagccattttgtactgaacaattttagaagtaagatcatgggtctgatgcatacatggtttcaaacactgtccacctggctacagcctgccttcgtcttaggccacacgggagctctgtttacccctacgtgccaagctttggcatgtctttgtgccactacacactctgttcccttcttcccggaatgccttttccttcctttgtgcctgaaaaattccaatttatccttcaccacccaacttataaatcccccaggcactttgttacttcctcttccttgtcccaaaacatgttagcccccttcctagcctagagttaccacattgcctttcgcttgtggactcacaacccctctccctaatccgcttggaatgctttgctctttaagcccatctccttttcatctccgcctctagggccaagcacaggggcaacatcaagtgtttaattagagatgagtttattattcatgcagcaaatacttattacagaactgtgttttggcttctgatgtactattaactatcctttcattcactattatatacaatgttacctgtataccattatatgctgcgtataagtaatactctattatgtatgctattctattctaatatgcacataccctaatatgcacatattctagtctaatatataaatctattgtaatatgcacatatcctaataagcacattttctattctaatatataatatctattgtaataagcacatatcctaatatgcacatattctaatatataatatctattcttttctcatatgaacatatctcaatatgcacatattcaattctaatatatatctattctaatatgtacatatcttaatatgcacatattctaatatatatttctaatatgcacatatcctaatttgcacataatatctattgtaatatgcacaaatcttaatatcacatattctattctaatatataatatctattctaatatgcacatatcctaatatgcatatatctattctattctaatatgcacatatcttaatatgcatgtattctgttctaatatataatatttattctattctaatatgcacatgtcctaatacgtacatattctgttctaataatatatgacataaaatattaaatatgcaatattcaacttctggtgtgctatataattatttaattgcttattgccactctcactaaattagaatgtaagctcctcaaggaaagaaactatctgttttgtcatctgctgtggtcccgcacccagcctgccgtgtagtgcatgatcaaataactgatgaatgaatgaataaatggtcgatgcttgacaacaaagacaatcagaatctctgagtcatgttgttgcaaagcacttgcggccaggcatggtggctcatgcctgtaataccagcattttgggaggccgaggtgggctgatcgcctaagctcaggagttcaagaccagcctgggcaacatagtgaaaccttgtctctactaaaatacaaaaaattagccaggcatggtggcatgtgcctgtagtcccagctacttagggggctgaggcaggagaattgcttgaacccaggggttggaggttgcagtgagccaagattgtgccactgagctttagcctggagaacagagagagactccaaaaaaaaaaaaaaagaaaaagaaaagcactaggaaggcatctcattcaatacatagttttatagatgaggggtcctgctcaaggtagaaaacagatcccagaccaacctcactgtggcacaaaatgctgctgccgatgagaaacccaggctccagccctgcactaacatagcaagtcacaggatcatccccaagatttatcattgcactgtagtctgccaagagccgagacagttggagttaaattccatctcagaagtgaataaatgaatctacataaactgcagagatccctgaatctacttccctatcggtcaagtaaaaagaaaaaaaatcaagaaaactcaatgttaataaataatacataaaggaatcgttagagtggagacaggttcaacttatcctgtgagttaaaaaaaaaaatgaaagcaagaaaatattccacagttccagtgtgctgagctcattcttgtgagattaaacaaaataattcaggattaatatattcatttctttgcaaactactatctatttcagttacagactgagtatcagtttttccagtgttggcactttatttttgctgttgaccggctcagatctgaaagacaggattttatgagaagcgtcaccttcagcctgctttgcctgtgtgtgcctgcgtttgtgtatcacacgtgataacgttatgctgtcgctttccaaagtacattcattcattcattcatccacctgcttgcccatcagacatgtatgtgcgctatgcctcctcttttccaggctctgtgataagctagagcgcagggcagtgagtgaagtgaacagggtccctgacctcacgaagcatggctggggacaaccagccaaccagcacatcgatcctgaatgacccctcatgatgagatggaagagggtaaagtcataacagagggggactgcgagggcacttggcatggagctcagggagggcttctcagaggaggtgactgtattcatttcctgggctgccataacaaggtattaccagccatgtggcttcaacaacagatgtttattacctcacagctctggaggcagaagtccaagagcaaggcactggcagggttggttcctttggaggctgggagagagaattggtttgatgcctgtccccacacttctggtggccgccggcaacctttgtgctcctgggcttgtgcatgagcacgagcatccccccagttcctgcctccatctacacctggcttctccccgtgcccatgcctgtgtccacatttcctctttgcagaaggacaccagtcatatttgactagggcctaccatagtagcctcgctgtaacttgattctctctgtcaaggtcctctttccaaataaggttacagtctgaggtcctgagggttcagatttcagtgtatccttagggggagacacaattcaaagtctagcagtgacacagaagtggaggatgcagatggaagcgtccgtgggaagaccccggcctgggaagggcatgtctggcaggaggaactgaaagccacccagggtgaccagagcaacatgaaagagtcagggagggtgtgaggctggagagggcgggaggggccagatctcacccacaagacgaggaggctggatttattccaagtgcatggggaagacattggcagatgttaaaagagatagggaggggggccgggctcagtggctcacgcctgtaatcccagcactttcagaggccaaggtgggtggatcacgaggtcaagagatggagaccggcctggccaacatggtgaaaccccgtctctactgaaaatacaaaaattagccgggcgtggtggcatgtgcatgtagccccagctacttgggaggctgaggcaggagaattgtttgaacccaggaggcggaggttgcaatgagccgagatcgcaccactgcactacaacctgtcgacagagcgagactccgtctcaaaaaaaaaaaaaaaaaaaaagatatagggaggaacattccaagactcagagcccccatgctgcttaggaatactgttagtccacaagagtgagtcaatggctaggagattgctggggatgccaacagcatgagacccaacacctatgtccttcacccaagtgggaataacgccaaccacaggcagccaacatgagtagacgtttatgtagtaagtttcaagcttaggaagcccttccacacgccacatgctctctctcacctaatacttgcaccgtccagcaaagagggtcttgttgtccctccacgtagatgaggaaactgaggttaagtggcaccgattccttccctgaggtcactgggagctacatggtaagagtctggcctctgcatctgcttttcccttgcaaactcaaagagacgtctctccttcaagttgcaagtgtcctatcaagaacggcaattgtgtcgtgagtttctgtgaaaagcaagactggtcattccatcacttctgtctgtccaacatgccccagacttgctcttttggggccccatgctgttaagtaaacatcccccagccagtgtgaatatctgaaagcacctgctttgtacgcagcagggtcagagacctttatatgcacgccctcgagccctcctcctgccagcactgagacaggtaccatgatcgtaatacccctttcgtgggtatggagatgaaggctccgacagctgaagaacttacccaggctccagaccccaactctcaaccctctgctaagctgcttctgtcccgtgaaaggattagcaatttaccagtccagtgccagtagagcccactattcaggcatttctgccggattcagtggcagccattatatgactctccagtggtctagcccttggggtcagctctgtaggattccttgccagggctattcctcggggaatacctatcctgtttttcttgttacacttgtgcaccaagggtttgctgaagcagcccaggtctattaccaccgttttccactctgcttgaacttgcaaacttcaacttactgctggccctcttgctctcacctcacctgcctttttttttttttttttttttttttttttgagatggagtttcactctgtcacccaggctggagtgcagtggcatgatctcggctcaccgcaaactcctcctcttaggttcaagcgattctcctgcctcagcctcctgagtagctggaattacaggcatgtgccaccatacccggctaatttttgtatttttagtagagacgaggtttcaccatgttggccaggctggtctggagctcttaacctgaagtgatccacccgcctcggcctcccaaagtgccggtattacaggtgtgagccaccgcacgcagccacctcacctgcctttctgttcaaatcaggacaatgttttgtgcaaggcctggatataactacagcacacaaaagatttctctcctgggttcattaggataagttcaagttaccctctgtccctccgtcatttcttctcattataaaagggttggagggcttctttcaatagccagtgaagttgattagcaaccttgtatctttattttgataggtccaatgggaaaatatactaatcatttcttatgagcaaagaatagataaaaaaattcatccatataaataacttttcgaaagctaattattatcaagtgcttatctgtgtgaggcactgttcgagatgctttgggaactgtagctcatttaattctcacaacagccctatgacgtaggtactcttattgtgcccatttcacagatgaggaaactgaggcacagagaggtttaggacgatacctgagacttcagcgtggtggggcaggaatgtgaggtgtgagtcagagcacctggttccagaggcagctttcaaacacagcactgcactcccctgagcttctacacactcttccggccccatgggattccgaaatgagagaaatcaggcccccaaaagaccagccttcatcaggagactcggacgagaaagtcaaaaaacctatgttgaacacagcaccattcttgcagcagtattaacttttccacacttcagtatattcatgtgcgtatctactttaaaatcttcctgcatcaccatcaatagcttataattgatactccaataattagatatcataattgaaatccaggttttactcactggagaatttgggcaaagtcctgcaaagcaagagaaactttagttcattaatgaggctcatttttacattagcccgctctcgctacataacaatttttaaatctttttacatttatgatagtcgttactgcagtttcagaatcattagtgagataatgtgcttcttcaagttcaccagtctctgtgaatttgatatacttgttctgagttagcagggttgcagcggcctcagctttttggttcatgcagtcaccgcatgcctaccaaacacaggctgcgggctgaaggctggagattgaaataaggcagcaaattcttgctttcatgaggcttagcagggaggacaggtataaaaatagtacaagggtgaatcttacaaataaattcagagtgctttgggaacatgacctaagggaaatggacccgaagtctgggaaggtcagctcatgaagtgacatcttgtcctttaagacttggctctgctaggtagagtaagaaggggtggtacaaggttagcacaatccaggaagagcaaacattgtgtgcagatgccctgaggcatacaagagcccggttgaggggctgagaggtggggccagggctgggtgggagaggtggcacacacccagggactcagtcccctattacagactccaggaagccatgcatttccctcgagttcccccaaatcactccccagtcacgattaacgggctctcttttctttcacttgggccctttcagcgccttgtttctccctggatctcagcatccttcccagcatgcactatcggctttattgcaatcggtttctgcgtcttctgggcagcccctcttctggggctccttgagggcagacagagcttcactcatcatggtcgtccccttcggcctcggagcggtgtgcacagagggagcacaaagaatgtccgttgcattaaatcaaatctaacaaacagcactttttcccggcagctctacaaataggaacaggtgtctttgctaatcgcccctgaatgcacggttcaattcagggctgtaaatccatatatcagagccagaaccagttagctgtctggtctataataaccacgcactggcctctcacatcatgggcactggaccctgtggctgaaaagaaagtctcaacaaacccaaacaaactgaattgtccacttgtaccagcctcacacaggaatggtcaaaatacctcttttccttcagctctgggaaattgaaaagacaaatcagttagcggaagcctaagactagaggctcacccttcgacaaggaaattcacttgtattttctccggagtcaaggatcccctgtttgcactcatttcgttgttaggaacagaaatccactttcaaccagcagaaacgaatttcctggaaggcattggtactcatcactgggggaggttccggggctttccagcttcaggtgcagctgcgtctaagccctcagacaatgtggacgggatgctccttgtctgcagctccagctgtcagctctgcctgtctctctatgttggctttattctctgctaggctctctccttgtggcaagaaaggtgacttctgacagccctgatgccttatacacaaaggcaggaacacccacatcctctctcccagatccaaatgctactctcatagaaagacttttggtctctctgggtcacagtaccccctcagaccgggcattgattcccaggaaatgatgagataacgcccccacccctgccccaggtcagcagtccccagcctttttggcaccagggaccggtttcgtagaacacaattttttcacagatggcaggggtggtgggggatggtttcgggatgacactgttccaccttagatcatcaggcatcagttagattctcttaagaaacgtgcagcctggatccctctcattcccagttcacaataaggtttccgttcctatgagaatctaatgccaccactgatctgacaggaggcggtgctcaggcggtcatgctcactcacaggatgctcacctcctgctgtgctgcctggttcctaataggccatggatcagtacaggtccgcagccccaggggttggggacccttgccctagatcacctgcccacctctgggaaacaagatggggagaaaatgaggcctgtggttgactgcaccaacgtgacctcaaggagcaggttgtggtggttccctgaagaaagcaatgcccccagatcaaagctacatttcccatctactccagatcctattcaaacagaaccagttcccttgagcctggccatgatttgcatgtgaaaagctggtgtgttgcagccagtctgcaccagctttgggagagctgattgccgcatgtcttgccggttctgcatgtgtgcggtgatatcgagtacatagcttgaaattggccatggggggaatatttaagcacaaaaatggacacaagctacaaatcagggcttttccccctgaattgccattaaacatttaccagcacaatactgtgggttagttatggtgtttgcccacctaaagaaactctgtgtgtgtgtgtgctcatgtgtgtgtgtgtgctcatgtgtgtgtgtgcatgtgtgtgtgcacacgtgtgtctatgtgtgtgtgtgtgtaatttaagccaaaatgacggaccctgtgttatctttgcagatccgtggtctcaggccatgcttaattcttccacgctggtttattggttcctgtgttccaaagctccgcatgtaccctgtttaaaggacggtccacttccaccctatacagttggagggtcacccattcatttgatttcttcaggtccattttcttcatcctccttccacatgctactgaccatcgctaacaggactgcgtgctgagagccgagcctgttacctgctttccccatgacagggctgtctgcttcctctccctgtcccaagatttgttctttacctctcagaactgcagaaaacaagttattttctcttggcatttgtgccgctctttttcctccctcttttggcttcgaaaaagtggtgggtctcatgcacttgtaattagctggagcacatctgacccatcgtcccctgagggagggcagcttggtggtccctagctcaagaaggggcagcccccaccccctgaaattagggaggggaggtctacagctttttccaggaggtacctcagcccaaagtctgtgaatccacaaaagcaaggtcggcctacccttttacgtaagccacgcggtagccagagacaaatgcaagcaatagtgtgatgtgagatagggcagaaacactgcaccccaaagtcaggtgtattggggtctttccctgggagtccgatgcagcaagcaacactgtcacaggtaaaacgtgaggaaacaagcttgcttcttttttttttttttttcaaagcagggtctcactctgttgcccaggctggagtgcagtggaacaatcacagttcactgcagcctccacctccaaggctccaatggtcctcctatgtcagcctcctgcgtagctggggctacacaagtttgcttcttattcctgagctttttaaatttcttcagctgattttgccgtaccgcgtgtgccggtttcatcttcctcctcgttgtaattgtttcatgaccggagtcaatgctagaggccccgaggaatgcaggaaagcaccagccatcaggacgtgttgatgagacacacactgtctgggaccttctgtgaataacatgattggcgttgtcaccgggataactgcaggagagatgtgaaagtgcttaggatgtagttggcgctcaggtcattctgcaggcgttaatgaagcacgtgctatgagccagggtctttgctggggacctaaagatgagtaggtcagtggacaatatttgaatgcaagtcacaaatgtgtggtttccaaacctggactgggtggggctgacagggatttcttccattttttctgtttatctctgaatggttcctttagctgctgacttggcaactgaactcaacgttgtcctctgcccccaaggctctcttttgtccattctctctttctcggaggatgactttgcctcctacttccaattcaaaataaatcctgctggaagaagcaacggagccatgaccaaaagcagactttgggtcgagactgccgagtctctacttttactgaatttagtcctgaatcccacacagactccctgtacccgctctccctaggacgcctcggaatggtcctccgtgatgccgctgcgcctgtgctgtctggaccaccttctgccttggtgttctgacaacatcctagagcatctcacctctctcggctctttcccagttctcatgctccctgatggtccttaaaaagattcctattcagccaggcgttgtggctcatgcctgtaatcatagcattttgggaggccaaggccgatggattacctaagctcaggagttcaagaccagcctcggcaatatgaggaaaccccatctccactaaaatacaaaaaaaaaaaaatgagctgagtgtggcagcctgcacctgtagtctcagctactggaggggctgaggcaggagaattgcttgaacccaggaggcagaggttgcagtgagccgagattgtgcgcctgcactccagcctgggcaacagagtgagactccgtctccggggaagaaaaaaaaagattcctattcatggacctaataccccacttctaggagtggagtgggataaactagacagagatgaacatacatacagcgaagcagaattcctgagaggcctctgatctgaatagtgccaactccaggcattagctacaaaagaccttaattgcaaaactttctggggacttttatctttcctcatctggagtatccacaccattgtcctgcctgcgaggaatttggatagtttattttgtttttcattttgttttgttttttagacagggtctcactctgtcacccaggctggagtgcagtggtgcaatctcaactcactgcagtctcggcctctcaggctcaaccaatcctctcacctcagccccccaagtagctggggttataggtacacgccactgttaccggaaagaggtcccaatccagaccccaagagagggttcttggatcttacacaagaaagaattcgaggcaagtccgtaaagtgaaagcaagttttttgggaaaatcaatgaatacaagtatggctacaccatagacagagcagccccaagggccaaaggactatttcttgactgtgtgttaaacaaggagcagattattcaagacttttccaggaaatggatgggcaattcccagggctttttagaccgtatagggtaacttcctgacgttaccatggcatttgtaaactgtcatagcgctggtgggagtgtagcagtgaggacgactggaggtcactctcatcgccatcttggttttggtgtttttccggcttctttactgcaacctattttatcagcaaggtcttcatgacctgtatcctgtgccaacctcccatcttatcctgtttatgcctaaccgcctgggaacgcagcccagtaagtctcagccttatttcagtcagcccctgttcaagatggtgttgatctggttcaaacgcctctgacactaccatgccaggctaattttgcatattttttggagaagcagggtttccccttgttgcccaggctggtctcaaactcctgagctcaagtggtctgcccacctcagcctcctaaaatgctgggattacagatgtgagccccggggctctgcctggatagtttattttttatgtttgtcacatcgctcttctctgtctccactgataagtcacattccagacccttttatccatgtgatttcttgagatatcaagattcctacagacctgggaggaagtgtcgtacatctttgggcaaaagctgacctgagacaataggcaattgcccttgatgctaagactaaccacaagctcttcccagtctgtagtttttatttgcacatttgcaggctggagtgtgtcctctctatctagtcggtatttcaataggaggcgaagatctctgtgaggcaatctggggtttttctagctgggcccgtgttattcatggccagccagctctcctggtttgtttatacctttttcccacctgaaaccttgatggttgatttgtgaaataaaaccaaaattgctcaatctgtctaaaagctttctgtgggttttaaacttacctattttttaaaagaaattttaataatgcttctggcttttagaatcagcaggaaacctacaatcaggattgttgtatttgcaccaatatcaaacataaggagcataagtaataaggaacccagtgccctttgttgaatacgtaaattttcatggtaactggtaattgctggcctataaaagctctcttccttatgttcctgctactgagtaaaaatgatttttgtatttgtaacagactagattcatttcaaatggaaatattaatctgtaattgttcttatacgagaaacaccaagttcaaggcaaaaataacaaagccagttaagcatatgtttcatacctgcacaatttacctaaatagagattgcccaaagaagttttgctggcttctgaaaactttctcataagattttaaaaatatattttatggtcaagaggttgtagcatcctcccaggactaattcatatctagccaagaaaaattacattttcccatttacattccaaagtctgaactgttattttataaatgaattttccctccaattcagaaagcactggctacattacaaattttaatgctactattataggatcataattttaaaaacccagggttctccaagggcttcagcagcatgccatctctccactttattaaaatgaatgaacagatgtacaatttatttctgccaagccatcatctaaattcataagctatttctcatgtgtctgaaatccacgttggtttcccattttctttgccttagaaaaaaaattacactccctcatttatcactctggggacataaacgagaagtctactctccacttcattcactttggactaatatcctcgacacaatttaaatcccatctcttcaagactattcaatgagagcaaggcagtggaacacccagcatccaattggaaaactccttggccatcaatgtagaagattgacaagctcagtcacatgagcttacaccttggcagatgcaggggaagagagcttacaacagcgttgaatccattcaggtagatgggacagtctagaaccatcacacttaaaagtcaacgtcagtaacagaaatgtattttagctgccgtatttcatagagccctgataccacccttacttcccacatgacctgtcatctgacagcaggctggcagacaggcatttaacagattcatctcgggttggcaaacatctagcctagctttgaaaacccacgtgttgatctcagacctgcctttacatccctgcaccaccattttctgatggtgtgagatcaggcatagtttttaacctctctgagatctgggttatttttcagtatgatggagataagtggacctgctttgtaataaaggttaaataaagtgcaacattttgatgctatgaacctaaaagtatctgggacaggtctcagtcaatttagaacgtttattttgccaaggttaaggacatacccataacgcagcctcaggaggtcctgatgacacgtgcccgaggtgctcagggtataacctggttttatgcattttagggacacatgagatatcagtcaatgtgtgtaagatgtatattggttcagtctggagagtgggcgatcagggagcttacaggtcataagtaggtaacagacaaatggttgcattcttttgagtccttgatcaaagacggcggtagaggaatagtcacttatgtcttagtctagctcagtgaatctgcatttttacgtaaacaatcagactgaggaagcaattagatatgcatttgtctcaggtgagcagagggatgactttgagttctgtctgtcctttgacctgcacctgtgaagatgagcgatcagtttacgttgcccaggtgaaattcaacagaagtttttagagtaaagatcttgaggcccacaaggaatttccttgcaggcaaattgtgagggagatattttctatatttgtagctatcttattaaaaataaaatgggagcaggtttgcctcccataggtcccagctagacttttccctttagcttagtaattgggggtcccaagatttattttcctttcacaatgccaaggtcaataatatatggcaagcacagtgcctgacatgtggttcagtaagggggccattgtgatgaagatggcatcccggagatacatctctgccgcagaacagctgggctaaaagagctctcctcttcctcagttctgcatttgctggcatggttctagtgaatgtaagaaaggcattttgcagccagcagatgcagtcaacgagcgcaagttgtaaaggctgcagaatgaagccctcaggttatctggcagaattctgctcctggaagaattctatttatgagatgctgctggaattgagcaataaaacttgccggagtctctagtttcacatggaaaactgccctgtgtccataaatgcttcttgggtttggggctttaatcagattttgagtgtttggtttgttgttgtttgttctttcggtggccctgttgcttggagaagaaacatcatgttaacttcatttgcttgaactctgtgaccatcctgtgatttcaaacacagcttgtctttttctcatgtaatgtttttgggaggggaaggtgggttctcctgatctcgggaagatccacagcaaaatgatggagttctttcatttagcagagttacagcttgaggtggacagtgtcaaaatggcaagctccccaaagaggaaaggaaagagggatgtcactccaggatgcgccaacgagatgctccttaggaaccacggaagtgacacttgtcagcatccacacaacaaaatgttgatgaggggagccagccttggtgactcctagcagctcccggcagcagtctgtctgcctgtgttgtcaacagtccctgaattaaatcagtcactgctgccgccaatgaacttgtaggttgttgtgggataaggggccctaggcagtttcttcatctctgcttgaccaaaccacgcatcaaggtcatggatcccaggtgcccctgaagacattcaagaagtctcgttcgccagctgagcaaagtcatgagacaaactgtccatatgacaagcctgcttttaggctttgacattccagcaaggaagcaggtgctgctgacagaaatgtggtagtttgagagaacaggattttaaagaagaacgaacccaattatttggatccacagagtcttagaagatagaatgcagggaggaggcaagcagggaggaaagagaaggagcttttatgtttcctcattgttactccatcacactgtcagtttgactagaagggctgtttttatttccctgaatcccagttctgtttctgagttcttattcacagggcaggatgggctgacactgtagagacgtgtcctacagtgaaattagagatgactcctaatttcagtcacatctccatcagtcagcccctcttaggtattgcacaagttccttagatgctttgggcctcagtgtcctcacttacagaatagggattttggtaatgaaggccagcagctccgtgcatgacaaggtgctgaatgctttctgtttattatcacgccgaatccttatgatttctttgtgaggtgcattctactagaccctccagttctcagatcaggaagctgagggttagagagctaaggtaatgcacccaggttacagcaggttatcctcaagtgccccacggagtagtgacattttgtcaccattgatgctatattactgataatgatcaatagataggttactggaaaggggtccagatccagatcccaagagagtgttcttggatctcatgcaagaaagaattcagggcgagtccatagagtaaagtgaaagcaagtttattaagaaagtaaaggaataaaagaatggctgctctataggcagagcaacagcatgagctgctagttggccatttttatggttatctcttgattatatgctaaacaaaaggtggattattcttgggttttccgggaaaggggtgggcagttcccagaactgagagtttctcccccttttagaccatataggtaacttcctgatgttaccatggcatttgtaaactgtcatggcactggtgggagtgtcttttgacatgctaatgtattataattagcatataatgagcagtgaaaatgaccagaggtcactcttgttgccgtcttggttttggtaggttttggccagcttctttactgcaacctgttttatcagcaaggtcttcctgatctaaatcttgtgctgacctcctatctcatcctgtgattaagaatgcctcaacctcctgacaatgcaacccagtaggtctcagccttattttacccagctcctattcaagatggagttgctctggttcaaagcctctgacagatactgcatccatgaggtgaataaaggtggcaccggtgttcattttattggctaagaaccccgaaattgtcacattgcgtgcagtggttccggaggtttgacctcaccgtagaagagcacatctgaagttagttttgaacatattgacatcagtgttttgaaactcctcaccgctttctaacagtctttccagttagctgagtcagcacaaaaggccttagccaggtctgaaaggagtttgttttcatgttgcagggagtgttttctaataagggtttttttctccattgaaaacatctcttactttgcgtctatcattatgatcttactcggagagaaaatggtatcttcctgggctgattgctcattggtggaggcttggcttccaggaagacgcacactggctttccgtagcactttctctcgtttttgtttccaaaatcactatttattgcccttcaaaacaggttgcgtttgaattagggttctgggcctgtacagtctgtgggagcccaagtgcaaagtagattccatcataaacaaggtatcccccctccaaattaacagtaaaataggccatgtgatcccagaatgcatcatttcaggcttataaagaaaagcaacttagtttccttatttttccatttttccatgatcacaggctcacagaagttgcaaaaatagtgccagaagcaccttgaacccttctctcagcttcctccgtagtaacatcgcctataactgtagtgcaacaataccaagagcaggaagttcatgtgggcacaatactattaaccagacctcacgaagtctccacccatttttgtgtgttttctgtgtgtgtgtgtgtgtatgtgtgtgtgtgtgtgtgtgtgtgtggtcctacgcatttgatcacacgtacagatttgtgtgaccaccaccaccatcatgatacaggacagctgcatggtcacagaagggctacctgtcttgctactccttattagttgtattaaccttccccttactcttgggcttctcccctggcaattattaacctgttctccacctgtagttttgtcacttcaaggatggtacataatggaatcatacaatatgtaactctttgatattaactctttttttttttttttgagacggagtctttcccagccacccaggctggagtgcagtggcacaatctcggctcattgcgacctccgcctcccaggtttaagccattctcctgcctcagcctcctgaatagctgggactacagatgcctgccaccatgcccagctaatttttgtatttttagtagagacagggtttcaccatgttggccaggttggtcttgaactcctgacctcaggtgatccacctgcctcggcctcccaaagtgctgggattacaggtgtgagctaccacacctggctgagatgagctcttttcactaagcatgatgcccctgagattcatccaagtactcacatcagccgatagctggttccttttgattgctgagtgatattccatggtatggtatgccagagttcgttgaaccattcacccactgaaggacatttgactttgttgctagattgaagctactgcagttagagccaccctgaatatttgtgtaaggcttttgtgtgaacatacatttccatttttctgggtaccagctgctggatcatatattaagtgcatgttagttttataagaaactgcctgttttccagagtggctaaaccattttcatccttatcagcaatagaggagaaatccagttcttccacattctcaccagcatttggtgttatcactctttttcattataaccattctgttcagcatatagtaatagctgctctctggtttggtgtatagcaatatgatgttaatttgcatctccctaataactaatgatatgaaacatctttgcatgtgcttatttgccgtcagtgttctctttggtgaaatgtctaactatgtcttttgcctattttttgtttcgttttgttttacaggccattttcaggactttaacttttgcccattttctttctttttttttttttttttttttttttttttgagacagagtctcactctgttgcccaggctggagtccaggggtgtgacctcggctcaccacaacctccgcttcctggggtcaagtgattctcctgcctcagcctcccgagtagctaggattgcaggcacatgccaccatgcccagctaatttttgtatttttagtagagatgcggtttcaccatgctggccaggctggtctcgaactcctgacctcgtgatctgcctgcctcggcatcccaaagtgctgggattacaggtgtgagccaccacgcccggccccattttctaacagaatcttttaatgtttgagtgttgagagtcttttatgtagtctatatgcacatcctttgtcggagatgtggcttgcaaatatttatctcaatctgtggcttgtctgttcgttatcttaatagaatctttcacagaacaaaagtttttaatttcatgcaagtccaatttatacttttttcttctatagattgtgcttttggtgtcaactctaggaattctttgcctagccctaggtgttaaagattttatcctctgttttcttctacaaatttttatagttgtatttttacatctaagtccatgatcctttcggaactgatttttttatgtaaagtgtaaggtttaggttgagttcatttatctgccagtggacacacagttgctccagtagccttttagaaatagctatccttcttccattgaattgctattgtccccttgattaaaaaaaaaaaaaatcatgtgggtgcaggtgtatttgtgcaggtctattccgtgtcctccgttctgtcccattgatctatgtctctgtctcaccagtactgtactgtcttattaccggagctgtagagtaaggcttcacatcaagtagaatgagtcctctgctttattcttctttttcaaaagtatttcagaaaacattttttttcctttttcgacttttactttagattgcaggaatacatgtgcaggtttgttacgaaggtatattacatgatgctagggtttggagcatgatgaaccctagcacccaaattggtagtttttcaacctttgctccttccctccccacttttggagcccccagtatctattgttgccatgtttatgtccatttgcacccaatgtttaactctcacttcggactgagaacctgcagtgtttagttttctgcttctgttcattaagacaaaagcctccagctccattcatggtgctgcaaaggacatgatttcattattttctatggttacatagtattccacggtgttttctaacccaccattgatgggcacctgggtttgttgcatgtctttgctgttgtgtatagtgctgcaatggatatatgggtgcatgtgtcttttcagtagagtgacctattttcctttgagtatctactcagtgatgggattgctgggccaaatggtgcttcaactcttaggtctttgagaaatgtccagactgctctccgcaatggctgaactaatctacattcccaccagcagcatatatgtgttcccttttctcctagttctaccaacatctgtaattttttgacttttgaacaaaagccattccaactggtgtgagatggtaactcattatggttttgatttgcatttctctgctgattagtgatgatgagcattttttcatttgtgaattggccattcatatgtcttctcttgagacatgtctgttcatgtcctttgccctctttttaatggttatttgtagaaaaccattttaaatacagtttgaactcaacagctttttatcccctctaaaattatttttctgattaaaacataactcatttccattgtaaacaacattaaaatatcaaaaacgtctaatagaaaaatttaacagatctcgggaggagccaagatggccgaataggaacagctccggtctacagctcccagcgtgagcgctcccagcgtgagctacgcagaagacggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggatgcacctggaaaatcgggtcactcccacccgaatattgcgcttttcagaccggcttaagaaacggcgcaccacgagactatatcccacacctggctcggagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgactcctgacccccgagcagcctaactgggaggcaccccccagcaggggcacactgatacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggttggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaagcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatcgaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgccggagaggatgcggagaaataggaacacttttacactgttggtgggactgtaaactacttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctataacttagagtataataaaaaaaaaaaaaaaaaagaaaaaaaaaatttaacagatctctccacacacctgagagaggactatgttctttcccttcgtatatatcaagttctacttttttatttacaaacgtgtgatcacactctcttcagtatattgccatctgtctcacgatttgtatctttttccttgtctgtaaaaagggagaactattaataatactctatttctttagtctttggtgaggatcaaatgataaaacacatgcagagagtttaacccagcacctgctacatagtaatgtctttgttgatgttatttttattgttcccccttcagcttatgctacctgctttgggtgatcttggcctttcttggtggcaataaagggcagagaaactccataatgtttagtaatccaagtcagtttgcagaagcagtcaggagaatgggttcttccatcactcagtccaggtttcctaccaaatagaatgaatgagacaggtagtactgcaaattcatagtttacttacgttaatcataatgtcaaacatgtcaacagcatcctggagagccccccaagtttcctgtccacttgtccactgtacagccacctacccacgctttacgtactacccagctcttcctctaagtgggatcctcccagaaagccagagctccgctcctagagagcgtttgaggaacctgcatgtggtttgtcttatcttcagatctttaacataagctgtaacgagggcagctagaagcagagcctatcagatcagcccccgccagctccaactagtgaaacccaacagagtccttggaccctgcagcctaagaacataaaaattctgtaatctccttctctttatctcagctctgccttcagatgtgtcccttgaatggcccacattctcccaatttcattaacttagcacattttatttccactaagtaaacccaaggtgcttccatggtccaatataacggatttcccttctgatccataatgccaaacaatatgctacttcattccctttaatggctttgtattgtgttctgttttatagatgtcccaccatttgaccaacttcacataaatggacattttgatggtggttcctggttttcccttttataaacattacagcaataaaaatgcttgaatgtacatcttcacgtacatatatgaaagtctttgtaggataaactcccaaaagcaaaatgcctggcccaaaagtatgagcactttacattgcagtttatagctctttttctaatatgattaaagtatttttaaattaccttcacttttgtcatccctcagttacgctggtttctgtattgcatagattcctagcctgctccactgcaaatgggctgccatacagaggatgaggttcatggtccagaaacgcatctggtactcaagcgcagagcagaggtggaattctaggcctgtgaatggttcacatcagcagtgggggtccccagtgaagtaggatcccaaaggccacagcaattggacggatactaatatccttcatgcttccacgggcatgaacttgaacttgcagtggaagcctctaaggcacagcaaggcaggagcagatatgaagtatgctttgcagctgtagctcctctagaatccaggggctaatgatcaggagggaggtgctaaatattctgggctcctcgcttggacttcaaacctacaagctccccactcttgaacctaaccccattcctgagtttccttctatgctcacatccactcccaaatcctctaaccaccctgagctacattatattaaaagggctactcctcatatgttcaccacagcactattcacaatagcaaggtcatggaaccaacctaagtgtacatcaacgattgactggttaaagaaaaggtggtgtatacacaggtgaaatactatgcagccataaaaaagaatgaaatcctgtcctttgcagcaacatgggtggagctggaggctattatcctatgtgaattaactcagaagcagaaaatcaactactgcatgttctcacttgtaagtgaagggtaagcaatgggtacacatgaacataaacgtggaaacaatagacagtgaggactccaaatgcagggagagagagagatgttggggatgagggctgaaaaaccacctatcaggtacagtgtttgctgtttgggtaataggtgtgctagaagcccaatcttcaccaagagacaatatacccatataacaaacatgcacacatgcccccccccaatctaaaataaaataatttttttaaaggtactccatcagaacacccccaacctcccgcaccctcaggtgtggcattacagaaacctcagcagcaaagccccttccccatccttctccaatcaccagagcactatgctgactcccagaaaggccacatgagaagaacttgctagcccctgcaggtggcccgttcttggtggtagagcataagggaaggggcagggaaaacaggaggagaggaggcatcatttcctgtaaatctagcacaggcttggtttgcttagacagtggaaatactaaaaaagtcaaaaagatccttcatcatacacaagaaaaagggagacgaaaattgaggtgaaaaatcattctgccattacttagaaaaccaattgtgaatcctttcctggttttaaaccatagctacataaactgggggaaatgtctgctgtaggtttgctccacatccagcctcgccccgttgggagaagccttggagctgtatgggttggagcagtgtctgtgtagagtactgatgctctcccactgggccctagtgtgggaccatacgtgaaagccaccaggtagggttgcacatagactctagactcagaccaaccggggtctgaatcccatctctccactccctaactctgctaccctaggcaagtgcttgtacttctctgtgcctcagtttcctcacctgtaatttggagctcatgacggtaacctaccccactgggtgagtagcgtacccgggtcatgacatgaaggatgtatgtaatcgttagctgtgattatcaccattccactaataagctttctgttgctgccgttctgcagggctcaactttctttagaaaatagttgtgttggccggacccagtggttcacacctgtaatcccagcactttgggaggccgaggtgggtggatcacctgaggtcaggagttcaagaccagtctggccaaaatggtgaaaccccatctttactaaaaatgtaaaacattagctgggcgtggtggcgcatccctgtagtcccagctactcagaggctgaggcaggagaattgcttgaacccgggaagcagtgagctgagatcacgcgattgcactccagcctgggtgacaagagcaagactccgtctcaaaaaaaaaaaaaaaaaaaaacacacacacacacacacacacacacagttgtgtttgcatcctgttatttgagttagctcaattctaccaaattcccatcctacagcctgttccagtaaccgcagagccatgagacctggtctgatggcttcttctctagctgcttgtatcaaaagaaggcaactcccccctttccccttcacctgctaatgaggcctggaacttgcagtccacatcacagcatcatttacgttttgtcctttcctggaggtctacaccaggcacctgggactgcaggctttctctctcccctgggtcttaaattacagtaacatcggccaggcgcggtggctcacgcctgtaatcccagcactttgggaggccgaggagggcggatcacgaggtcaggagatcgagaccatcctgtataacacggtgaaatcccgtctctactaaaaacacaaaaaattagccaggcgtggtggcaggcgcctgtagtcccagctactcgggaggctgaggcaggagaatggcatgaacccgggaggcggagcttgcagtgaaccgagatcatgccactactgcactccagcctgggtgacagagtgagactctgtctcaaaaaaaaaaaaaaaaaaaattacactagcatccactcttaccctacctgtaggaagtaccgtgttgctcacgggtgaccccaggaggcttacctttctgttttgtttgtgaaagtttctcccccattttgcttgtgcttccatagcaatgatgctagatgttggctcactttggaaacactcccttcctacaacataaatgtgtgtatgtgtgtgcatgcatgcgtgtgtgtgttgaactgagttacttatgagctgggcttctgcaaaacctgataatcaagggactctgtttccattcagaaatagctgtttttgacagagaaggaaaattgacagatttttccatattcggggattatctagaatatgattcccctcaaatggcccatctttttatcctcaacaatcataggatctgtgacacgtgaagaataagtgttatctggttggtgggtaccagcagtggtgctggtaggaccaaaggggaagagattctgtccaggagtctccttgactggtcagtcctacctgggtccagaaagttgatagccacgatccccattatgatccctgttaaaatccccatgccatggggatgtgttataagcacacatgcaagatgcattacaaacctgatcctaaagccccacaactgcctgataaggtaacagcattatcccagttcttcgcctaaggaaactggagtctagtgaccacacctttttttggttccctgacttagaacctcttaaatattccctcaaggtgtgtttgaatttgttgctttgtaaaggcaacaaagcaggagttaagggaaaccaaagccataccttggaaggaccaaggtatggggttaataaaacacggatgtttcatcatccaggcgtgtaaattacacatgtctggccgtgtgttctcagagtcacatgtgtattttacatgcaagaacaagccagtgggtggtctcgaggcagaacaactcccaggagaactttccatatggactgttttggagacttaagggtcactttgattcaacgcaagtttgtgtgatgcagtgattttagaaactgtagcaagaaggtaaggcttcatggtagttaatgcagaggcatcaccgtgacttgccagaatccttcctgggtggtgtccatggttcctgccacccctcctccctcccagaagtcccaggcttagtctgaatgctcagtctttctgcagctgcccagagtggtcagtgagttacactggaggcttcaaccactgggtttccatagacatggaaatttccattcatggtttctactgacaccgaccccctgggaatgctgaaaacactagaacacagctcttgattcgctcagattttcttatttaagacaaagaaaatttcttgtgcaaaaatcgagtcagtatcattctatctttattctctattctctctctccctctccccatctctgtctcctgtctttattttcttccttatctatccccctttttctctttccctcgctgtttctttcttcttcctttctttgtctcttttcctaacttttttgcatatgtagctgtgtcttttcctgccttctttttctgcactctatccccagctctctagcttccccgcaacacacatacaccacctactatgctatctggcaattcccactggggaactgtggcaagacatcttatcactggggaaggaaattcaagctgaaagaattcacctttttacttaaaatttcttaactctgtgactattcctgttttctacttatgaagtccagcctcctcgccccccattcccctcaggtgtggcagtgaggttaaagtggccacaggctgctgttggagtgagccttcctgctccatgtgggttctataaaatgtgcccttggcacctgttcaatcagacccaatgaggattttggaacagtatgttttctactgtaattacatctcaacagtgaccatttatattattccttgattgcaaataaatttacagtgcttatttttgtgctccctaccttcattgcatttttcaatatatttaatacactttaatcacacagtgggaggtgaggaaatacgggcccctcttgtgaagggaaagagagggtggttgggctcagagctgctttttctttgttacgcatgttgtggttgttttctaattggagagtcatgaacatgtttatggacctgcaaggagaaataagttgatgtgcagggaaggagggcaggaaggggtaaggcactgaggagtacatagccggtgggagccagggactggagttcactttgagcagcaaggaagatagcctcctgcagccaggggaaggaggcaagaaagaggcaaagggagggggcctgtgggtttccaggttggggatgctgaacacggagggcacctgccttctcgcactcttcccctgtgggtcaagcagcaaggtctgctgctgagagaggcaggggtctagagcccactttgcagctttgctgaagcacccagccacctgaggacctgattcaaaaggcgggcccaggttgtacctttctaaccagctcacagctaagctggtccaaagcccacactttgcatagggaggggaaaatggatgacatgccattttttcttcattgtcaagtaagctggagtctgaacacgttctaattggacaaaatggaaaatgcggtgttttaattttctgaggcccattgagacagccccaagggtgacacagctgcctcctttcaagcctctgctcctttgtaggttgatggaacttgaccctggctgtaagaccagaatcaatgtgttgcacctgcatccacttggcacccacaggtataaaatgtatttattgaaaagcagcaggaagtacagaaagcaggaaaaaaaatacctttcttcttttataaaagggattatcagctgctaattcaaaaattgtagggtaatgaaaactacatcaataattttcataataattatagtctttggttttacccttgaatgtttttctggcaacatctgattcaattaccccagaaaatgttactatgctcttccagcattttcctatgatgtttgaatctatgaccaaataagtgataactcttgtcctaggggagcttgtgggctgccgtacacaggcaactgtcatgtagggagacctgacacacacatcttagctggattagtggttctcaaccccagagggttttccacaccccgctgggacacccaacaatgtctgaacacattttttattgtcacagcttggatggtgctaccagcatctagtaggtaagaactaaggatgctgctcagcatctcccaatgcacagggcagcccccacccaatgaacaattatccatcccagaatgtcattagtggcgaggtcgaaagactctaagtgagattaggattacgattagattacaattcgaaaagaaaaagcagggtggattcggtggctaatgcctgttatcttaacattttaggcggctgaggctggaggattgcctaaggccaggagttcaagaccagcctgggcaacatagtgagaccctgtctctataaaaattttaaatatataaaatatattttaaaaatttaaatatatatatagtgtggtgtcacatgcctgcagtcccagctactctgggggctgaggcagaaggctccattgagcccgggaggtcaaggctgcagtgagccatcatcacgcaagtgtattccagcctgggcaacaaagcaagagcctgtctcaaaaaataataaaataaaaatagttgatcagaacacttctggttataagagacccctagctctaagtagtttagataacaaggggactttctattggtaggaatattaggtagtgagagactagggtactgtaacaaaaagttcccaaaagaacaacgtgtatttctttgctcatgaaattccttaaaatgatgttcagtgcaacaaacatcgtttctttatgtattttatttatccattttcattataacaatgtgcattttattgcttatgtgctgggcattcatgtaagcattttataaattatttaatccatcataatcctgtaagggtaggtattattattattaattattcccattttgcagatgagaaaatggagacacggagaggttaaatgacctgccaaaagtcacaaagataacaagatgcagcttcctgtggctttcaacatgaatcactttcctcattggtcttttattttcctctttttttttttttttttttttttttgagatggaatcttgctctgtcacccaggctggagtgcagtagcacaatcttggctcactacaacctctgcctcccaggttcaagaaattctcctgcctcagcctcccaagtagctgggattacaggcgcccactaccatgcctggctaatttttgtatttttagtagagacagggtttcaccatgctggccagctggtctcagactcctgacctcaggtgatctgcctgcttcagcctcccaaagtgctggaattacaggcgtgagccaccacacccatcccataggtcttttttaatgtgacagagtgccactggagtgcgtctctcctcacgcagattttcattatgttactccaccctgtgatgagagcccaggagggacagagaatgctttttaatcctccttatctcattgagcctgattcccaagggaacgattctcatccatttattctccctctgggactcagaaactccatcagccacctctggaaggaatatgcgacgtgctcatgggaattacagtcgggcccaaggggtctatttgaaatgggaatcagtggtgcaaacacagagaatggatttagagcagtttcttctgactaagacatttggaatttaaatgcaaattagaagctgtaagtcaattccgtgtatgaatttatacaaatcccttgtaatgaaagcagaaggtttctcttgtccttgtttgtgctgtggtgttagcatcacgagcctaaccaagtgtgtcaatctccctacagctctggagattagacatgtgctttctccagttagagacggctgtgagtgccatgctgggggtgggattctccatgggctgcaggggtctgtgtagtttctccattaacttcagcaacaccccatggaaattgggaagaaggagggtcctcgtggtttagccaaaggttttgaaagagacaaggctctcattgtaccccctctttactggcccctcatgccattcacaaagcaagccctcattctcaaatattgcctttcctcactcaggagctggaggctgggctctgggaagctgacaggccacggtctcttgtatttgaaaggagcaacccaagggctacatatgggttaacaaatgacttgaatccccagcgcctgcagcctggagtccccatatgacccagcagctccactcctaggtgtaaaccgaagagaatgaaggcataagtcctcccaaaacttgcagatgtgaacattcacagcagcattattccccatagccactaagtggaaacagttccaggtccatcaactgataaatggagaaacaaaacatggtccatccacatgacggaatgctttcagccacacaaaggactgaagtactgatccacgctacagtgtggatgaaccgtgaaaacacgatgttcagtgaaaaaagtcagacagaaatggccatatattgcgcaattccatttctatgaaatgtccagaacagggagatctccggggacagaaagccaattagtggttgccaggggccgggagtgggtgaagaatggggagtggctgctcctgggggtggggcttctgttcgaggtgttaaaaaaattctaaaattgattgtggtggtggttgcacaactctgtgaatgtactggaatccattcatatgtacaatttaaattgatgaattttttggtatgtgaatcatagcgcaataaaactgttagcaaagaaaaaactgcatagcaccatgtctaaagactataggggatgtcacccaaagggtcacctttttaggcagaacttgagctcttgttaaggtttgaaaaatcacaagctgttttttttttttcctccatagctcagaaatcaaaccagattgaggaaaatctttctagggaaaaaaaactcacaaaagctgagaaaattaaaatatatagagctcctagaatcaggaattgtagcttacttttaatatcatcagcactctagcatagttctggtacttaggtgttgaagagttgacaggaaacagaacccaggaggtaaatgaagaatcaatctgttgggaagaggtttagaaaggaagaaatcacttaggaattctcttaccctgctttatttttcttcaaataatccaacaagctgggtatttgattatttatgtatctatgtagcatctcactcccacatagggacaacactcatgacagaaggggcctcctatggtttgtccgctgctgtgtccggcattaagaaaggcgctcagcacggcgtcatcagccataaatatttgtggaatgtacagacaggggattgaaggcttggataggggaatatgtccttggagagtgaaatgaacgagtggctaggaacacacacatgggtgggggaattaacatactgacagggaatgaacaaatgggtggggtaatgaatgcacaaatcagagacttaatacatagtatagacagggatgggcatgtggctaggggatgatggatggaggataaaagtgtggatagaggatgaatgaatcattccagcagagacttgtaggcagccagcatgactgaatttgttccggttctttctatcaggctggtgcaaaagtaattgcagtttttgcaattaaaaatggcaaaaaattgcaattacttttgcaccaacctgatacatctataagcatgtctgggggaagggtccctcctgcaccctcacgtggtggggtttatctgaacattagggtataggccatagttaggaacagcccctgaatttaacagagaaagaccctgaagcaagtaaggcaggtcaggagaccaggatgggcagaggtcctgtataggacaatgtgcaagaaaggacccaacaaggcagctttgcaagatgtcgggatcaggggccaagaggagaagaagcacaagaggtcagacgaagaatcctgcagattgttagccccaggatgaggaaacaggcctgagagtctcatctgtttcatcagagagcaataaaagaaaattaaaatataataatgccaggatgttccaaacagctctttattgctacagaactaccatgcctgtactttcgtctccaggcaaatatactcaaaatagtttcctattgctccactcaccccatcattcgtcccctttctgcattaggcctacgggttaatggatgctgccacctgatccctgcatgatttcccaccaaccctatgactctgggttctggagaggtgaaagagcatctccaggtggctcaaaactgtggctccaggtactactcctccaggcgggctgctccctggggcacgtgttctcagtccaccagtgggccatgccgcatcagcccacctgcttcctggcacatgggatgcacagcccatgaccttggacccagcagtaggcagcatgctttccagttttgaaggcaaggacggaggcatacaaggcactacttgagatcctgtctgatttagaattttgtaggacggattcctgttgttgaacacactgagtgatgagaaacttggcaaatcttgttggcaaatctctcaccttgattccctttggcatcctttgtgtctgtctgatccttccagcctggcctttggatagcaggtacccacttcttaggatgtgccagacaccacggtaagagtttgatctgcacttgttcatttattcaccagaatcacctatggagttagcagtgaccctatccccattttacagataaggaagtaccgaggcttacagaggtgaagttgcttgtgtcagggcacccagctgttgagtgacaaagccagatcctctgaggtggggcactgagcagaggcccgaatggcaagatggtgccagtacatgaagacaagagtctgtcagagagaacgacacaggtagagtcctgcagcttgagcaactgtttacaaacccatggcagagcccatgtgaatgagggagaaaaggcagagatgggcagatcccagaaggcctgggaacccatggaaaaggctctggattttgtaaagtagaagctgttgcagggctgcgaagacagaggaatgtcagctccatgagggcaggaatgtgtgtcttctttgttcagtgaagactcccaaacacccagaatcgagcctggcatgtagcaggtgttcagtggcttcattgaatcaatgaatcatgtttaaatttgtaacaaaatgactctggctgctactatgcagaggacaggttgtagagagaaagtggcaggggggaaaacagaggaggagtcaaacacccctgtaggagataatcaaattacctgagcggagcttctgatggctccaccaaggttggtaggggtgggacacagagaaataggcctattcagcacatattctgcatgcatgcaaccattaccactatctaaggctggaactttttcatcacccgaggggaaactttacacccattaagtggtcattctccattcccacccctcacacccagcccctggcaaccataagtctgttttctgtctgtctgagtttgcctcacagatatttcgtagaaatggaatcatatagtttttaagagttgttgctgatggactggatgtgagaaatgagaaaagagaggaatcaaaagatgactcctgcattttcagccttcacaacatgaataaatggtggtgctctttgccaagaaaagggagaagggggaaagatgagatttgttttggtggagtcgggaggtggaaaggcctctgtttcgatcatgttaagtttgaggtgcctgttagacacccagaagcagatgctggctgtgacttggcacttacaatcctggatacagggcagagtccagggttgggggtgtgagtgtgtgattcctcagtagagaggcagggcatggaagttctcatccaggtgctgactgatgaagagctgccattgcccaagctgggaccagaacccctgagccatgttaagaaaaagtcaaccagatccaggcattgttacccttgaatggtaaaggtgatttagtggaatcttgatcaaggctcctgagccatttcctgtgggaaagtagacatctttgaatgactgcacagagaatcgtggtctttgccactctcccctacagttttggcaatatcacagccaattttagggcacaaacacaaaccattcccagttatcctttgcctgtaataggaataagacagcatggtgtaaggaattacttgattttagaaggcatttcatctctccaagtcaatctttagggatcgacactgctggtggcttatgaatttcagatgtggtacattctgggaatgccagctcttgggctccaggaaaggtgattaaaggacaggctgatgccaacatttatggagaataaaacttgcacttcaggtacagtaaactcagggcactcagttgggcttcactcttccatattcttaggaaagactaaagtcacatgaataagatctcagccctgcatatgtaatggcaaaatgaatgatgtaggctcttcctttgagaaactaacagactgtggatccagctcattgtaaagaaacagccatatgagtgatgtaaagggtattaatccctcaatacaggatcatttatctgtagtaccactccattgctacattgttcctgagccaagtgtcctggccaccatgtctctgggacagtgagtgacattatgaggtcaaacaaggtgtcccccatagaccgtcaagaagacaggctgctgcttttcagggatctctactctgatccccttgggatagcttctaggttcatgagtaggcagaatcccactgagttcctagttcctctttgacccccagagcagcactttagacataaagttcatctatgctcaggatgacagccaaccagtagctccaaagtgttccttgacaatcattttctactttactgaacagcccaccttcctctgcagcagaccgcttctttgctggagaggctgtgggctggggatatggagaacaaactgatgagtgagggatgtgtctgcagaatcagtcagtggaagagatgacctccaggagactgtgatttccttggcaaaggtactgcatttgcttgcttagcaatatctgtgaactccttgccatagaacagcaagaattcgcaacattccctgccagtggcatccttcagcactgccagccacatgtcctcaccagcaaggtcccatgtcctcaccagcaggtcccatatcctcaccagcaaggtcccatatcatcaccaccaggtcccatatcctcaccagcaaggtcccatgtccccaccaccaggtcccatatcctcaccagcaaggtctcatgtcctcaccaccaggtcccatatcctcaccagcaaggtcccatatcctcaccaccaggtcccatgtcctcaccagcaaggtcccatatcctcaccaccaggtgccatgtcctcaccagcaaggtcccatatcctcaccaccaggtgccatatcctcaccagcaaggtctcatgtcctcaccaccaggtcccatgtcctcaccagcaaggtcccatatcctcaccagcaaggtctcatgtcctcaccaccaggtcccatatcctcaccagcaaggtcccatgtcctcaccaccaggtcccgtatcctcaccagcaaggtctcatgtcctcaccaccaggtcccgtatcctcaccagcaaggtcccatatcctcaccagcaaggtcccatgtcctcaccaccaggtcccgtatcctcaccagcaaggtctcatgtcctcaccaccaggtcccgtatcctcagcagcaaggtcccatatcctcaccagcaaggtcccatgtcctcaccaccaggtcccgtatcctcaccagcaaggtcccatgtcctcaccaccaggtcccgtatcctcaccagcaaggtcccatatcctcaccaccaggtcccatgtcctcaccagcaaggtcccatatcctcaccaccaggtcccatgtcctcaccagcaaggtctcatgtcctcaccaccaggtcccatatcctcaccagcaaggtcccatatcctcaccaccaggtcccatatcctcaccagcaaggtctcatgtcctcaccaccaggtcccatgtcctcaccagcaaggtcccatatcctcaccagcaaggtctcatgtcctcaccaccaggtcccatatcctcaccagcaaggtcccatgtcctcaccaccaggtcccgtatcctcaccagcaaggtctcctgtcctcaccaccaggtcccgtatcctcaccagcaaggtcccatatcctcaccagcaaggtcccatgtcctcaccaccaggtcccgtatcctcaccagcaaggtcccatgtcctcaccaccaggtcccatgtcctcaccaccaggtcccatatcctcaccagcaaggttccatgtcctcaccaccaggtcccatatcctcaccagcaaggtcccatgtcctcaccaccaggtcccatatcctcaccaccaggtcccatgtcctcaccagcaaggtcccatgtcctcaccaccaggtcccatatcctcaccaggaaggtcccatatcctcaccaccaggtcccatatcctcaccagcaaggtcccatgtcctcaccaccaggtcccatgtcctcaccagcaaggtctcatgtcctcaccaccaggtcccgtatcctcaccagcaaggtctcatgtcctcaccaccaggtcccatgtcctcaccagcaaggtcccatgtcctcaccaccaggtcccatgtcctcaacaccaggtcccatgtcctcaccagcaaggtcccaacacaagttagaatgtgccatcaggtttcttttatcatttgatcttagaactaaaagggacctcagtggttacctcaagctgttgttctcagcccttggctgttcattagaatcacaggggggtgttttcagaaatacgtatgcctgggccccatccaagaacgatctctgaaagcaggaccccatatcattagtgggtttgttttaaggctttcaggtgttttaatgtgtagtcagggttaagaatgacagctttagtctgatacccttttctcagataagtgaactgggactcagagatcttgcagaatttaccagaaaggtacccatgagttagagcagcagtccacaacctttttttttttttttttttgagatggagtctcactctgtcgcccaggctggagtgcagtggcatgatcttggctcactgcaacctccacctcccgggttcaagcaattctcctgtctcagcctcccaagtagcggggactacaggcacccgccaccacacccagctaatttttgtattttttgtagagacgggatttcgccatattagtcaggctggcctcgaactcctgacctcaggtgatcctcctgcctcggcctcccaaagtgctgagattacactcagaagccaccacgcccagccaatccacaacctttttggcaccaggaactggttttgtggaagacagtttttccacggaccaggattgcggggatggtcttgggaggattcaagcacattacatttattgtgtgtttcatttctattattattacattgtaatatacaatgacataattatacaactaccataatgtagaaccagtgggatccctgagcttgttttcctgcaactagacggttccatctgggggtgatagtagacaatgatagatcatcaagtattagattctcatgaggaatacacaacctaggtccctcgtgtgtgcagttcactatagggtttgtgctcctatgagaatctaatgccaccactgatctgacaggaggtggagctcaggtggtaatatgagcaatggggagcagccgtaaatacagatgaagtttcactggctctcccacagctcacctccttctgtgtggcccggttactaacaggctacagaccagtagtggtggttgggaaccactgagttagaggccaactagaatttgccccacttcattgaattccctactcctttaaatatgcagaattgcataagccaaactccagtgtctttagaaagcagactatgttattgtttcttgaaaagccattcttcctccagattcagatgttggtggtcaaatgagtatctctacagaaaatctctctgcttctccgaattaaactattttcaattatcttgtcagatgaacaaatgtgttttgcattttctttcattttttaaagagagaaactcaagtgaaggagagctactaacgtccaatgaaataaagtatccaagcctgaaattgaagaaaaaaaaatgtaggcatatttgctctttggtttttatttttctgtcaccatctaatgtaatatttatttaatcattcccctaaggcaatgattttcaaactctctttagcagcaaaacttttttttttttttcaaacaaaatcccaggcaggaattctaatatacaaaacagataaaatataattaacagattcctcaggcagtttaaattcttattatttgaaggaaaatgtttgatgccttggtaggactcctgtaccatctcaaacattcttgctggactcagtggctcacacctataattgcagcactttgcgggaccaagacaggaggatcacttgagcccaggcattcgaggccagcctgagcagtatagtgaaaccctgtctctacacaaaatgtaaaaattagcttggcgtggtggcacatacacacccagctactagggatgctgaggcacaaggatcacttgcacttaggaggtcaaggctgcaatgagacgcagtcacaccactgcactccagcctgggtgacagagcgagaccctgtctcaaaaaaaaaaaaaaaaaatcttgttctcaggaacacagtttaagaaccaccgttccactgcatcgttttcctgtcagtcttcagtggccatgtcttttcattttgttttgtagggcaaagacctgctttgttatgcaagcctcttctccgtgaaaatgcatttcatttttagttttgcatatgtgcagttctgtatttggtgtagacagggtcatgtagaggaagagtacagtcactggaaggtggactgtgccaggtgggcatcttcctcaaaagccatggactcagcaccttctgtgtatctgcagccaacacatggaaatatctcataggaaatgaatcagagaagtgtgccctgaggggaagagggagcaattcctgccagggcatgcagtgaatgtttccctttcttgccctttggttcattccccagcacctgtagagccaggaggttgagggatgcttcattttctctctcagtggaatgggacccacagacagctgctgcctaggaacatcattttcctttcaacccaggatcaccctgggtgggtgggtcacatggggcaggacatcagtgagggggacattagtatcagtccaggatcaagaaccacactacctgggatgccaatgggttttggagaggactcttcactcaggacgtttctttcttgttgagatgctattccttattatttttgaactatttccacattcgagttttgcattttctcacctgtttagtaatggtggatggcttcagacatttaactgggaagactctggatgtttagtagacctttctgtcactgtccattaccatagctagtaggtactctctctttgcatgatggagataacatgcaaatccttttagcaaagcatctggcacaaaagagaaacacaaaattgtccgtagaagaaattaatgttagttggaccaagaaaggactttgattatgttttcttaaaaagaatctctgtgttttagactgaaatctttacagatgcaatggcatgtctgggatttgctccaaacagtgcagaatcggggcggggtggctgcggagatgaaccaccaggagcagggagttgaggatctctaaagcctgaagacaggcatgtggggggtattatcctattgtacatgcttttatacatgtttaatatttttcataacaagatgtgaaaaagaaaaaatacttgagaaaacatctatgaaacccaaagcaccatcaaagggaccactcacctgatgagatcagtagacatcttcagagttgttttccccagggcgccattattgcaaggaatagaaacctgctcaaggcagctggagtgaaaatgaggttgttgatgggaacagaggttccaacagacaagaacacagggaacctcggaggattgagagcaggactgggaaaccagtcagcgactgagagcacttcctatttgtcttttgtctttgagtcccagaaaaaaatctcttttgtaaatttttctctcaatttctccattcttttgcttctccatgcatattggatttctctgataatttatccttatccaaatgacaaaaaatggccaccccttgcacaaatgctgggaaacctatatttctcttagttcaaatttatcaaagaaataatcccatttttcatgaatcaactgatggagtggttaccccggagtcaggtaatcagctctgggtccaatcagctatggccaaggaagctaggatcacatgatacaaaatgactccctagtaccactgttttcagcagggactgggggtaggtttaggtccctcaaatgttttatggattatgcaggcaccctgagctatatctactcaaaaccgctaagattttcaggaaagaaatattctaatttgccatttagaaattatataatctctgtcatttggactacagttgagtccactttcctttttcttaggagaaatagagaagaactggttactattctcattgggagactctcaaacacatgtacgttgttttctttctaccttgtgtttttattcttgagacaaaataacccgaaaagttagtgtctacttacagtgctcttactttatgaaagatgtgacattcagcattttggggaagcagagacatgactccgactcttcaggagctcaacaatgggagaggcatgccccaggttgtctgtgtttgagaggcagggaagtctgtgccaagttctttctgttcatggttactggaattctcacctctagcatctgatttctttctttcctgtgtgagctacctcccatgggcattaaaaatcaagtctctgacaccactccgcatcttcaaagaaaacaaatcatttacagaattttaatcagataaagagaggagaaggctgggcacagtggctcatgcctgtaatgccagcaacttgggaggccaaggcaggaagatcacttgagcctaagagtttgagaccagcctgggcaacttagtaggactcccatctctacaaaaaaaaaaaaaaaatttaaattagccagtcatggtggtttaggcctgtggtcccagctaaggcagaaggatcacttgagcctaagaagtcaaggctgcagtgagccgtgatcataacactgcattccagtctaggcaacagagcaagatctgcttcaaaaaaaaaaggagaagaaaaagatgctcaccaatgactaggactatgatgatctggtgggttcctgaatattctttcatctggctcctgtagtcacttcagggcctgactatgccttttctactgtgacgtagctagggaaggacttagtaggttccaatcatcttgaagacttgccagtgaacagaccatagttcttaggcaagcaaccacaggtcccttgagtggctctgttattaatctgttctgagacatcgggctttcttaaaacattgaatgagctttatgtagaactctgtactgtatactgtttaaaatttttatgtaaatatatatcttatgtatattttatataattagtttttatttttatattatatttcatattatatatgtgtgtatatatatatatatagtgcacacaaacatgatgtggaggctgaatgaaaatgttctcatacgttttcttctaagaactttactgtttacatttcacattttgtgtatggtgtgaggtaggggtcaggattcattgttttctgcagatggatatccaattgatctagcaccatttactgaaatgaccgttacctggaaattaaatcatgtcaaaacataaaagcatccataattggccacaggtacagccttggatgtatgacagtgaaggaaatggttttagaagtggtagaaagcaaattgtcagatatgttgtagatgtacagtacctacaaagaaaggggacacccagagggaatactagccctctcacttactgatgtatttttgtgcctagtggagtctccagcatgcaacagacacaacaaatatttattaaaatgaattgttgtatctttccgccatgagataaatcctaatcatagaagaaaaccagatatctaatgccgctttcccttccaaatgtggacatgataggattgacatcatttgcctcatgtctgttgttggagcataacaagaatgagcaagtgtgtgagtgccaggcatacataactgaaaaaaaaaagcttcttccacaccactcgaggaaaataaaatacatatatacataactacattatatggcagactgtgataagagcagaaagagtcacaggggtttaaaccaaattctccaatttcttagtaagaatttcatatgatacagggcaaaatccatcatcattatccttgctaacaaatactgactccttgttatacatatgccaggctatttgccaagctccttaaatgcattatttatatcagtcacagttgctacccattagactattgggaagagccttccaataagctgtatcttttatgtaaacatagactcaaaaatgtttgcaagttatatttctgatggtctctcccctacccttttatcatcacaaatagaaattagtgagaccctataatttttttaagctaagggccagatgactacatcccagcttttcaagttccatattagttctctgtgaaactttagggttaatggctcgtgaacttagtctagtattcaggtcaaacatgcaactagtcaagcatgcaagcttgcatatgtgcagtcctttaaacttgtcctctgtcacttctttcccatctgtgtctttccagccttctgatcattatttccatcttccatgttaatctaaaggtcaactttctgctcttggaggaagaacatgcattcttggtgtataataaaattcaagtccctcttcctacttgtgattgtctttgtggctcatccaggcagcctcatcctgaatgtctatgatgtaagtcaaagaaaagaaaataatcagtcctgaatttggagggaagagatcataagcccagtacatagtcccaacaggccacagtgattgtgtaaaaatacgttttatatcttgtatttgatttgccacacagtttaacagaaaagtaactttatctattttttccaattaaaggtagtaatagtacaatcaataattcctcctgctctagtgtggtaaattaatgtctttctattgtttttaaatcacaaagtgagcattgctatagaaatgtaaaatggtaccatttcattttaatctatttaattttcctttcttgaattatataatggggttaaaacattgaatagaattaatagaatgagtatttaattaaggaataatgagcttctaaatgaatgctcaaagaaactgcttcatagtttatgcagaaatcagataatgggcttaacaaatactataataattgtgttgaatgttttccatatttaaagattttttttttctgtattctctcaggagtagatttaaacgtaacccagttccttgattaggctacactttgctttcatagtaaatcccaaatgccttcccatggcccacagggccctgcataaggtgactctaccacctctggagtctgatgtcatagagttctctctggctctccccttcattccagccacacccagcttgcctttgttctgcaaagccacctttggctcttcccgccacctggcctttgctcttcctctttcagatgccaggtatgttctcacccccttcacctctctaaggcctcctcttctttcagttctcagggaatttttccctgatgatcctctccagactggatcagatacccacctccacacatacacacacacacatacacacacacacacagactccccaagaactgtaattttatttcttgacaattaacacgttgttatacatttctttcccatctgtctctcctttcagcctgtaatctctctgaggaaatatatcatgtctgttttgtttagtggtgtaaccctggatggatggatggatggatggatggatggatggatggatgggtggatggatgaatggaaggatggatggatgatgaatggaaggatggatagatggatgatggatggatggatggatggatggatggatggatggatggataaatagatagatggatggcaggtaaatgccgttgtggacccatccaaggacatatgagggccacaatgcacatctctgagaattcctagcacatcagcccctttccattctacttgaattcatttgcccacacactaaaaaggtattctataccagccccttcagcaggtgctgcagacataaaactatcagtgtcatggaagaagctgcacaggtttgtctcacttatacatggcctaaatattaattttattaattcattcatccacccatccacccacctacccatccatccatccaccacccacccatccatccacccatccgtctatccatctatctgtccacccatccatccatccgtcccatcttcagacctgctcatgtgttgggcactgtgctgtttactaaggatcagggctgagtcatccattaggcaccattatcacagtgctaggaccctaaaatcgaaagaaataaaaagaacttttagggtaaaataaatttttaattcttttcttcacatcacaaaaataattttttctgagacagggtcttgctctgtcacccaggctggagtgcagtggtgtaatcatagctcactgcagcctcaaactcctacactcaagagatcgtcccacctcagcctcctgagtatgtgggacgacaggcacgtgccaccacacctggctaattttttacatttttttttagagagatgggaatctcactatgttgcccaggctcatcttgaattcctgggctcaagtgatcctcccacctcagcctcccaaagagctaggattacagtgttagaataccatgcccagcccccaaaataaattttttaaagcacattactctattatgataggaggggttgatgaaggcaaaggtgactggggtccaccagccatgacgcagctctgctggagcacagggaagatcagtccatccctggtcttctggaacactcaggcaagtggcagaatcaggtgtcagtcaacaagtcagtccctcttagtcttgcttctgtatggctttgtcccttcacattccctcaggcctcacctctgctgccagatcccacttcctatacttaagatcattcattcattcaacaaatatctactgagtttcttctgtgcacctagcaccatgcaagagactggagataaagccatgaagagacaggtgcacatagagcctccagcctcctcaaatcatgatttctcacagtgttttcatcttggcaatgacactcatctgctttgacagagcaacttctcacttatgcactggacatgacagcgtttctacctgactggtggttcccagcatcctctagccttagcccatttcatgcccacatgattgatacctggttttctaaggtacaggtgtcagaagaaccacaaggacgggttatgagctgacatccactttgataagcaggggcagagaaccagtcctttggctctggaccgcagcaagagggtgaaggaaggactggcctaagccatggggatctaaggtgggcaggagtggcagagcaaagattactggaaaccaggagacttaggtctgatctttgggtcactaaacgactttgggcagcactcttccttcttccttccttccttctctgtgcaatcatcttcatctgtaatatgaagggattagatcacacatgtgtcaccaagccccctcctgactacatggcaggtagcattaattgatcacagcattctttcctgctgagcccagatgtactgcaggcctgtccacaccaggctcaggcagcttcacccattcacaagggtaggtcatgtcattgacacctgcctgccgtccttagactgggactctatcctgcttcttgccccgactacatattggaattatctaggcaggtgaataaaatgctgagtcctaggctttaccccagagcctggggaatctgaattgatctggggagtctgaatctgaattgattccctgactgatgcctgattctgccacttgactgcttgtcccagaagaccagagatggactgatctcccatgcgctccaacctggctagaggaccccgggcagtttctctttcatcagcccctccaaccataataaccataatagattttcatgcgctttaaccctggggaatcctgaattggaataggactcgggaagtttttcaaagcctctgggagattctaatgtgcagacagggctgagaaccgttagtatagttttcttgctcaagaattctatgatttttgtgagaagagaagatagaagataggtagacattaaacaagaatcacacgaatcagatcaaaataattgcaccctggagttgtttctgtgttacagcagcctcagtatcccttctcattcccactattttctagcctccatgcatgttctaagaattttccagctctccttttatggaagacaactcgcccaggtttgccgaggcgcaataaacaaattagttgcagtccccgccctgtcccctgagaggcctcaggattaaggtttatgattaatgatttccaagtcaattaatcagccactgcttttgaaacctcatttctcaaattacttttctttgaacacaagggctttttgatatcaccttactgtctctagattcactttcctactaattgaaattccaagatatttcttctttttgtcagcttattggtgttacttgtttataaaatatttgcaaacacattactattcacctgtagtgtgtcagaggtaagcaccaaaacaatactttatgctttcggctcaaaggaatgtgctaatgaaagctcatgaaattctctatctatgagaaagttgatttttcatttattgatttattttcaccacacctacttgaaacaagaatttgagatgtattacaatagaaacacaggtacatcaaggctccaaacaattcatgtagatgatttcttagaaaatggtttctaagatcatattaaaactggatatggagtgggaaggatgggattggttttcttcattagggaaaatagcagtatctagcagaggatctggggtcaaatcccagtctctccacttacaagtcttaacgcttgactcatctgattatgttgttattttggggaggcaaggctgcgagaacaaatgcaaacaaaaatggcttgaactcaatgaaaatttgtttctcattcaatgatagttcaggacaggtgttcttggccaccaggttgctcccctccatgtggtgactcagggacacaagctcctccttccttgtagctccctgcttccctggggttttgtggtcctctgcattcaggtaggcagagggtgaaaaagcacagagaggaggcacagctgttcttttcaccctcccaccacagagcagcacagcacagccatggtcagtatcattgctgcccacattctgcaggagagaagttagtctcgtggcctcacctaagttcaaggaaagctgagaagaagagcatagtatcttccaaccgtaatcctcttatgttattatttatttttaagtgagatgatgtgtgtaacatacccaatgcaaagcatgtagtaaatgactatgtgttttcaaaatagtgaccattaccatctgctttgtttgcagtttcaagccacagtcgaggaaggagctgtgggagttattgtcaatttgacagttgaagataaggatgaccccaccacaggtgcatggagggctgcctacaccatcatcaacggaaaccccgggcagagctttgaaatccacaccaaccctcaaaccaacgaagggatgctttctgttgtcaaagtaagggtgcttccaattgcctctttctcctcatgcgagcacggagggccccatgaggcagctcatagaatcattgagtttagaaggccacagataaattcccccagtctcctccttctgggaattaacaaaggaaaaggctcatggcttaagggtgcactcgtatcctcagcagcataaacaagcagccataaaacaaacctgttttataggttctaaaatacccaaacttatgtgtaactttaagaaaaccaaacttaagtgcattttttattttgttttcatttttgttttttgagacagtctcactctgtcacctaggctggggtgcagtggtgtgatctcagctcactgcaatctccgcctcctaggttcaagtgattctcgtgcctcagcctcctgagtagctgggattacagctgcctgccaccatgtccggccagtttttgtatttttagtagagatgaggtctcaccatgttgcccaggcttgtctcaaactcctggcctcaagtgatccacctgccctggcctcccaaaatgctggagttacaagtgtgagccaccatgcctggcccaaacttaagttttaaatgaaattctttatacatttgctaaggaattattaacagatatgccaaaatgagatgtgtgaaggtgtttttagagatctgtgctcaaaacgtgggctacgacatgacttcttaatcttccttagtgagctcaattattccttaaaaacacacacaacatagttattggtgtgaaaccctctgtgacccttgctaactcacacactgaccctctctatggcaacaagtagaacaaggaggaaatgtaattataaatgtaaaacctctagctcatgctggtaatccagaaatattagtgggggtggtagcacagaaggcttgctacaggtggccttggtattctgggagaaggcatttctacacagtttcactctttctgggaagttctggggagagtttctgccagagaccaggaccttcatgggaacacattttcttttctagtggatgaagccatttgcctgagcagcagggatcaattgtatttatagtgatagtaccagtgggcagagcagggaaatggctgcccactccctgtgtgcccttggccaagacacccatgttttctgtgcaccagtttcctcatctgtaaaatgagaatgttaatgtaacctccctcttagggttgttgttgtaatccattgagttgttataatgaagtactgtaggctggtggcttataaaccacagacatccatttctcacagttctggagcttaaaaagtccaatatcaaccttccagtagattctgtgtctagtgaggacccactttttgatagatgtccatcttcttctctctctatcctcacatggtagatagagtgaggcagctctctggattctcttttttttttttttttttttttttttttttttttgagacagagtcttgctctctcaccaggctggagtgcagtggcctgatcttggctcactgcaacctccacctcctgggttcaagtgattctcctgcctcagtctcccgagtagctgggattacaggtgcatgccaccacacccagctaacttttgtattttcaatagagacggggtctcaccaggttggccaggctggtcttgaactcctgacttcaagtgatctgcccgccttggcctcccaaagtgctgggattacagatatgagccactgcaccctgccaaatcctgttttgctcatatctattttccttgagctgtagcaaacacattttggggaggcctgagctccaggatatgtgatggagatgtctatttacccaagttttatcttccaaacttcaggtctggaaaattgtctgacagattttatagactcaggactagccacggaggacagccagtggctatgtcattctatgacttttacagcttcgaaagtgcaacagccatggacacagagggccagtgccagggtttcctaataactttgccattgcccaatacattagtgcttttatgtacttcgtgcattactgctagtccccatgaataatatacagtactataattgcttattcatacatagtacattcatatataggagtacattacaaacctagtctacatacacataagcacgtattaacaatcccttaattaactatcgcacatctactgttgtcaagtacacaataaaacctaatccatacgaatactgacccgtactagaaatccttaatattacgtagtacatacattcgttcatcggacatagcacattgcagtcaagaaatctcttgccaacatggatatcccctaccaaattttggcctctgaatctaccaatctccgagaaatcatccccgctcaggagtactaccctcctcgctccagacctataacacttgggggtgactattctgaaactatacctggcatctggctcttacttcagacccataacattaagatcacccacatgttacccttaaattaagacatctcgatggactagtgactaccagcctattaaccaaccttggcaacagagtgagactctgtctcaaaataacaacaacgaaaaaagaaaaaaaagaaaaaccagacttgcaggaaggagccattctcctctccctacattcctgtgctggtccacaatgcagtggctctcaaatgctagcatatataagaatcatctgcaatgttagttaaaatgcagatttctgggcttgccccagacctgctgtgtcagaatatgagagagaggtgtgccaggtggttctgttgttcacagggcacaccacttgtcaaggggcatggccttaggggaagcagtttccatcagcttgtccgccctccctgcaaattccaggggaagaggtgcccacagaggctgatgctcttgctgacttcagctttgctagtgagtggactttctttgctttggaattgggatgcagactctccctcaccccacattggctgcctcccaggtcagtaggaagggccttgagttctatctgtctctcagcacatgtgaggcagagccccagaacaccttctagaagccagctaggccatgctctctgctgctgtccactgtgccagccactggtgcaaccatcagggatgcattctgttgcaagtaacagaatgttagactaatagtggcttaactaatgaagggaatttaagaatttttataactagatgaaggtaggccagtccaggattggccaacagttccaggtggcagagagccagcagtggggtgcctcagatgcttttgacattttcctcttggacataaagtagctgccaaagccccaggcatcatatcttcccatgatgctgcatcctaatgcaggaaacaaggaggcagccaggcaaatgagagaaggtgctcttatgagaccctctcctcttatcggggcagaaaacatcctttctaagggtcccccggccaatttcccgtgatgtttcattgaccaatgacatacgttcttccttaacttcaaggaaagctgagaaagtccaaatctggcctttgggcctttacagtgcataaggcagaggggggctggtgattgctgttgggcagtcaagcacaagcaggtctgccctaaccagttagcaatccaacatacagaagaactatttggagtctcaggatgctgctggtttccagcaaggtcctgccacttaaaaggaccaaatcccagtggctctgacagatgagtgtcggcttcgtctttaaaaccttcagatcagaagcacccttagctgctttctaaaccgattctaaaaccaccagaaagttattctttcagctgaatataatcaaccctacattttaagtttattttctattctgtcctcaaagaaggtagtatccagaaagcatccgttattccccaaacctttcacaggcctaaacatagctattcattcagttctggatcctccctcttccagccaacaaacccaggtcctccatccttcccatgtgggtcaacttttccaggctttaaatttcccagggcagtggtttacaccctctcttgtcacttgaaaaaatattaattgaattgcctctctgtagcttccatcaggagtattttcaatttcctcctgtccctgacacagaggcccagcaacagacaaagcacattagtaagattgtgtgctttgtgagatcttggagggcttcttaatccaattacagcactccgaggggattaggaacagagacccatgtgtcagcagctccaggtggtctggccctgggcatcatacagctggagttagtagatcccaccttaggcaaatggaaataaacattagcatggccctgctcccttcctaaggccagcctcacattgtatggctccctccctcgctgctcccctccctctgtggcttcctgcatggcatagttcctctgaagccagcgttccgttcagggagtgtcagcctgggaacataggagaaacactggggccggggaaatgactcttgcagctcttgcttccccactcttcttcctcaccatcttaacagcttcttgttattgataccaacaccaggcctagctccatgggaaatattcaacattcatcctgtccgctgatctttacaacaatcctctgtactaggattttattgaagagacagctgagacttcaggggaggcagtgacttgctggtggtcccagagttatgatgcatcagggccaggacttgactgccacccatctttctatctaataaaaaaatagggaatttaaaaggcagaaatatccaagaatgttagatttttgcacaatcaaaataatagataattgtgttgcacaagtctagtgctagagaaaagcacaagaattacagtcaattcattcattcattcattcattcatgcaatatttatttagagcccactatggtcctgacactgtgctaggtgctgtgtattcactggtgaaagaaatggtctctgtctgcagcctcccaggcagcttatagttataagagcaagaacttttgctgcaaataatgacatccccaggaaagaaggagaggaggagggagggagggaattgtctccttgggaaaaaacaaccagttgtccccagccgaggaaaaggagctgagcggcacaaattggttatttccaagcattttgactgtctcacttgtcagcagatggctggattccccagaaaccccactatcctcctgcttgtgcatacgtctccggctgtggagaatcagatgtcagaccaaactaggccaagattgtgattagtgctggtgtggggtggaaatggcccttgggggactggggtgctctgcatctcactgctgttcagagggcccaccctcagcgtcgtcatggcccagcaagccaaaggctctgtcccctccaggatcctaattgagatgaatagctgtattttccaagcatggcagctccctggccctggtttgaggtttactttaccgaagttgcacattctggcatcacttgggatggacagagatccattattaggatccatagaaagaaggatagaatggtgaattactgctgtgttacaaggattgaaccgacacatcactgtgcagccactcagcactaagagctttgcatctgttaactcttaaaatcctattactgaccctgctgggagttgttctaggtgaagagaggaagtccagttacaaccaggaagcatctccagtgtgtgtatgtgggcacacactctcccatgtgtggcgtgcttagcactgaatacatgtcagccgtaattattatgaaagtgactttatttgcctaaagacactctgacccaacctgccagattccattcccacctcggtgccagctctttccccagcatcaacggtccttatctctgctttcattttcccatgtccactgcaacctctacaactgttgttgcttacttttagttgagtgtaaatcaaatctcttgacttatttagtcttgtccttcttgcaagaatacccattacggcatgggtctgatgggttagctgtttgttccagtaagcattaggaacttgatagaagcagtatgccctcatcttacctaaatgtctccccatgcaccgctgacagagacccactctgggaaatgctgcacccaccacatcatgtgctctcgtggttgggaaagagagtgacagacactcaattggcagcgccattgtattaccaatgtttatcatggagtttctttgacatcctctggtttagtccacacagtggctgggggaggtagatactatcagccccctttgcaaaatcacctagagtggtcctcatcaacgctgcccattgacactggggtaggacaatccaccattgtgtgggactgtcctgggcatggccttgagtctagtattgctgtcccccgcccggcaaatggttgtagagccctcgagtcaattgaaaatgctcccatacattttcacatgccctcagttgggccagggcccagcggcttaactccatgtggctcagactttcaaatccttttccctacatcatactctactagaaaccatgcacccaggctatacttgaagggacatagagaccctttaacttcatggcaagtgagtgagaaacattaaatataaaactttggttttcctgttccatttgatccactgtgatcacagaggcagggttatcttgctataaagctactgaggattgggcgttggagtctcatttaccagagcccccgtgggtgtcgggggtacggagttacaggttccaggcagggaggctttaggcatcaccattgccagggagttgcctaacgatatctcagagggaggctcactaaggttcaagtcactcactgcccagatcactaaggttcaagtcactcagtgtccggatcactaaggctcaagtcatgtgttgtcattcatttcttaatcaaaaacacaaaaacaaaaaaaaaccaacatccatacttaatctcacattttcatgtttcatattctttatcttaaagatagccccccagttacacaggcttagcctccaaagcccagctccatccctgaaggcccactgttgctcgtggaatttcagaggaagttgatgcaaaccacctgccttttgtggctggtgtgcatcctgagacccttctgtctgctttccagccattggactatgaaatttctgccttccacaccctgctgatcaaagtggaaaatgaagacccactcgtacccgacgtctcctacggccccagctccacagccaccgtccacatcactgtcctggatgtcaacgagggcccagtcttctacccagaccccatgatggtgaccaggcaggaggacctctctgtgggcagcgtgctgctgacagtgaatgccacggaccccgactccctgcagcatcaaaccatcaggtgggtgagtggctccggaaccacagacgggaggtgggcaggaatggcttttcctttccagtcgcagaagctggttgtcaggagcagacaccattaaattaaacttgttaacaatctcagcaagtgggaggaaagcgtcatagagaggaggttgtggctgacggctgcagagggccaggctctttggtgaggatgctgctcccacctgattccagcctgggagaagagtagcttcagtgctgtgttcccaaatgaccagccgggtctgctggccctgagcacagtccttgaacggagagagaagggagccactctgggtgacctcctgcatctcagaaacttgcctactttgtcatcagcactgctttatgacaaaggttttgctaactccgtttacagatacaggtattgtggattcgcagattcgtagaggttcggtacttgctcaagcagcccagcttggtggtagaggaatcaggatggaaacaggacactctgcaaagttcatgctccttctagctgctcaatgctcactgactctgagctgccagaaggggaaggagcaaagtcacttcctggtgcttggaaatagaccattgggattggcgttctgcctgatgaggggcaggcaaaaattaataataataatgtcttcagaaatttctgtcttcatttcttaagctctgcccagtgcttagatagaaagcattttcgtaatgagatttaattaaatggtcgctatccacccgtggtgcatctaatgctcacaaataaaagatgccctcgttggtacatggtttcacaataaacttaaatcagcgtgcagatccaaatgcacgcctgtctctgcagaagaaagttattaatgttcctcctccaaaatctaatcttcttctcatatgaggtacaaataatcaagtattggacacacttaaaacgaacatgtgtctgattttcctgatttgaaacacctgaaaatgtgcaacagggactgagtcaaccactttactttagagcaagccggtggagaagaagcagaagttattttccaacaccaaaagtggatttatttttacggctaagctttctgaatgccagatgaactagacaagcgtgtgaaataataccaaatcctataataatgtgaatctgaaatagccattcttttttttcttgttgctatctgacaatggaaacatgcaatttaaacatcaaagagagagtctttcttaagtacttagatgggaaaactcgtagcttaacagactacaaggtagttggacaaaggtaggatgtctccaggtgagcttaagtgtcatcttgtatttctacaattggaggtgaaagcagggaccctggaggcaataaaatgagttaaatcaggttgatgttttggaccctgtgtctctgccattgctgggacaacttgggatgctgccagtcatgaaagagctaatgcaatgggtaggggtggatggaggtgtctgggacccaggactagatgtcctactaagatgggacagacagtgggagaggaaggtcaggctgggttgtttgattaagaccagctctgctgacttgggcaaagaaagaacgtgctggaggaccctatggatactatatacgatggaggaatatctgaagaacccgctcgagatagcacaggagctagggcatccttcaggctctaggtcacaggaacagacagacttgcagttcaggatctcacagtgagaataaaccagctccagctgttttccattctagtgtcactcggcccatggtcacattcccagggcagctctgccttgctggagctggggtcatgcacctccctgctccaggcaccttggctagtgatcaaccgggatgatgttcccagatacacagcacagagggccgctgactgagaaggagggatgaacatcctgtctggcaaatgaagcttactgctgggagtatggaggcagcccataggtgcagtcccagcaaactgagttaggaacaggattccagcctggggagggaggggtgcctgggagagctgagacattaaggaacatccaggccaagatttgagccatggggagcaaaggtcaccttactattaaacagcacaggcagataagggacttcatcctaccgctgtgtgagagaagaaggaggtcagagaaagcaacctagaaatgacttgaggtggcacctgtggggagaagctggaacgcagaaagttctgaggatcttcctgtttctctagccagtgtaatcatcacagctttggccttccatcacaaatgactagtacccaactcacagtgacttatgccaaaaggggtcctgcttacttgcataggtcagcgcacctaatggaaaagtccatgggaacaaaggcctccagcatgatggaattcaggtgctcagaacatattccttctctatatctggctctgctctcccctgggttgtctccatcctcagccatatttgcacatctgtagagggaagagggaagaggcaccagcaaacacctctccttgatcctaccagaggaaagcaacatcttccttcctaatcaatagcccagcccaaggcccaggttgagtcacaagcacaactctctgaaccaagcagaagatgagcaggacagattgtgccacgagtcctggtgcctgagcctgccacagaccccagcacccagctgtgagggcctgcaggggcggctacccgaggaagtgcgggaggctagtcccagaggatgggaacaaatgctgtgtaatcaggaaccacagagagcccctggcccaaaggtgaaccttgtgaaccccacagaaaatagagctgcagtgtgtctctgcagctggtctaagagttctagcatttacagattggcctagctgagtgatggcaggaccaatccctttcccagccgtggagcaaagtaaatgtgtgtgtgcatgtgcatatgtgtgtgctgcacacatttctctctctggcctcactcctcaggcatattccttcctgctgggagccacagcggcccacacgtgactctttctcagcctggcactggctggacaccccctttcccctcctccgttcttctccccttcactccctcctacccacctttccctcctttctctttcttcccctccacccctctcctctcctggagtaaagtcgggataacatcaccgacaggttgagctattgtcatgggagctctttgggaaaaagaggctcattaattatttgcagcctttgatcctgcacactgagaagtgctctcccttggggcctgtgtgtgcagaggaggagtggggctgcagagaggggccaggatgggagacacttttctaatctaatcatctgcgctgggctaccccggcttctcagacagatgcaacggccttccaagttgtgatgttactgctgttgtgatgattcttcagggagcaggcactggaagaagaaacttagctggaaaagaactcttccttcttctcctcctcctcctccacaaaacaggaatcaggtgtctcctgataacattttagtatctctaatatctttttcttcttcttccttgtgttgactgctgatgtgatacctctgttcttgtcttcttagtttaaaagaatttaaacaagagacacacaccaaaagaagtgcagcatagagtaatctactgcaacagaaaaagaatatgttgaaagttaggtgcagaatagcagtatcctctgagagagatgattccgggcaggctgctcacaacaatgaggcagcaaagacccacaccagggaggctcccttctgggagtcttccatgattattcataaggaggtgggaagaggcgttactaggaagctgttctgggtggtcttccgggtgcacatgtgcagcagctgtacaaggtcgttcataagtcgcatgtctctttagcatctaaaatctccacccagggctgtgtttttcacaattatgatgagcagagtcagtttgaggacaggtaaaattaaaatgtgcatgttctgtagaggggaaagtcgccactgaagacagctttgcttgaatgagctcactgactgtgcgcatcctgagattgactgtgttggctgtgcggtcaccacagttgctgctgtgtcccgagaacacggtcacttccttaactacctatccggcctcactcctcctccttcctctgtctctttgcctgtctgtctctctgctgctctgtctctttttctctccccaccccaccatctctgtcttttctgacattccctgtgactcagctccaacaaccccatctcatgtcacattagtcaccaggccctcgaaactaaaagcccccatgagagaccgggaccctgagatcctgcagcagggcctgcccatcctaatggccactgtcacctcctccctgagggggctccttccatggtcaacatgggaagccttctccccaaccccaaccccactgaaacttaggaacgcacttccagctaagtccaactcctgggccacgtcctgcctcgcatgaggaaatgcacttctcaggcaccactgctcctcggctgaccgcggccagacaccctttcatctccccagggaatgctcaagtcagcaaagggcgccttgatctccaaggaacctgtgactacaaagacaaggggtgtccaaacatcagagggaatcttctcactaaaaagcctgggttattaagacttgttaaaaagcccttcacattgtgttgttagtcaaatcaaaatgaacagcagtggtctagtgacagatgaaattcttctttttaatgacttttatcttcttatccttattataaagttaagatagtttctggaagaaacttttgaaaagacaggtaagaataaggaagataataaagtatctgtcatcatctcagacaaggaaatcccttttccacagcttggatctgtctccctcaatcacgtatgtgagtattctgtttttcattaccaaaattggcttgcattatccaccctcaaacctcaccatttttatttcccagtatacgctgaacagctttctgtcccaagaaatagccattatttttcgtcgctgaatagtgtgctattattccattacagggatatactcatctgtttatttattcccttgttgttgactatttacattgtttacacttgtttgcagttttttaaaacattagtgggtatgcttatagtgaaattgtttaatgcatcattaatatcctgaagacaagtccctgaaaatactttggttgagcaaaagtattactgtgtattgttaatgttttttggcatatacagaattctttgtttttatgtctaggcagtcaaatttatattttccatcatttctaaattgatgtcacagtttagaaagtccttctcctctccaagatcatgtacatcaggttctaaaacagatcaggttcccactctgtcgtctccaggtgagatgatgataagacttgcttccactttcagcgtagcaaccgttcctccaggtgcacaaggtaaaatatcctgatgatattcgagtatctctaatgaggagaggacttatgtaactgaacttgttagaaagagtaacccaggctgggcacagtggctcacacctgtaatcccaatattttgggatgctgaggcaggtggatcacttgagatcaggagttcgagaccagcctggccaacatgacgaaacgccatctctactaaaaatacaaaaattagctgggcatggtggtgtacccctgtaatcccaggtacttgggaggctgaggcaggagaatttcttgaacctgttaaacctgggaggcagaagttacagtgagcagagatggtgcaactgcactccagtgtgagcaataaagcgtgactccatcacaaaaaaaaaaagtagccgaaagataattatgcaaaatggaagtaactacatttgctaaaccttctcctacagtgaaatgaaacatgggaactaacgcttccatcagatccctgatttggttacattagggaggcagccggcagctaaatccttctgaatagctgggaggactcacttctttctctctacaatcaagggcaaccaagtagcaattcctattccaaacatttttcagacagaactcatcttgcccaggatctatagtaaacaattccacagcagagacttctgcctacactttgaatatagaagatatgtgttgaagaaaaatattgttcctacccatgtaaaatttcatatcactgctcaacacttttttttggaaagggtcattcatccagggagccctgcgagtatatgtcaagcattttatctgtggggactaagtttggctgaacataacaggaaaattcaaaatgacagtggctcagagcagacggaagttgattttttttttctcacataaagtaggtctagagcaggcatgacagttcagggacagtggcagccccacacggccccacacagggttctacttgctcactattttaccacgtctaggctggcaccctcttcctcatggtctgttatggttgctagtgctccaaccttcatatctgcattccagacagcaggatgggaaatggagaaagaagagggatactccctctcttttaaggagactttctggaagtcatccacatttttatttaaattttattggccaaaattggtcacagggccatacctagctgcaagggattatgggaagtatggtcatttgactgggaagcaatgtgcattgttttttaaaccaaggttcttcactaaggaagaaaggaagaatggatagtgtaaggtagatggcactttctgccatgaatgcctttttaaatggaacctttctgcttaataaataactacagggtacattttaaaagggaaaaatatcccatgatactagatatttgcataatcaaaataatagatgatgttgctaaagactagtgctagagaagagcatatggattacagcaattcattcattcatgccatggtatttatgtagagcccactgtgggcctgacgctgtgctaggtgctgtaaattcactggtgaaagaaatagtctctgtctgcagcctcccagggagcttatcgtcataagagcaagaacttttgctgcaaatgatggtgtccctataaaggaagaaagaaagggagagaggaagggaagaaggaatgaaataaattgcttccttgggaactaagaaccaatgatcccaagtcgagaagaaggagcagagtggcacaaattgcttcttcccctgcaccatgcccggctgactttcagcagatggctggattccgccagaaaccctgctttcgtcctgcctgtgcacaggcctctgcctctagggaatagggtgccagaccaaactaggccaagattttcacaacgccctgcagacatgggttttgagaatgatggtaataatatggctactaggatgattaaaatacctaacatttttatgtagaactttaccaaaagcactgttaccagtcttcttgtattttcataaccaccctgtaaatgagaacatcttgttctccctttttactgatgaggagagagaacctccctgagccgtggttaaaggaggaaagcacacaagcagggtttacagaggctgagttaatgtgaatcagaacgccggagcttcctccgtaccactgcgcctactgctgatgttggcttaaggctttttgaacatgtcttagtgtaacttcaccaagcttcacacttcctcaatccttgacatcattgtccatcttcccacgagactttgtgctcagggagagtaacaatcatctttatctccttccctaatgagccaccagagcttcctcagtaccattgagttagttaagcactttaggcacaggactaagaccttcagactttccacgggcctacaaaaatgtcagggacctgaatacatagtctattgactccaaaattcaaaaagaaagcagcaaaattgaaattaataaatatcaactgcccacggcatcatgacaactttagcaggctaaacctaatatttgcaaaagtgtctttacatttgcaaactatttgtagctctcaccttgcaagaacggtggataaattataagtgattattagcagaatatttcttatggcacagtaattccaaaagcaaaagtataaaaataatttcaaacatgtgataggaaaaaaatgtatttttagtgtgggtacattttagtacatttgatacagtttggggtgaggccaccaaagacagagaaaaatttttaagggctcaaatgtctggaaacagcccaatcccagcataaggactggtgcatgaccagtgctcagtaaccaggtggaatagattaatggcagctgggttgggggtgactgcatgcacacatttttctgcattaagtagacatgggttgaccgaatgcggtggctcatgctttgtaatcccagcacttcgggaggccaaggtgggcagatcatttgaggttaggaattcaagaacagcctgaccaacatggtgaaaccccatctgtactaaaaatacaaaaaaagttagccaggcatggtggtgcttgcctgtagtcccagctactagggaggctgaggcaggagaatcacttgaacctgggaggtggaggttgcagtgagccaagatcgtgccactgccctccaacctgggtgacagagtgagacttcgtctagaaaaaaaaaatgtagacatagcttgcattagtccattctcaaattgctacacagaaatgcctgagactgggtaatttataaagaaaatgatttaattgtctcatggctctgcaggctatataggaagcatggcagcatccactcagcttttggggaggcctcaggaaacttaaaatcgtggcagaagacaaacagggagccagcacttcacatgtccagagtagctgggccgaggtgctacacacttttaaacaaccagatcacgcaagaactcactatcccgaagacgccaccaaggagggattgcgttaactcccctgatcccatcgcctcccaccaggctccaacattggagattatatttcagtatgagatttgggtgaggccacaaatccaaaccacatcataggttttgttttcttttaatcttcaaacattgactaatgtctaccaaccatgaaaacatttacatttggccttgttttaaaccaatcccaggaagggtagccagtgctagcagggagactttagaaggatgtgcaggtctctcacagaactttccaagtccatgaaagttacattgaagagccattgccgtcagccaacccttcttccgaagccttgatccaaattgagcctattctttgaacacagaatatctgaatcagatccaaattagatactcatctctttgaaaactacaactgctttgtcctgatttctttggggctctgtcttttttaagtcgtttccttcctcctcatctttctgacctggatgctttttaactttacagtagaattcattcatgcattcaaactggtaaagaatacaacatagaataatgatatttcagccccaaaagatttgttaaaatgcccaatttccatttttactggtcttcccatgattcatcaagtccttttctttaacaccttgtttaatctaatattggagctcattcaaaggaaatcacaaaaaatgttgggaaattaagcaaaaaccatcattgactggcgatgggacattttattctgtatcttctaagacctttggaagaaaaaggcaaaaatcagctctcttgaaaatgcaaattttgtcatcactggcattctcagaaacacaggggttcaaaaatatgtagtagcctaccatttattgggaggaaggaggatttctaatcccaaaaccaggtttcaaaaccagatttaagagtttaaattggggtgactcccaccttttaaattttaatcagaagttaaaggccaaattgtaacatttctacctggggaaattaagagaaggccttcatcttctaaactatattattaacacttcatcttaattaaatgtggttactgacctcaataacaggatctgggatgaggtcatttttttggttcttgtttttaatgagttaagatttttttcttttttaagtcaacaaacacagagtttgaaatgtaaatggattgtttacagtggtgtctttgtaatttttaattaaagcggtgttgttccattgtaagtttatggtagcaatacattttattgcctattctgctgtggaatttttaattatttatgcaaatatattagcacagatgactcttgtttttagtggtcagatgttctgttatgaagatgctgggggaaacaaagcctcacaaattaaactatgggatttttaaagttttaagggcttcactggctaaaaatagaatcctggcttttataatgatccagagactgaagattttcattattcatgtcaattaaaggtgctcagtttggctaatatgaaacatctggccgtttgggtaaatggatgaaaggctattttacaaatcgaccacctttttaacatccatctacatatgttgttataaatttgccataggccagactttcattattgaaaacatggtttcaaattggctatatttgaatataattatcagggtccttcttgtcagccttagaaattaatcctcagaaccaatatagaaaatattgacaaatgttaatattgttccttgaccaatattttctaagctgttaaatctacttagctttttttttaataaacccatttgaaatagataaggattgctatataagctactaacatagcactgattgaaaaagccacacatttcaggattgcaacagaagtcagttgcatagggaaaatagctgatttattatctgagtttgtctatcaatcactaacaccagtcagccagcaagcacgaggagcttatcatggcattaaccctaacacgggtaatgaaaccacaggcagtgagtcatgtaactaattcaagaaatgcatttcatcatctgctcccaatctgctttccaaatgaatctcaaagcttgtattttcaagtgatgaggctctaaactacagtcctcctacaaatgcttaatttggggatttcctcatgcattccaatagcgttggcaggaatctcactagaagatccgaccttatatggctgcttctaagtattcttgggtccctgagtgtaggctgcacatgtgaaaggaggacctggggatttggattagggctatgaccggaaaacctctctctccattcattcatcccacacctgcaacatactgggtgcttttctaggcattgggggataaagtagccccagaaacaattaaaaatatctgttggccgggagcagtggctcacaccggcaatcccagcactttgggaggccaaggtgggtggatcacctgaggtcaggaatttgagaccagcctgaccaacatggtgaaaccccatctctactaaaaatacaaaattagccgggcgcctgtaatcccagctacttgggaggctgaggcagaagaaccacttgaacccgggaggcggagatggtggtgagccaagatcacgccactgcactccagcctaggcaacaagagcaaaaactccgtctcaaaaaaaagaaaaagaaatctgttatcatcgaaatcatattcctgtggaagagagaaaatgaatgagagaattaataaatacaataagtagcatagtaactggtgattaatgcaaagaaaggaagcagagaaggaaggaggggagccatcactctagatagagggtcagcagaagcctcaccagtgctgtgatgcttcagtgaagaattggaggaagtggaggtgagccacacagctatcccgggtggagaggtccaggtagaggaagcaagtgggaaggccccgaggcagagtgtgcaggattgtgcccagcgcacagcaagttgggggatggtgggaaatgaggccgatgctccggagaagatggggaaagtgttaagcatgctagtgggattaggaaagggggcaattaagggaaagggagacagaggcagagcagaggactggagtgtagggtagccatagtaatccaggtaagaggccatatgggtctgggcagggatggttgcagtgcaggcagtgagaagctgcagacactgaatttgttgttgttgtttttatttttgagacagagtctggctatgtctttctggctggagtacagtgccacgattttggctcactgctacctctgcctcccaggtgccagtgattctcgtgactcagcctctggagtagctgggattacaggcatgcaccaccacacccagctaatttttgtatttttaataaagatggggcttcaccatgttgtccaggctggtctggaactcctggcctcaagtgatccacctgcctcggcctcccaaagtgctgggataacaggtgtgaaccactgggccaggccctgaatgttttgaaggtactggtgacagggatttgctaaccaactgtgccgtgtgtgtgtgtgtgtgtgtgtgtgtgtgtgtgtgtgtgtgtgtgtgtcagagagagagagagaggaataaagattgactccaagatttttgtcccaaacaaatggaagcacagagggcacatctctgagctttgcaagctcgctggagaagtggcaaagtaacttgtgggaggaaagtacaggaattcggtcttgttcttgttgagtttgaggtagacaaagggagcacatgagctgggtatcagggggcgtttgtgctacagatagaagcctgggtgtcatcaacatccagatggaatttaaatccttgagactatgatccccaaagagggaagtgaacgtagggctgtggccaagccctgggacactctcatattgggaggagtggccctgcctggtgctgtttcacatgaggcactgcttcctgagaatccccttacagccttgcaaagaaaagtacatagccagccaggtgcggtggctcacacccacctggcactttgggaggccagggcaggtgggtcacaaggtcaggagttcaagaccagcacagttccgtacaacggtgctgttaacttggcagcccgaccgcaaatcagcatatcctgagtctatgcaggccccagggtagagtgtacattgtccccaggagtcgaacggacctgggccatcctgcctccttccatctcctgtcttctttcactagcatgtctgatccacttccctaacacagccaggctaggttggccgctttctgctatagctacaccaaattgctcaaggttacgatatagtagctggcatttactttgtcccaggcactgttccctgagccttctgcattagatcacccctcatttcacagcaaccctgtgggtctctgattaccccttttatacaggggaagacaataaggattaggaagattcaggaaattacccaaagaaattcacactcagattcacactcaggaaatgtgactcaatgacagccgtcgtcacctctctgctcttctgcctcccaaaccaaactgaagccagagaagcgtgccctgtgtgtgcaattaccagacccaatagcttgctctctccaacttctgtttttcagaataaaattgtttgttccatttctgattttagttgatggatttatgacagctttcattgctgatagccacagcaaaaatcattgctgccagatgcctgtaagagcatggggagggagtctggccagatctccatggactcaaggttgctccctggactcaaggttgcaggaggtccctagggatgcattcttcccggcttgctctttccatagcacagaggctcttcctgccatcatctgatgacagggatggctttgcctgctggacatccacctgttgcacgggttgatgatgcgaaatgtttttacagactccgtctgtcccggtttctttccatttaactctttcatgcccacttccctgtgcattctattcctgtgattgccttaaggagaacaaggatctgtcataaacttccttattttgccaaacttactataggcaaatagagactttcggacttgaaggatgtgttttccttatggaagcaaaggaaactgaccttgactctttttatttcatcctagattcaggctgtctctagaaactaccccagagcagctgcatgggaaatggcagacccctggtctcttacagccttgcaaagaaaagcacatagccggctgggcacggtggcttacacctgtaatcctagcactttgggaggccgaggcaggtggatcacgaggtcaggagttcaagaccaacctggccaatatggtgaaaccccgcctctactaaaaaatacaaaaattagccaggcatggcggcatgcacctgtaatcccagctactcaggaggctgaggcaagagaatcacttgaacctgggaggcagaggttgtggtgagctgagactgcaccactacactccagcctgggtaaccgagtgagactccatctcgaagaaaaaaagaaaagaaaagtacatagccaagtggccacaactgccagactagtgccagacttcctgagcacaaatccccacttgtccatcttccagaagtgtaaccttgggcagatttttaatctctctgggcctcagtgtccccacctgaaacatggggaggaatagtaatatctagattatggagtcactgtgatggatacagaataaaagaattcagggaaagtgtttagaacacagtgcacggtacatagcattaaattaactgattcgcatttttagcaaaatgagcataatgcgtagtcatttactaaaggtgtctctttgagactgataggggtgtttttctagaatatttggttttcatgccttgtggattagtttatttttattttccacaagccagccccgggtacctcactgcttaaatctcatgataacagtctcttcctcattcctggtaaaatccaagggagcagataggagtttctaaatattaagttttgccatctgctgtttgcttgcctgtaagcaagcactcagagatgacagtgccagtgaatgaatggcgaactgctattaaatgtaggagttgaacaactgatttatgaacgtttgcagcttggccctttggtggaggtaggcttgattttgcaatttttctagagcacacatataactagtcatattttctgctagtaaaactgttcctagtttgggcattgggattaaatttatcagtattttaagatgctctgcaaagtacctcacactatgcaaataacaccatgagttgtagatactctgtcacccaaacaagtttaggatctggttgaatgtttgaagtgaaatgaatcagaggagactgttcctgtgagcaaaagaggacgtgacaattcagaacctctaatcatacctagtccactatctgtcaggattcatggtcacaagcaacagaaaccagcatgggctatgttaggtggaataaaacaagaacagacagggttgacattaggcatcacagaatggatagaaaaccagaagacagactggaaaaaatgagtagccgccagatagaactcaaggggagggaaggagggattagggaccaccacaaagagaacagctgagttctcatgttaggcttcccatgcaatgaacatgacctgtgttcacccccacatcactcatgcaagagcatccagtttgctggagttgtctcatgtcccatatctactcctgctgcagtgggagagaatgggagtgggttactacctcccaccaacactgcacaaaacagggttttctccaaaagaggggttgggatgctatgagggatgataaaggatggggagcagtcaggaatgagaaacatccactccaaaacccttccacaagtgtgagtcttccacagtgctcgtgatgacctccacagcagacttgctgttatgactgtccccagctgccctctgtgaggatgggtgcttatgaggtgagaggtaaacatttgcatattcagttcccacactaaagagtgtctctgtcacaaagcaggaacaggtgacatgggccagcaaccaggtaaatctctgcagggcatgaagagccaagaatgctacagaacagggctgtggcttgcagagggcagggtgtggctctgggcagaccatcagggcaagagaaggcactctgccccaatacctccctttgggctggactagggagagtcaagccaggccctcatcttggtcataagctttaaggggataccgaaaaactcaatcatccagatagatgttttaatgcagtattttaaaaatcaaaactaatgcaaaaattagccaggcacggtggttcacgcctataatcccagcatttaggaaggctgaggtgggcagatcacttgagatcaggagttcgagaccagcccggccaacatgatgaaaccccgtctctattaaaaatacaaaaattagccaggtgtggtggcgcgtgcccatagtcccagctattcaggaggctaaggcaggagaatcgcttgaatccgggaggtggagattgcagtgagccaagatcatgccactgtactccagcctgggcaacagactgagactctgtttcaaaaaaaaattattgcaaaaattcataataagcaaaataccagctttttaagtaaagcaggatcattgttactgatttttcattttgtgtccagctcacatatgactcagcatggcgctgctgtgcgcaagctccttttcctctttgggcccatttcttcttctgtaaacttaaataggatcgcaaatgctgtgactctgtggatccctggatcaagagtagaaatgagttcaacctgcgtggcagatgctctgggccaagcctgtgcctacaacctggtggactaggcgaaagcaggtgccctttctgcaacagacagttagcaatgttgagtaaactgtgaccctttcacccatggaaacccacagctaggctccaaagaaaaagaagataaatctctgaatttaacaaataactagaatataaaatagttatgtttaaaatgattaggggaaaagaataggggccaggaagaaaggataaaacataatgaaatagaaaaggcagatgtgaacagtaactaaatagaaagtctagaaatctgatagagcattatctcattaatacttcggacacaactgtgagatgggtgtgatcatccctgttctatagatgaggaagggaggtcgaacctttcgtgagtgaaagagacggaattcaaatccagatatatttatgccaaagaacttttttttttttttttgagactgggtctgtctgtcacccaggatggcctgcagtggtgcagtctcggctccctacaacctctgcctcctgggctcaagggatcctcccacctcagcctcctgaatagctgggatcacaggcatgcaccaccatgcccagctaatttttctatttgtttgtagagatggggtttcgccatgttgcccaggtggttctcaaactcctgggctcaagcaatccactcgcttctgcctcccacagtgctgggattacagacgtgagccaccacaactggcctcaaggaacttctcaacagggaaacatttctttcctttgttttgcaagagaaaacactatttttttaaaaagtcatgctcagtagagtgtgcaggttcgttaaacacctgtgatatctttttataattctgtgtaagatggggtcttcatgtgcagcgggcccatttcatctctgttccccattcattcatgttctttgtgtctggggcttcttttgaaatctgtaaaggtgggaggaccagggaatccaatagagtgagcacatgaagagacgtccttcaagcccacactggatccacctggaactcccaccagggagttcactgggagtggggacttggcagctgccagggagaattcttaggcaagtggttactgtttgatgcttcaccctaaagttataaagatgcaacattttacagctcaacaagtaaacatttcccaaatacttaaaacatagattacctagtcactggtaaaacacagcaactggccttcatctccaaaatatatctagaatctccgcagttcttgcaactgcactacataaactttgtctaagccaccaccatcgttcacccagatgacaataattgccctaacttgtctcccattcttacaaggcaccatccacatcgcggtgatcctcttaaactgaagctcagatcccgtctctcccctgatgaagcccttcagtgcctcccatttcacactgaagtaaaacccagaccccctgccctggcccaggaagcccctggctggcctcggtgctgagcttcctctcctctcgctcctctggcagtctctcctccaaccacacggcctttcttcctcaaacttctttcccattcaggaactgtgcaaacatcattccctctgccttgaattccagtcgatccttattattcacaaattccatatttgtgagctcacccactcaataaaatgtatttgtcaccccaacattaatactcatggcgctttcatggttattcttggaggagtgcagaacagggaaaaatttgagttcacctgacgtgcacattcacagttgagctcaaacaaggccttcttttgctttgccttcttatttcagctctcatagtacaaataagtgccctttttgtgatctgtttagtgccgtgatttttatttttgcacgttttgttcgcaattttgctgtttgaaatggcgttgagcacagtgcggaagtgctgtccagcgtctctgggcacagaaggctgcgccatgccttacagaagaaacaggtgttaggataaccttccttcaggcatgagttacagctctgctgaccgtgagtgcaatgttagtgatcaactgtatacgttaaggaaggtgtgtttaagcagaagtgcacataagataaggccgtgtattgatgagttgacaaaaatgttgtgaccagaggcttgaggaaacctaaccgtgtattcttcccgagagcaatggtttttgagacagagtctcactctgtcacccaggctggagtgcagtggtgcaatctcggctcacttcaacctccacctcccacgttcaagcaattctcctgcctcagcctcctgagtagctgggattacaggcatgcgccaccatgcctggctaattttgtgtttttagtagagatggagtttcaccatgttggccaggctgatctcaaactcctggcctcaagtggtctgccccgcctcggcctcccaaattgctgggattacaggcgtgagccactgcacccagcctacagtagttttataggacatagctatggtgagtaacaaagatcaagtgtgcttgcttgcctgaacattcactacctgtctccccacactaaactgtaaaccccttgagggcacggaccatgttggtcttcaagtgggcctggcaaataataggcactcaatacatgtttgttagttaacgaatgaattgcaaataaattatttccaaagacagtttttaaccaggctgtactgtacaggactgtagtgtgtcctgttcaggagttaatatttaatatgtctttgcaaaggataacaaaggatttccatcagggactgactttaatataaagagtgcaaatgaatgctaattaaatatcttcacttaattattatttgatgcacttccttggtttgggcctcccctttgggcttaaaaagatacaagaaactgcttctgtttctttactttctcccagtgtcactgactaggcaccgttggctttgatgaacctccctgaggccaccatggggagatggtgttgcctggttcccagtgctgaggctctcaagacactgctttcttggaaagttgatgcggccaggagcatctgttttgtgcttcctcctgggcagacaggggctgctcttggaagtccattctgcttcttgctaactcacacaggcggtatgaggaggatgcttagccctaactgatcttatgatctagcctggaacactgagagctgggtttgctaacaagccgggtcagtaaccccaaccttcttacttcagtccagcgtcttgccctgtattgtcttctgttagagcacggttggcaagtttcttctataaagggccagatgataaacaatataggttttatggaccacacaatctgtgtctcagctactcaactcgaccatcgtaatccaaaagctgccacatctgtgaataggcatggctgtgttccaatagaactgtgttgacacagggagtcagagggccagatttggcccatgggccatagtttgccaacccccatggtacacccctaccagcattatggtatcttcatttgtgtgtgttctactctgtgctgcgagctctttaggggaaggcctgaatctcatccagtggtttcctctcaacatcttgtgtagtgcctgccccgtgacaagccctcggccaatgtttgctaaatgcatgacttataagacatggcccccaaagcacgggcattgtgaaacatgctaaccagatgaaaggtgacctaagccccagtggcagcccattcatcatcattctgcctcctgttgccaatattcaaaatagcaccagttgtttttctgtcaacaaatcaaaataatattcctgcatttgttcaacaaacagccactgagtgtgggagcagcatccagatgtcagctgggatctgcctgcctttgagaactaaataaatatgtgataagttgataagtcctgactgcatgccccgtagcagcccagaggcttcccaagatttctgcaaattccagaggattggagaaggaagccttgactttccagaggtcacatctggcttcaagcttccacttctgcaagctagttccatttcttagctgtctcaatctcctgcctgtgccagcctgtggcatcccatgtcgcccttctccccagtcctcccttggcacacatatgcacacacacgtgtatgtgcacacgcacatacacacacactcactgtcatcagaattggttgcatgtgatctaactcactgaggatgtttagaggcatggaaagggcagttacatcacatcacatcaaacaacttcaacctgagaccctggaaagccctcgattttccatccttctcagcatcccatccgtctgtatttctcacaaggcacatcatcccagcatgtacccagcctcagcacatattgggactcttctctccaatttctccctctcctctgcactttctctttttaaacagctccatggagatgtgattgacatgcaaaagtgcacaagttgatgagttctgacatatgtgcactcccttgacgctatcaccgtgatctagatcgtgcatgtgtctagcatcctcagaaacgtcctggactcctttggcatcctcctttctgcccctcctttcctttacctcagccccaggcaaccactgatctgccttctgtcattgtagattagtgtacattttgtagagcttcatataaattgaatcataaagtatgccctcttttttgtctggctccttctgctcagcacaattattgtgggattcatccgtgttgtcacctgtgtcaccagttacacagagacaaagaccttctgcagaaagattcaattctatgcagtccccacctcgaaagaacttcagattcccttttaacagacggaaacatgccagaagaccaaaagggctctctgtctttagaaacccatggttgttaaatagccatttttctcccgattaaaaatagctatttttcagttgcctcagcagctgcttaataagcacctactatgtgccaggcactgttgttagggacagagtgggaatcaggaaaacatggccttcctcttggggaatgatcagagaatgggcaggtgaactgctaaaaagttgcaacaggtgtacatatatttcttttgtttacaggttttgggaatgcaatcccatatttcctttttttacacattgaagtacttttttatgagcaatgcatgctcgtcacaaaaaaattaacaaacatggagcagcataaagaagtaaattaaaaatcacctttaatcccactgcccagatatggccaccattatatttcattttgttaattccacaggcgaggagtagaggaatatgttttgtttcattttgtgtaattaaacgggccacgggaactactatcagcttcctggggagctgagttgtgtttattttttttaagagctactaatttttgattaacaaggatgaatgtaatgtttaagaggaatctatttacaccctcttccccttctcaataaaacaacattcttccccaccaagtgtggagtcgagactctgaggatgtatggccctgagctgggggattctagggacatttttcatgtcactacctagacagtcgtgtgagtgctccagcagtgagggatctcggctgcaggttacattccttgccgaagccagggctggatgataattcactttgtcattacttaattctgtgatggctgaaacgactgagccagaataaaactctcagtccctgaaaagatgagagactcagtgtcaggatgtttaggaacagaaaaagcaagagggcagccgaatggggccatcgggtggctgcataaagaagtctgatgatggatgcagcgctcccaattcatttcttttctaaatgacatatttgtatgtttccttcatcatttcattcggtccacacgtatccatgcggtgcactctgtgtgccagtcatagaggccacatccggtcgtaggccgtaccccatgcacagctgtcctcttggcacagttgactgaacatgctttcgccgtgtgggagactgaagctatatctgtttgagctacaactaaaaccctggagtctctgcatgcctttgccaacatctggtggttccccaaatgtgtcaggttcttctctgcctctgtgctagggtttctaccctgaccgccacccaacaacccctgcgcccttatcctctcttcttcctcaggacgttactacgatccagccccacttcagcaccacggtcagcacccaccaattgcccagcactcctgctactgggttgctaggtatttcgcacatcagcccttctctgtgcctctgcccagtttgcttcctctgccctctctccctccaaataacagctgcctggctaatgtctgcgtatttgctggcagcagagtaacactgaggttgatgtccagctctgccattgagggttgtgggactttgggtaagttacttaacctctccagacctcattctctccaggtgtaaagggagataatacctagaggattaaataggctaatctagcaaagctcttagcacagtgtctggaacatagaaagaacccaatacatattaactattattgtaatctgtcaagaatcatcccaaatataccttgtgctaagaacctttcctcatcatttccttggggtgtaatacaaaaatctgacgtattccagaggcttggataccctccttggtactcacttggcatagcttccatcacactgtattttgtaattgctcatgagtgtgctagttaggataagtaataatagcttctgtgatagataacccctcaaatctcaatggcttaacacaaaactacattgctcactcctattacagtcgaactgcagatggtggggtgggatggctctgctccataacgttcagagatccttggcaccttccatttcatgaggctgcctcttcaaggtgtagcctccagggttgctgtggaagggaaagagagagcaaggagggtcttgcagggggtttgcagccaggcccagaagtgacattatcacatctaccaactttgctctatcctaatctagctgcattagaaactgagaagttcagcccgcctgtatgttcaaaaagaagataaaattatctctgaccacaggagtgcttctcatctccccaccaggccatgagatgctcaaggtcggtggccatgtgccttgggtctcttatccagtgttagctcccttctgcattccctggtcacctccagagctgagcaggtggcactgtggggaggggctttccaagcacagatgataggagatgcaaaggtacagagggtctgggagaaaactggccgcttcagggaaccacaagccacagcaacatttgcttgggctgcacacatattactgcataaaaatagctcgttaccaccttagcataggatgcatgtggaggtggggcagggatgagccagggcagcccaggagagcagagcttacagtcctctgggtagaggccagcatttctgatcctgtctgcctctgctatggagcctatgtttccttggttccaatggcaaggctaacaagagcgttcctccttgggtcatgtatctctttgaatagagctgcatccctaagccaaggaaacatattgtattgagtagtgctttaaagaacaggcaaggaatggaaattggcataaactttctaaaagacacgctgcagtatgtattaacttttttccaacagtcacactcttccatacccgtaatttcattcctaggaatatatctcgaaataatcagaaatggtgtcaaaaatgtatacactcaggaaacagatttatgtgcggagttgtacactgaagccttatttatggtagcaaaaagttagaaaacagccccagtgtccaacaataggaggctggataaatatattacagagttgccatatgatggaataatatgcagtgattaaaatttttgaagccaggagaaattgtttctgatataaactgaagtgacaaaagtgggacatccaagttggtaaacggtacgattccaattatacaaatcacacgtggagaagactttgaataaaatgtctaaggataggagcgggctttcaggctcctggaattatttggtgatttttcatgttttcttcacactgtcttgtattatcaagttgttaatgttgaacacatacattacttttataaacagaaaagtactttttaagaaacaaggggcaaggagactaagaaaaccatcctttcttggcagactccctcagaggtactatgtttcttttctacagttctctcaggactcaaatgcttgcctagaccaacatgcctctgactccataataggcacgaactcgcaattactccctggtacacaaccttttcagccaccgtaacatccattcaactgcacaaaatatgtcatctaaaacctcatccagataaccctgcacattgcacttttttatatatggagaaatgaaaaaggctttttgctttgtaagttccataaagacatttcttggcatctagaaaatgacaagaacccttcaacccagacttcacctcacacccatccctaactttggttacagttcaaaagtgttcatggaagtttgaaaagtggtttcccttttcacctgaagctgtgatttccagtgtggtctggaggagaaaactgcctcgaaggaagctaagggatagaaaggtgttttcaatgtcttctcttaggtggggttttcattcagtcaggttaggttgttaaggcaagagagataatgaacaaaaataacaatcttaccctcaaagatacaataaaatgcactcatgttctcatttcgatgccagaatatgaacaccgagatggttctccaactcccatgcaccaagccccttacaagcttagactcgggtcaggtcctagaaaagaaagtttagggtgtttagggaaatgtttgcagtgtacccagtgagtggatttaaccaaatctgtatctcagagcaggcaccactcccatatcccaccaggaagccattgtgagatatagtctgcccacagccccgctgccacaggctccaatgccagggaaagctgtgtctccccatcagtgcaattctaagaattaagtactccttccttgccaattacatggtcactatccttagaattgaatttaagctctgatagaaaattgttgaaagccttcagtgctcatttttcaccaaactgaactctataatggtactacaatagaaaaaaaatttccaaagttcaattggaattttttcccagtaacttaataataaggctccaatttcaggaaaatagtttcagcatgagtgaaatcacactgtttgttatgcagcatcaaagctgtcctccaacacagggcagaggccagtgctccctggagttgaactccaacaatcatttaaaaacttttgtttccaatcatttagaaacttgtagatttttctggcaacatccaagaataagttatctcacttagatgagttttctgtgaaactgaagctcaccacttcaagtgctatatctttctatatattgacttcatttctaaaacataggtttccccgattcttaaatagagtatgggaaaggaatttaaggtcatttgaggtaatcattcttataggttaataagtgaaccaagacaatgctttacctgattttgagttttttctgtcttttatgctttcatacaaaatgtcatgctctaatcactaaacctgactccagaaatccacctggaaaacaaagtagacaaccaagctttttgagaattttgacttttttaaaaaaagaaaaagaagcccgggcccggtggctcacgcctgtaatcctagcactttgggaggctgaggcgggcagatcacgaggtcaggagatggagaccatcctggctaacacggtgaaatcctgtctctactaaaaatacaaaaaattagccgggcatgatggtgggcgcctgtagtcccagctactcgggaggctgaggcaggagaatggcgtgaacccgggaggcggagcttgcagtgagccgagatcacgccactgcactccagcgtgggggccagagggagactccgtctcaaaagaaaagaaaaagaatgatattagcaggaagagagaattaagctttattgagcaactactaagtgccaggcatttttctgtgcattttatcatttcatccttcaaacaaccctaaagctgaccttactgtcaagcattcaccattcattctacatctgactctcaggagaagaggagggaatgttgggtcaagtgatccccagggttccttcaagcaccaacaatctctatgtctcccatcctaacttaaattttataaaacaaaggatttgtttaggtgggagagtagataagtctgccctagggctggttgcctctttcagcccccattcatgcataacaaatcacacacaaacttagtgactggaaacaacatcgttttcgtgtctctgtggttttaatggctcaggaatgtgagcagggcacactgggagcagcctatctctgtgcctcaatgtctgaggccttagctggaatccccaaggcctgggagctgatgtcatctgaatgcttattcagttgtttatctggcaattgttgattgctgtcagccagaacatctacttgtggcctctccacgaggcctgggctctctcacaacatggcggccaggttccaaaggtgagcatcccaaaagccagcttgcagtggtttctctttcgccttttatgatccagcctcagaaatcatacagtgtcacttctattgcactcattcatgaaggccgtcataaacgctaacccacactctaggggacaggaactagactccacctgtgaacgagaggagcgtcagaaatattagcatggccatttttggaaaatgctatagagccaaagtctgcatgaagagagaacagattgggaatcagaggtacctgagttcagattccagcttcattgctcattagctctgtggcatggggaaatcagtgaaccctttactgctgtgttatttgtaaaatgactgtgattgctgactgattatgtcaggctatacaatcatttctttggttgcaagccatggaaaccaaaccttatgaagagaagaaaacacatatgcaggcatgtgtgtgcacacacacacaagacatagagaagcaaagaaaaataggatgaagcaagcttcaggaatgccggaaaaagctgcttcagcgatctaggttcctgggatgaatggatgatatttttaggctctcacgatcaggacaaatcagctccaagtattttccatccttatgtctctctgaaaacattgtacgctcccagcatattaagtcctgggtggcctgtcttgagtcggactcacttcatcccttcactataggagagagaggcaccataatggaaagtctcagcaaggctacatgaagaatggggtaaactcatgggaaaatgcaggtgtccccacaaagaaggagaaatggataaacagcacatctactctggacatttgcaggactaagaaggatacaagatggaaagcagaatatgggtgtactgttcccgcttcccaatatgccatgcatgttcacgctccagaacttgactgtcagtcactcttcctaaaatatttcccttcctgcctccacccatcacaatcctgttggtctttctaggtcagtttcaaatactgcatggtccgtaacactttcggtgagtaggaagtaatctctttctccttgaattcctccattctattttataactttcttaggccattattacctccttctttgtcttagccatttccattttgctttatccaaacatttccaaacaccaggcaccttcatctcctgtaacctatctgctctctgtgtactgtcattcactgaatgcttttaagttgactttaatttgacttgtctttcttttaacttagcaataatatctgtgatatgccagctatatttttaccattcactttaaaacaaatattattgaaatgtttaaaataattgctgatcccctgttctactactcttccctattctggctgagttcctataagacagagatcagctcttagattccccgtgtatcatatccctgacatgccgcactgtgctattgatctggtggccgttcaataaaaagtcattgagtgaacaaatagaaagcgagaaagagggaaggagaaagagtgagatgaaataatgaagttaaagtgaactgagtgggactcatctttggtgagagaccctaaaggcaaaaaaaaaaaaaaaaaaaaaagagctgggaaagttgaattttgaggagaaggcaagaatactttattttccttctaccctaatgacaccttctctttggactcatcctcctgtgagttggcaaggggaatggggagcagcttaagcagcagctgccaccatgaccattattcccaagcaacttgcccagggcaccagaaggcatgagctccatgtttcccagccaaggctcttccagccagcagtgctgatgggaagaacaggcaagccagagtgccttatcaagtgcaagactcaccacccatagaggatccacccaaagccaccgggagaaccaacacatccctgcagacgacaaaagcgtccttttgctcatggccacatgccttgcagcacaagctcctctcaaatacttcccaggacctcaccgtaagggacagtcaaccagacgtgtgcttccacatgttcttcaaatgtgtttttcatttgcttgggttcaacctcattataatggcattagccagaggaggtagcatggtggttcaggtttctggaagtggggttaagccagtcctttcactttcttaactgaaattccccaacgcccttggcttactcacccctcagcatgctttgttctctttctgtctttttctgtctaggttctctatcatgagtgtcctcttctctgaattcatagcctttgtggcctctcttcctgctaaccatgctaggctaagtaacgcccacaccgcctccactccccaaagctgtccacatcctagtccttaccttatacagtaaaaaggactctgcagctatgattagatgaaaggtctttagacgaccttagatcatcaggatacacccattttcaccataaaagtccttataagaaggaggcagggccaagcgcggtggctcatgcctgtaattccagcactttgggaggctgaggttggtggatcacttgaggccaggagttcaagaccagactggccaatgtggtgaaacctatctctactaaaaatacaaaaattagctgagtgtggtggcatacacctgtagtttctgctactcaggaggctgaggcaggaaaatggtttgaactcaggaggcggaggttgtgatgagccaagatcatgccactgccctctagtctgggcaacagagcgagaccctgtctcaaaaaattaaattaaaaaataaaaattaaattaaaaaattaaaatggaggcaggagggtcagagtcagagaaggagatgcaatcacaaaagcaagtcattggagccacataaggaagaatccagaggtcaaggaatgcaggcatctctagattctggaaagagcaaagaaacaaattctgccctgaagattctaaaaggaacacagccctgccaacatcttaattttagactctgacttgtgggactataagaataaatctgagttgttttaatccactaggtctgtggtcttttgcatagcagacacaggaacctgagatattaaccttcatctactttctcttccaatctatgagggttcccccagcggactccctctataatcagtacggtccattcagcattcatccatgcacaccccaagttttccactctaggggtgccgtgtgtgcaccatttgagaaacacggcctctgcacaggaattgcatcataatcatccttgcatccaccatgttgcccacatgggctttatacatagcaaacaccctgtaaacatgtatttaattgcatagaaagccagtattccattgccatccacagtgagcctcttaaaatacattcttcatcagacccatttatatttgtccagagctagtcatgcatgatggtaggagaatgaaatgaataattttatttttgccatcaggaagtaaacattttattcatagactttgtcatcctgtgtaatagggtctgagtattcactctgcattttagaacatcagacatatggaaaatctatttgatgtgtagttctcagttcctgaccttatgtctttctcagttcattatttccacctctctctagtcattggatttgtagaaagaacagagatatttaagaaacattattcattccttcagagtcttggatttctccaaatagtccaaaaaatggcctatttttagatgattgaattatactagaaaggtggtgatcttgcccccagatgacatttgtcagtgtctagaacatttcagggggtgcgaggggaatgccactggcatctagggggcagaggcccgggttgctggtaaagttctcacaatgcactggacagcctctctgcaacaagaattatccaaccccagatgtcaggggggacaattgaagttgccgcttctccactctccccaattagaagtatctgcttaggtggagaaatcctgggctggaacaacaggctgcaacttggccaaatgacctctgattaaaagcaagagagctggcttaaaacctgttcaaggccatttcgaaaaacctggaggctttccctgactgcaagcttggtcttgggcaaaagtgccttatgactgctagaaaagctaagagcatctcaaagttcaagtgctggcatggaacttgggctatagcattgcatgctggccttctgcattcctcttggtgcctctttttaagagggatgttggcaaattcaggtgtgttcaagggaggcaacctggaaaaaaaaaaaaagagtgttgcggggagctgaagaaggaggactctggaagcacagaaacccagattcctccagccctgttactgccacttagcagccataagacctcgagaaattgactcaccatctctaaaccagagtttccttgtcttgggaattaacaggaagattgtaatgagttaaagttcatgtgtgaagcgcttagcaccgtgactgccacctctaagcactcaataaacagggctgtttatgcttgttattcggaacgggagagggctgcaactcgggcacctgaggcacaatgggaagtgctggagctggaaaaggaatgagtgatggacagactcgatcatcgttgtgtagcatttgaaggaggctgtctctggtgggctgaactacgatgaatgttagcaaaattctacaggcatactgggactcaacctggggaagccccgcaggctgctcagcatggatcagtgatcctcattctggccaccagcagaggtgccttgctacacgccaccaccttggggcaggtgccactggacagtagcctgcgtggacaactaaagctgtcccttctccactctccccagttagaagtatctgtgacttcagatgcagggagattttgaagctatcccattagaaagtcaatagtctgcctacctcattctttagcaaggatgccccataattaatcaagtgggctgaaggaataaaagcctcctgtgctcattgcattctgtgagcaaacaatagcgggaaacaaatgccagacgggctgtggtaggcataacagatgacatagtaggaattggtttatcttggcatcttggggggctttatcttagtgtaatcagtcaattagcaaactttcctaatggctgagaggcacactggctagcatgtgtgtggttgtttgtttgtttggtgttttggggttttttattttttggtttttttgttttttgttttttgttttgagaaaggtcttactctcttacccatactggagtatagtggcgcaatcttgactcaccacaacctctgccttccaggctcaagcgattctcgtgcctcagcttcccaagtagctgggattacgtgtgcataccactaccacctggctaatttttgtatttttagtagagacgggatttcaccatgttggccaggctggtctcgaactcctgaccttaaatgatccaccgccttggcctcccaaagcactgggattacaggcgtgagccaccacacccagctggccagcatgtttttaggtgcttagtagacattgcattctttctccagggttgccataacaaagtaccatagactgagcagcttaagtagcagaaatttaatttcttacaattctgtaggttagaagtctgagatcaaggtgttggcagagttggttccttctgaggcctctcttcttggcttgtagatggctgtcttctccctgtgtcctcacagagtcttccctctctgtctgtctgtgccctaatctcttctcatgaggacaccagtcatatctgactagggcccactatagtgatctccttttaacttacctgtttaagacaatcatactgtgaggtgctggagattaggacatccacatatatatttggggaaacacaattcagaccagaacaggcaccactaaaatttggcagcaccttttaaaagggccttgaatggaaaggagagaacctgtggtttacaatagccgccagagcactgggggctcttgcgatctcatgagaccaaactccaggtctaggcacacctggtttgggacaggcctgctttagcattgaaaacaggatctttgcccaacaggaaggttggagaatgaggcatgcatctaagaaaaaaatgcaagcaaaataaaaattcccacatattgccttaattgtctttacagaaggaaatatcccagggcaagaatcatcagggcatgctctgcgccctgcatttgatttcatgttttcaggagcacccctcaaggtctggagaagcacaggtgctgtacctgtacaagccagcaaggcaaagaggcctggttgcaagatgtgaggcaacattttatattttacttatgttattcaatttgtctacacatctatccttttctggaaaaagaccatattgccacttgagtttcagtattacagacattgttttcctctaagtgactagactctctgtttagctcgccacacaacatcatatctgccatgtgctgtcacacactaataaaagcatagaggagtatgtaaaacagcattgcttctctaaaaattcagccctattaagtttgttggtacatcacctggatttttattaaagtagtaaaaatgttccgcaaagtgactttgaagtaacagtacgattctgagccacgttaaagaaatgttaaggtggagagctctgttgctttcaaatactagtataattctggccaaatatccctgtttaaaatgatctgagcactttaggccttttactaatgtatggattatagttcaagccagtagctagggagctgtgtgtttgagcctccatctctaccacctagcagcaaacagatcaacctgggaaaggagcagctgcctgcacttcattcactgaggattcttccaaccctctctccgtctaacgggctggggtccttcatggacgcattgatagatgacagtgtgccaatccagcacacaccagaaatggttactccaccagggagctcacctcatcttctgccattggcctcccaccccacatttttccaatgaggttctttgagtccgacttatttttgacaaagccacactggtttgtaatgagcattgcattcttttatacagagttggggagggagggagattttgaagggggaaaacacgaaccaagtaggtagatatttgcatctctcaacttttctcgtcaccaaaaaaaaaaaaaatttcctcttcaaatttgtaggtaaaaagacgtgtttctttaactttacctctcacaaatggtatgttcatctatcggctgggactcttttagttaaaaaggaaacctaactcaaaccagaatgggggtggggaaagtgaattgatgtatctcacataactgggagatccaagggtggatgtggttttaaccagaactcgatctgagggtttgtgggaaatattcaaattagaacagttaagagcagacaccagccaatcaaaacagtccatgccagtgacgtcagccctgcatgtgccgtcagggtggggctatcaggaatctctctccctcttgactgccttcctcattgtcaacattactctcaaagaggctttggtcaggtttcaaaaggccagcagtagctctgggtctacagctccccagctctgcaccccagagaaatgcctgtccagtattctccaaaattcctgggctcatgctcacttgtccagagtagatctctagcccaccctatacccatcgctggccactggccccatccaaaactctggggcagtgagtggagggggggctgccctacgccaaatcaggtggtcttacaggaagaagtgaaaatagatgccgcagaagccacaacaatcccatccactgcaaatcacacgatagtaaatggcactttagaccccttctatagtttccagaaatgtagagaggatcacgttgctttagtgtcttgccccaagtgctattaatatccctgtccctaaaagattgatttttattatcggtagaaatacttaatagaaatgaaatctacgctctcggtcatagatagctggcataaaaattaaacaaaacactgtgaagcatacttctgaagtgaccgcatacctagctatgctgccccagtgagctcaagtgtgttttcattagggcatttggtaagcctgggggaaactgtttctgccccacaaaggaatgttctgcaaacattcagtaactaaccatgtgatgctttctacctctgtaactaaagctaaagacttttacctattgacttggattctcagctatcagtaggagggacagtttcaaaacattgtctatagagactgtaacatatgactatcacaagacagactcaggaactgttgaatattcatgagttaaatgggcaaaatgtttgacatcctggcatctttggatgtgtttgttttacatttagtagcttttctatagaagacagaaatgggaaatgccttcttaatctgcttgaaggagagggttctgatgatactcatctatcttcgatgagaatgggtctttatctttaattcctaattaacggttttgccaactacctttatctatttcccttgtgattttaagagaaaggaaaagtcttgagtgtgttgcctctgcccatctgtttctttacatcatttgcgagctcaggtacttgttatttgctgagcaaggactttccagctaggattggataaagcagtagctaggttcgagagtaagagttttattgctatcatttagagtatttcttcattcgttcatgcatgcctttgctcataaatacccccaccttattccacaaaagatatgaaatggagctttattgctatgagttcatgctggcataaatattaagctctgtgtaataatcacttgggctattcccgtacatagtgcagagttacttatggccaacgcaaagtctattttcccatcagaggttaacgttcccatttacttgatcagggtttggataatgcttcattcacagctgtttttcgcttgcaagaatccatctactttatcctcactgaccttaccctggcaggtggtgccaggatttcctcaggcagttgtttgttttagcattttcgagtatttatactggctgcggtaagggagccaggatcctggggcttgtaagtaccaggtcttggtaagtctccttcctggcagcagcagcagcgttagtaaaatgcattttccaatactatcctgtgtcttaaatggtatttttatccattagagttgagtgcaagcaatagaaattaactctgaagaacgaatgcaaaaacagtgtctttgagggctgtgtgtcgctgacaggcaggcgggtccctcaggggagccctggtggacagtctgatgctcggtgccaactgtcagcccaggccaggagtcagagttgggagagattgtgatgccttggcttgggtcagggcccacttcctagctcggggatggtcaaccttgacaacagcgtgtgacaagggtggagtcatagcaattagggtgtttttaccaaagtgaaggaagacgaaatgccttcctgggtggggaaaaaaacaacagatgtccactaccctccccttttgcagtaattttctctccatatttgatgactattctatcagatattgttaaaatctttccccagtatatgcaatttacctttaatgtcatcttcttggtacagtcttccattttgctgagttcattttgttttccataaagctaggaaaacttagacttgcccacttttttgttttaatagactttgttttttagagcagttgcaggttcacagcaaaattgagcagaaggtacagggagttctcacatgcttcctgcccccacacatgcacagcctcccccataatcaatatcccccaccaaactgggacattcgttacaactaatgaacctaccttgacacgtcatgatcaccagaggccatagtgcaaattagggttcccttttggtgttggaaatcccgtgggtttgggcaaatgtataacagcatgcatccaccattgtaataccatgcagagtagtttcagaactctaaatatcccgtgtgctccacccgtacatccctccttcccgccaacccttgccagtcattaatccccactctgctgtacctcttactggctttttttatgtcttgagtcacagtcttgctctgtcacccaggctggagtgcagtggtgcagtctcagctcactgcaacctccacctcctggactcaagcaatcctcctgcctcagcctccagagtagctgggactacaggcacgtgccaccacacccggttaatttttgtatttttagtagagatggggtttcactatgttggccgggctggtctcaaatccctgacctcatgatccgccctcctcagccttccaaagtgctgggattataggcatgagccaccgcacccgccctggcctctttaatgattgtttacttgggtaggtaaagtcttccagtccttttcattctctctaaaatcagaaactctttggaaatatctgaattttcagatcaacatcattgcctgtaaaactctttaagaccctctttgaaatggggtaacagccattaaaaaaatgagaaggccagactcaggctggacatggtggctcatacctgtaatcccagcactttgggaggccgaagcaggtggattagttgaggtcaggagttcaagacccgtctggccaacatgtctggccaacatggtgaagccccgtctctactaaaaatacaaaaattagccaggggtagtggtgcacacctgtagtcccagctacttgggaggctgaggcaggagaattgcttgaacccaggagacggaggttgtagtgagccaagattgcaccactaccctccagcctggatgacagagcgagatactatctccaaaaaaaaaagaaaagaaagtgaggcaaatgaagacttgtagtgattgctttactataatcccctaatctcccctgacttcttccccactttttgtatatattttccatcttctcccattgggttcagtctgaactgaatctgtctgaactgcctggttcaccgcacgtgaaagtccctgtctccactttcttctgtctcaggaaacaggctcagggcagctgagaaacaggcccaggccatcctgctgaaggacgacaccatcaggaagaaacaggtagtgacatgaaatgggcacctactatgagccaagggctgactcttggtgtctatttcttcatttaatgatcacggggacgctgtgagctcctttcacctctcactgcctcaatttccttacctgtaagtggcgacgataattccttcctccaggactattgtgagagtttgagagctagtttggagaaaaagtaggccaattaaccagctcccctgcatgcaaagcttgttatttctctgtgacagaggcagctctttaaaatcttaccgtgcacgttctgcaggacacctttccctggatttttctttcacgcaaaccccattcagttcctactgtgctctgcttgcctctcctgttgttgagaggctcaggaaaaacaactggaactaattcaccactctggcttgatgaagtcacttcctgctgctctgggcattggcctctggaacaatcaaccgctgtctggtgggaattctattaacatgactgtgactgtcttactttggacagtcttactttggattgcccccgaagcagatgctgagacaagggttagggtgaaaatagtttagttggcagaaaatcccataaaataccagcgggagagcaggaagtgggacaggagaggaacacagcccacacactctgcattgtccatccagccaccactatgcgtacaggagctgaatcccagaggaacacactcctgggcttattccatccaagtaatatcgtaggctgggggaggtccccaaacgccagtgagtccttgaccccagtcattgtccaggctcttgactgtgagaagaaattcaagaatgagtcagaaaatagtgaaagtatggtttattgcaaagcaaaaagtatacactcaagaaaggtgagtgtgagcgttttcaagagtgaaggaatcgctctcaagggggattggggttgctacctctatggatttctttaaccaagcagtggaatgttcatgaagattcctggaaaaaggtggagatttctcataactgaggtgtcacccatttttgcaccaaatatgggtgttcctggaaccatcgaggtgccggtgggtgtgtgatatagtatgttaacgagcatatattgaggtcctagggaaaacctaagtgaaatccaccaccacgatgggtccagttggtcttagccagcttggcccacactcttgttttttcagggtcttatcagcccctagcttctgcagctatttcaacattttccttttgctaatcatgtgaaactactgcctggaattttctattcttctatgaccaccctgtattcttcttgtctcatggggagcaagggagctgaggtataagtaccccagtcattgggtgagggttgctcctgagagaggtgctgattctcatcgcattcagcctgctgcatagatgagcaaaggcctttggctgctggtgcaagttctctggcaaaggaatgcaggtgctgacaggtgcatttggcctgatatgcactgtagggggatggcttccagggcaccctcaatgcctcttaaaatcattctctccttaaaaccagcccattcatctcttgggggcttctgcctctctttcagacaaattattgcagagagtccagtagccaagtagaattgcattgagcaggcacatttgacaatgacatttgattccagaacttgtcaagctttgttctcagaatatgaccagatcctaataatgtctgtccactgttgagggaccactgcgtaccagaccctatgtgggatctgtgaagtctattacctcattcagtcatcccagcaaccctgtgagggatcccccactgtctccaatttctgcactaggagagggcgacatggggaggttacgccacactccacgtcactcacccacggccctctcagtaaacggtggacacaggatccgtagcctgaatgtctgtgtcatggtcaagctccaggtcttttccagcgccacattttccagcacaacaactagattagtaagtgttcgcttatgaggatgtactaggagcgtagctaccgagcgcttcctgcataccacgtgcagttatacacacctcacatgtaagaatttaaacccccacggtgacgctaggaggtatgcacggttacttccattataaggtgaggaggctgtggcataccatgttctgtgccatgtcctcagataccattataccagatgccattccttaagcccctgagtaccaatcccactccctctccatcacacacagccactatggaatacactcacatcagcgtcagttggccccactcactgtggggcagaatttccctggtctgatgcctggcatctgcccagaaggcactgcagcataggggacagtggggtcagactccactgtaggaatctacatctccctgcacacactgtgaggccttgcaagggctactgcacatcagcgagcctccattttcctcatattcaagatggaatcaagcttgtcttcctggcgggttggtgaagatggcactaaatgagaagggaacagggtaggcaccaaatggttgctgctgccgaatttgggaccggggtgctggtggtcatctgagtgccagctctgcctgaccttgatccagtacatacgtacacacacacacacacgttcacacacttgtgcatgtacacatgtgtacatcatgcacatacatgtccacacattcacacaccactcccacatctgcacccacatgcaagtactcatacatgcactcatgcacacacatgcacacacattcacacatgtgcactcacacatgcacacactctccagtaagctttttggagttcatcaatattacacccaagtcagcatttattgagcacctactgcataccagcattatgccaagcacaagagattaggggaagttgggcgtaatggctcacgttcataatcctgctctttgggaggctgaggcaggaagattccttgagcgtaggagttcgaggacagcctgggcaacatagtgagaccccgtctctgtctttaaaaaaaaaagacacaaggggagcccagaaatgaaacagccaatgtatcatttcaggcagaccatctcgttttcacaggaagcagcaaagacagggtgccagacacctttgccacgctccactggcttccatactctgagaaaagagggaatccgactcatgagagccagaaatgaaattgatgcaatcccaaacccagggccagtccatcctggaaggtaagccccatggggccttgtgactgcctcttctttcaagcaaggtcctgtcataattttctccctggcacaacctttatggagtgggttataactgtgcctgaaatggactggcctctggcagagcattcctcggtgtgggagccatcaggccctcaggaacgagtcttcctgccaccaggaggtttcatgtatgcacctgtatcatcagtagtgtggtgtttctgtatcgtcagaactcagcacaccatttctggccagcatggttgtttgatgtagactgagaagtgggttcagtaatgagcacctggcacactcaaactctgctagggttgggtggccacactcctttgaggcttgaccaatgtcacctgaaggtcaccaccagtagccatccagaacagtttaattgggggttggcagtccatctgcagtgacacactgcctgtgtcctccaaaactcagtggattggagaattgagtcacgatgaatcttgtaacccatacccagagccctgaagaacgcaggttgtttgcacgcccagccacaaagaagttgccttctcttgatctttgaagcaattaaatgtcatttagagaggagaggtttgctgtttaaaaatattttttaaaacagcttgagtttattcttgtaaggctgccattgggtctgagaccccagaggagcagtgcgctgccttgcagttactccgcagtgggcaagacaggcatgttttgctctgggaagagttgctgaacacctgtctgagcaagggactctttgtggctgtctggtcgttatgtacaccacttggtcctacctccaagtagcttgtggtctcctgggagctgtaagaaatccaaaccagcaaacaacatagtttttgtttccagtgttaaccacctggcgaatggtccagataggaatgctgtagaagctccagggaggaagagactccaggggctcaagtggtttagcagggctagcaggactagcaggacaagacagagtttgaatgagatcgttgcatctaagtggaataaggagaagctgataatgcaagaaggtcaaccatctcacacacatctagggaccgtggggaaacccattttgctagagtagagagattggatgaggaagtacaggctgcaccctggagccaagctaagtaaactggacttcattctgaactgggagtggaggggtccatgtgcaaaagagcactgtgggaggatccaggggacactggagccctggagcttgttaggaagcaagctactcattcccagggaagaaagaggaggactcagagtggggaggagtgtgccacatgaaaggtgcccacagtattcaaatcccaacttcgctgcctgctaattatgtgaaccgatgctggctacacaatctctctgagccttgctattctcatccctgaaatggcaatagtaatcccagcctcaaacaatgatagttaagattatatgaaatatcatgcatgtagtgccagctacatatgtacagtgtccaaccccacaaaggggatccctgttattcgtagggagatggtgtagcagtgttgccctagagccaattcatagcagtttgcaggggccagttgttaccatctctttgtagctgtgcattcagtgacatcgtgggagtaactcgaaactggccacattggaaatacttctatcatggaattagacaaacactattaattcaagctttccccacctccagagaatcagatgttaaacatttgccagtgttcctctggcaaagaaaaggaaaatagccagaggtaagtgaaatcaaatgagagaagtctaaccttgcaaaactgagccaactgcactgatgtatcctgttgtctgtcccacaccctcgcaaggcttttggtctttgtccagcagagtcaccacgtcttattcaggttacagtgctgagctatttggaaaccaggctgggggggtggatttcaatgtcatcttactaaaaaagttcactaatgaaaagtgtattgctaagacagcagcttcatatttctcccagtctttatcagcagccatggattgaatcgttgacttgattttactacactgaggtcccactgaggaaggccaagttcctaaatcatgcacctgacaggtgccatatttctgagcacagagctgagctgtgaccttctagtttcacagtaactagagctgggtgacatgcttaataaagggagtacatggtgcatttttaaaatatggaatgaaggtggaatcatgcagacatgtcagtctgaaactggttaccagaagcaaggtgatcaatcttcctgcctgtcttaggatgctgatgtgagaagcacgatgactttcacttggcagaaggatttggaagtatctgggcttgataagctacctcatgccaaggaccatgctctgtatacgacttcatcttttcacccaccctatgagtgaggttttagtgtctccatttcacatatagagaagtaaaagcttggaaggttagcacctctctccatgtcccacagatactaaagggctgagccaagatttgagtgtgcttttgtctgattcgcctctgcttggccctctgtctccaagctgctgcttagctggaggctcctcagtgacatcagctcactgtggctccctctgcctggaatgttctcccttgcccaggccttcatgtgactgtctccttttcacttcagtctcactatcatctcctttgcaaggctttccctgatcaccttcgctaaagaagccctcctcaactctgcccacctgtcactggtcactccctgtactgttgcccaatgggacggctttcagagcacataccactctctgaagttatcgtattgtgtgttaactatttttatgatctcccttcctcttgtagaacagaagctccatgagaacaggaatttcatgccttgttctctttcatatatgcagagtaaagaagaatgtctgacatataatagctacacaataaatattgaaagaatgaggggatgggtggacagatgcatagatccatggaagaatggatggatggatggatggatggatagatggatggatacatgaattgatggatgcatggatagacacatggatgagtgatgaatgcctgggtgggtgatgaatgcatggatgaatgtggaatgcatggatggatgatgaatgcatgggtgggtgatgaacgcatgggtgagtggtgaatgcgtgggtgagtgatgaatgcatgggtgagtgtggaaagcatgggtgggtgatgaatgtatgggtgagtgatgaatgcatgggtgggtgatgaatgcatgggtgggtgatgaatacatgggtgagtgataaatgcatgggtgggtgatgaatgcatgggtgggtgatgaatgcatggatgaatgtggaatgcatgggtggatgatgaatgcatgggtgggtgattaatgcatgggtaggtgatgaatgcatgggtgagtgatgaatgaatggatgagtgtggaatgcatggctgagtgatgaatgcatgggtgggggatgaatgcatgggtgggtgatgaatgcatgggtgagtgatgaatgcataggtgagtgaggaatgcatgggtggatgatgaatgcatgggtggatgatgaatgcatggatgagtgtggaatgcatgggtgagtgataaatgcatgagtcggtggatgaatgcatggatgaatgatgaatgcatgaatggatggatacatggatggatgaagttgtacaagctcaaaccagctcagattggaggaagcgtcttacttgaagccccctgtgactatgttggggcttgtctcctaccatctcactgaaggagcctatctcctaagctctctcctagacacctgtatccttactttcccctcccttcccagcctgagcagtgtcagcgtcaggagcaagatgattgatgaagtgtcagcagggacacaaccagctgggtgagcaggggctatattgtaacctgcagccaggagctgctcccttgagatggcctttgggtacaactctatatggcttcccagcctttcttccagctgcaggatcatcctacccctgggactcccttattggtgtcctcattaggccaatcaatgcaaattaagccctgattcacagatagtggggatatacagtcaccacgacacatatggcctctgtcatccagtttcactcagtctagagaaagaaagagatgaataaacagacccttttagtataaaagctatgatgaaagtgacatttgaggtgaaaacactacaatataacagcagcagagagaaaggcacatcagtcaaagtcaaggaaggaagggacagctgggctcagacttgcaggtagaccagggcaaggatgttcaggcagaggaaatgggataaacaaaggcatggtggccaagagagctagatccgttcactcaacacacaggcaggactgcaacgggtcttgtgtatcctgtggatctaatctatccttaggcgtcagtctgggaaacatgagttccgtcttctccactaatctgggaaggagggtcaagtggtacctctgtctccacctcctccaggcctacacagtttgtgactgacatactgagcaccaggtctgcatcacccaccttatcacatgtgggcacaggatctctgccgggggcaagcggtatgatgtgtcctggtcacggtctggctggtgatttggttacatccagacacggaagtcgacctagaataacctaagacaaaggcagtcgtttctctggctgacattgtcagaacgttaaacaaccaaaaacagcaacaaagtgatgggccaagcaggcaagtttgggaacagctttaatgactaatttctaatgagagtttcaaaacactaattttccagaacagagaatcaagttgtgctcatttataacccgtcatctgcaatgagacagaggatatttctttctgtgttgtcagttaactttctgagctggacagaatacaaactagaagaggtgggccgtaaatcagctcctttggaactgataaatggatattgtacaaatcctgcatttgcattggctctgaggacataaatcaattctcatgatcttactttggaaaaaaatttccctttgaagtcagactgagcgatttatgtagcattctttcctgactttatttttctcagctttttaatgattgtcttttcactttctgcacttacacaacattgtaaagtgttgcattttcatgtagagaaaactggaccttggtctgaatcttcccacaagggataattttataacttttttgctcagccattgaataacaattgcttttggaaagattgtcataatgtatcagttagaaggcaccttagagaccatcatttcacatgacctctgttttttagatggggaaactgaggcccaagagtgacagtcatgtgctgcaggtcacaggccaagtttgtgacaagaccggggtgtctgttcgggttttggagaaacaaggaccctagatagggtccattcattcattcatttatttatttatttgttcattctccagacaaatcgttatcttggccccttctgctgcagccattgccactaagaaggcaggccctgcaggggagactctgcacgtcttttgtttgttgagtatttgctaaacgggcaaaaaatggaagaaaaatcaaaacatcactgttggctgggcacggtggctcacgcctgtaatcccggccctttgggaggccgaggcgggcagatcacgaggtgaggagatcaagaccatcctggctaacacggtgaaaccccgtctctactaaaaatacaaaaaaaaattagccgagcgtggaggcgggcccctgtagtcccagctactcgcgaggctgaggcaggggaatggcgtgaacccgggaggcggagcttgtagtgagcggagatggcgccactgcgctccagcctggggcgacagagcaagactctgtctcaaaaaaaaaaaaaaatcaccgtccttttttggcgttctgtcagtcaagagtattctgaagactatcgagggaggagtgtttggtttgtgccttgttttgttctgttttagcagccctggaaatcatggatacctcccttccttgaagttatctttcccatgtataacagctgtattgatttatgagatataattcacataccgtacaattcacccatttaaaatatacaattcaatggtttttagtgtagtcacagagttgtgcaaccatcaccgccctcgattttagaacattttcagcaccctaaagagaagccccatcccccttaaccgttaacgtgcttccttctccccactgctctagtgaccactaaccagcttcctgtctctgtgggtttgcctagtacggacatttcatcggaatgaaatcagctaacatgtgatatccttaatggttttgtagcagaaagacatctacgtgggaagggacgctgctgagtgtttagagaacagacacattcatcattttattgtattttctcaactttagaacagttttcaaacatgtggaaacgttggaagaattttatagcaagcaccctttgccccatcaccgagattctcccagcacatcttcttctgcttgctttatttagtgcacacctatccacctgttccagagatcaccactgcggcagtgggttctcaaaggagaaccttccaaccttcccgcattgagaaagaaaaatatcagttttactaaatgaaatatcaacattggagattttataagccgagaatgttagtacatcaacattagaagccctaaaaaataaaattgcattcaaaggccaaaaaagtcttaggcttgctagctctccaggaaaggcctgtgtgttcaggacaggaggactaaggaccaaacaggtttgggaatgacagatcccttgacggaactggctgacaactttgctcaccagtcacagcagggcagcccagggagtgaacaggggcgttggcggggagggcagccattcccgcccgctgctaatgggctcgcttctcaaaggagcttttgggattcaagggtttaagtatcaagtttgactgatggatttggagggaagaattgaaaactgcctgagggaaggcgctttgctttttcttttgtgaggcaaaagcttttgaaaactgtgactgtacaaagagccacagctcctctgaggagtctgttatgcggcaacacatactcagatgtggacagcagtgagcacgctgcctggaaagggggaacagcaccgcgggcaggcttcagagccacacaccacgtctctgtctcagagtctatcctcgaccacagggtttaagtctttgatgtgcacactgggccctggagagaaggtgcctgttctcacgggctgaccccacaagcctgtgagccgtaagcggtgtgattcgctaacagttgaatggcactggctatgtgtgtatgtgtatgtgtgtgcgtgtgtgtgtgtgtgtgtgttgtgaagatacatttagtttgagtccctatgaaacgaggagaaaaggtcttgacaaacaacagttcaatagctcctgccaatatgtgcaatgcaattctttttagtgagtgaattaggcttgataagaactacattaaagcttctgttggaagaggaattcaaaatgctcatctttgtaatttacccactcagtcaccagtgtttaccaagtgccaatggaagcctggagagaagagaaagcaaagataaataagcgtgtctctcggccttcaaagcactgtgcccagcaggaaggaaagcacacaattacgacatgccgtttttattgtatatatgtttatatattaggttgggccatgtgaaattgctgatgtgacgggttttgacgagagaaatggcaactgtgtggttcaacctaatatttagatagtattgtcttagctcaggctgccataaccaaataccacagactgggcagcttgaatacagacatgtattactcacagttctggaggctggaagtccaagatcatggttctagctggttcagtctctggggagggctctctttctggcttgcagacagccaccttcttgctgtgtcctcatgtagcctcatttccttggggcatgtacctggagggtggggattagggagcatacagggtctccttttataaggatcctcatcctatcagatcagagctccatcctcatgacctcatgtaaccttaacttcctaaggagaggcccacctccaagtactgccacaatgggggttagagttctatcaacatccgaatttggggggaacagcaacaaatgttcagttcacaagtataaaatggatatattatttatgtgcatatacatcatatactgttacatatcatagataagacatgcatattatacatatgtgtatgtatatatagtaaatataccatctatagtaataaggtttcacaaagaagagaaaatggaaatgtagagatataaaggaaatcatctttgtattactagtctttttattgccaaaaaaattttatttgcaaaacaaatataggctcatggtaaaaattttagcaactgagataggcaaaactaagaaagatgtaaatcccactagccagataccactactcctaagacccaggtcagacagcgaggcatcactgttaagagcatgggcgctatggttggacaactctatcacttactagctgtgtgtcctggacccagctacttagtccctcaccacctctgtttcttcatctatataatgggtcagtaatcccacccacatgaagttattgttagacttaaataagctgacccatgtaaagtgcttggaaattccctggcacaaagcaagtgctcaataaatattatctgtgactctattattatcatcatcatgatcataattattaccgcaactgccactagcattcccttccaaggtattttctcagccagcagcagcaaatctgtttgggattgtatgtcaagccctgtgaaaaagaagggtttggcacacagggcttcatacaaagaggggttttgaagctgacctggccattgccaagtcattaccgtgcttgtgagaagggggcagcgagcctgccacatgtttgcatgtggaccctcacggtgctatacacatacctacctactataaagatttacttcgtatgtgttgtcatcttgtcatgctgtgttcatcatggcttttaatgtctacgtagcattccattatcacttttgatcaacagttccctgattgattttttatttttctatagtaaacattgaaggagaaaatataattgtcgctaaatatttcagccaaataagtctgagctatgcattattctaaggccctctctcagatcttcacaatgcaaatctgagtattaaaggctctgagaattcttgcgcaaagggggacctcatttgatgttattaacctggcattccccagttttggaatgtgctccctatagctatttctttaagctaaataattagaggaagaatttctgggtcaaagaatatgtacagttccaagagattttcatttgtttccctctagaatgttgttttaggaactgacaaacttggagatacctccttctgggctaaactgtgactttttaaaatcacaattcgatgaaaagttcaacacactaaaatatacggtggtattcttttaaaaaattcatacaattgaactgggtacaaaggatcacctgggttttttgtttgtttgtttttgttttgttttcgttttttggtttgtggtttttttgagcttttagattcagggggtccatgggcaggtttattacctgggtctattgcgtgttgctgaagtttggggtatgagtgatcccatcacccagacagtgtgcatagtacccgatagttttcaacccttacaccccttccatgctcccccttctagtagtccccaatgtctattgctcccatctttgtgtctgtgtgtactcaatgtttagctcccacttagaactgagaacatgcagtatttggttttctgtccctgtgctaattcgcttaggttaatggcctccagctgcatccatgttgctgcaaagaacacaatttcatcctttttcacagctgcatagtattccatggtatacacgcactgcattttctttatccattccaccattgatgagcacctggattggttccttgtgcttgccattgtgcattgtgctgtgataaacatacaagtgcatgtgtctttttggcaaaacaatttatcttcttttggataaacacccagtagtaggattgctgagtcaaatggtagttctgttctaagttctttgagaaatctccaaactgctttggacaggggctgaactgatttacattcgcaccaacagtgtataagagttcccttttctctgtaacctgggcagcatctgtcattttttgactttttaataatagctattctgactggtgtgagatggtatctcattgtggttttgatttgcatttctctgaggattagtgacgtggagcatttcttcatatgtttgttgaccgcacgtatgtgttcttttgcaaagtgtctgttcatgtctttgaccattttgtaatggggtagttgtttgcttgttgagttgttaaagttacttatagattctggatattagacctttgttggaagcataatttgtgaatatttctttccattctataggttgtctgtttattctgttgatagtttctttgccaatttttgtttttggtgcaattgcttttggggactttgtcataaattctttgccaaggtcaatgtgcagaatgctatttcctaggttttttccagctggattcttttctcgtcttctggcaagtcagtttagaagaggttgatttattcagaaagtatccattttctttttctagacttcagacaggaaaatgtaaaatgagcaaaattctcgtgtataaactagctcaaaggtttgtggaagatttaaatgctgcatgacaggtagcaggtagtcgataaatgccagttgtgaatattgcttttcagattaaataacaaggctgaaagtaaatgttttggacaggctagctattcttcatacatccaacctaaaggtaatcatcctggtttatttatttattcaaaaaatattgaaaaattcacactgtgagccgggtcctaactagccctgaggatagcagtgaacaagacagtgtggagtttccattctagtgggaagaccggcaatgaacaagccaatgaatgtctgatcacacaaccggtgtgattacagcttacagctctttcccatgggagagtcaacagcttaatgggatggagagtaactggagaaggccaccttagatgggctggttaggagggagatgatgtgtgatctgaagagtgataatgaaccagccaaggggagaggtgagggggagaaaccaacagctaatgcaaaggctgggacgatgggagagcctggctagctttggactggggaacagggtgagttgatggtgggaggtgagcagtgatcagtccccaaagccacaaaggttttgaagcctgaaagggacatgacgtacattttttaaatctcactctcctgttctgtgagcaacagaatagaggacccggaaactgtagtagggttctgtttctacactagtgctaatgtagaacctcctacatccagaaagatgatagcagagctgagccacattcttcctggcaactgatgttcccacacgtagaaacagctggcatcctcatacagagggaggcttgcaggcccaggatacatctcatcccccttgctaatctcagtacttgacacccctgacctcaccaggggcaccaaacccaactgcttcctgcagggattcagctgcacttgtcatcacagagccttgaaatccctggggatatcaactccttggaattccaggctgctcttccacttgcttctgacacattgacttttctgcccattcactcacccatctttaaccaaggcctgtatggccagacatgaggccactcactgcctacatgaagagggaaagacaaagtgtatccctgggagctcgctaccttgtgtgaaaattacaacatcagatagtaaatgccttggtgaagatacgcatcccaagggcaggaagctccccaccttgatcactgcaaactccccagtccctaacagaatactgggaagatagaaggtggtcaaagcgtatgtatggaatgaacactggaaatcagtacacagggctgggaatgtgtgattctgagcactcagtgatggaaataaccctccagctccttcacagaacagccagcagcatcacctgttttggtgatggtgcctccggatgatgatccgtgagcgcacactggactcgtgctcctgggtgagctctctccttgtgaaacccagatgcttctgtctcccagggaccctgcagccctcccggtaacctggcctccatcacgaatgcagtctctatagacggttgtctattaggatgccactggagagggaggtcccgtcatcacctaagctaagcacagctgcctctaagtacctccttgcttggcagccggccagaccacattcactgagcttcaagtcataatgcgaggctcagccatctatctcactgtggtccccgctgcagctggcttcatttattgacttcttgaaagtggcaatatccatgctcagcttggtctgagctggactcagagacccaggtgccagagcaaaggccatggtgtgtcggttaatcacccaataaaaataaactctgagaacaaatacagaggggtgattaactttcccattctggtcttctgacatcccagtttgctctcccagtgagcgtgtttctttgagataaaccaccctgggaaactgatcacctgtccagacaccaccatgccttggcgtaagtggacaaaagtggaacgtgacctgcaagcagcgcagcctgagacttaggcagagagccccctgccccaggttccatgctgctgagggccttatcagaaactctgaagcagagcaccagactattttattctgctttttgctcttgtaataaagtgttattagtgtttagtcaccagattaaaccccaaagccttacctcccctcctgtgaccatccatgtactccaaatcatgaaccaaaaaacagggaccaccaacagcccttaccaaaagaagactggaagcacaaaaaagcaacttaccatgaatcaatttaaagtgaagaccaaagtgtgactcaaaactgaaaaaatatatgtatttggttaagatgtaattgttaccgaagcaccaggggtttggtctgggtcctgctgttcactgcacagaaagccaatcactgagacaagacaaaagccagggaagaaggctttaatcgggtgctgctgcagccaaggaaatgggaggtcagtctcaaatccatctctgaaatgaggggttgatgcaccagagaggaaatgtaaccgtgtttgggaaaacatggatgaaattggaaatcatcattctcagtaaactatcgcaaggacaaaaaaccaaacaccgcatgttctcactcatagatgggaattgaacaatgagaacacatggacacaggaaggggaacatcacactctggggactgttgtggggtgggggaaggggggagggatagcattaggagatatacctaatgctaaatgacgagttaatgggtgcagcacaccagcatggcacatgtatacatatgtaactaacctgcacattgtgcacatgtaccttaaaacttaaagtataataataataataataataataataaaaacagggattaaagcggggcaaggaagagaagttggtcagtaggaagcaggtggtcctttaggcaatcctgatggatgaggggtctggctcctcattatccagaggcagtggtctggtaagtttcagctccttgattttatctgggagacctgatggttggcttcttgagaaaggaactcagataagacaattgtaactttctcaagttttaaagtctggaaggaacaatttctgtggttattcaaaaaaaaaaaaacataagcgtcagttctgtgggacaatttgatcactttattttggagaaaaaaatgatgaatagaagtttgtttataagtttaaccccaataataggctagtctcacagtgaacacagatgaaccaagaattgctttgcttttgacataatttttacaacatcccacggcagtacatgccaaacttcaccttgtgctcagcttatgccctgcatttataaagagattgtctttcctaaccattcgagggctttgtccatttcccaaaggacctctccccagtcctttgccagtcaaatcactctttcgaagcagttgtaaatccactgtcctttctcttcttcaatcattgattcccttctctccattgcgttttcacttgtcatggatttacttatgattcctttttttcttcttgtattgctttacttgtaattagcaaataataattgtatatatttatgaggcataatgtgatggtttggtctttgtatacatagaaactttgatcaacatctcccccttcttcagccctctccctgctgccatgaatttgactcttttagattccacagatacatgaaataataaagtatgtgtctttctgggcttggcttatttcacttagcgtaattcttatactctgagtatcctcgtagaaccctacatcttttgtgagattgacagtcatactttgtgctggactggtgcatctttgggatggttttgtcactgggcgataactcatgaggtctgctgaccaggtagataccaggagtaagcaggatatttggctgcaagagagaattataggcctggtcgggagttcattcaggatgttgtaaatggaatactggggtgatgagcagtccttgtgggtcttgttcatatttgtatatattcaggcctaggaatgcagggaaaaaagggataaaacacactgaatgaaaagagtgtgaacaaatggatgaagagcctcacaccaagtaaagcttacgttgctaccaactggtaccaaactccaagtcgtcctgttcttttccaagcgccatttctgctgcttagaaaaagccacccaatctggatacatggatgtagcaaatttaaccttagacctagattacctataggatcagacttgatcagtcattaataatgataatgaaaattaatcatgaaagctatcttgtggttgcaccttaaagcatctgtgtaatgcttttacccatactaagagtgttcaatccctgttttcacctaggattgataagtgtatttctggatttcagaaatcggatagcttctgaagtctcagcctgttaatatggtaactaaatatgttaaggtcctagtctctcaatgtttaattactgtttaattttttatttcctaatttactcaatgtgtatgatattgttaaatttgtggctttataccctgaatctctttgtctgtatttctctgtattgcttggcagtcaatttggtcaaaagcaacaacgaaatgacccttacgaagtgtcaaatgtccctttatatgagatataaatgtctttgcaaagacacttataaagttgtgaagacgttgtttccttactctaatagctgctgtattcacgtaggtttcaaaaatggggtgggggagggcagtggcagtgagcgcctagcggaaactatgtcaatcacccctggaaataaatctgcaaaatggactagcaagccctgactaggaagagcccggccacagcaaaatcttattgcaggcacaaaaaggtcctattgcagcagttgggagacctttggtaaattctaacaaagaattaatggcctcgaacaagacgcccggtatgacctttgccagaagaaactaggagcagacttgcttgcctggaacaggtggtgaggaggttttcagagaagatgtgtgcagtccctggcaagtagctggtgcccaggaaatgtcagttccattgtttgccagggaaggctcggtgcacgtggggctcacacacaaaggaagaggttagagagtccgcagaaaagggtgggagctcaaaacagtggttcttaggcgtttgtctgcaggcacgctggtaattcatgctgaccatgcccacaatcagtggcacctagctgtggccccacccctttcctgcccactattgaaagtgactacatggcaaagagcgcctatttcctagactaaatcattctcagacttaagttattagtgagcgctgttagactcaagttccttgatatctacatcacaactgagtagtttatctcagtggtaagtctcgaagtttgacttcgaagttactaagagccttccaataaaagaacagtttaagccaatattgtttcaccattgatagtgatgaagatattaaattcacacacatgtgctgtgtgattttaaacctttctcaaatgtgtatgatttttataagcagaaatataattttaagaaagctttatatctatgtaatagggttcttttttttttgggaaatattgccatcctgtaaattccagtcctatgttcctgagttattccccactaaggaaagcccagctgtgggacatagacctggtttccacctcagagtttaaatcattattctcagaatggtggttctcaaactttggtgaatcagagccacctggaaaacatgttaaaaatggaaaggtcccatcatatcatcaacagccctgatcattctgatacacacccaaattggagaaccagtggcacaaacaaatgcccaaccctcgtgggctattcacaaggcaaacaaaaatcaagctatgcttgggaggcagagatccacattggaaccacacttctgctgctggaaagctgcatgactcaggcaagctcctagaccactctgagtctttgttttctcatgtgtaaaataaggtggtaatatctacctcccaggttgatgaggcaatggcagacagtaatgtatatgaatacatacatcgtacgccacctcctcagtgatcaatgaatgtgcgcttccagttgtagacacaacagcagaaagttaatgctgaaaaataggaaaacactcacaatgcatgatttacgatgtgagggagcctgctggcatggcccttgtcacgagagtaattaaataaccatttgtgtaattactaatttatatcctgtctccctgctggagtgtaagttccaaaaactggagggaatacactgctgtcttcccaacaccaagcgcggtgcctggcatgaaacagacacccagcaaatgtttattccaaatgagcgagtgaacagtacgtcacattaaaaacgtgtgtgtttatgtatacatcgatacataggctggaagcctctaggcaaaaatgttaatagtgcttatctctggaagtggattagggtgattttaatttttttcttttttctcctccgtattgtctgaattttctgcaattaacacagaggaccaaactagcatttccttgggtaaatgcgagtggagttggagccaccccctaccactgtgcctacaagagcatgttttcttgtgattccagcttccttgggggtttcaatatgtagtctctagaattaaaagggttttgggccaggtgtggtggctcaagcctgtaatcccagcactttgggaggccaaggcaggtggatcacaaggtcaggagtctgagaccagcctggccaacatagtgaaaccccatcactactaaacatacaaaaattagccgggcatggttgcacatgcctgtaatctcagctacttgggagcctaaggcaggagaatcgcttgaacccaggaggcggaggttgcggtgagcccagattgcaccactgcactccagccttggcaacaaagggagactccgtctgaaaacaaaaagggggggtttaggagaaataggaatttagtgatttctaaagataagtagaatttgttcttattcaccatttccttgtcctgatcatggactatgcaaaaaagagctcacacaacaggcctgagactgctgttcctagaaagacctgcctacaaggttggcctcagctggtatgtagaatcttggatgtggggagggctcccactctcttagctgataagagtgactcactgcacctaaactgcttgcgcgaacaaatgtggtttatgctgaatatctgttttccccctgggagtcaagaattttgctaatgccatgtggagggtgtctacgtgaccagccccccaaaaaaaaccctgaatgttgagtcttcggtgagcttccctgatggagaacatttcacatatgttgtcacaacttgctcctggaattaagcacgtccggtgtgaccccactgggagcagactcctgcaagctggtacctggtttccccaggatgttgccccatgtgccttttttctgtgctgttttccctgcgtattttccctgtgataagttttaaccattgaatatgacaatatgctgtgttctgtgggccttcctggcaaatcactgaacctgggagtggtcttcgggacccccagcacacaaacccacctaactaagccccctttgacagcatgtatcagatccaaggcaactaaagggatgggaatgtctggagcagcatagaagtgggagtttggctgggacaagagagacaggtggctcttttgagagacctgcctatgggggagggatgaatgagcactttagaattctgggtcacccagcacatgggtcaaccaatgcatgttaaagaaggtttctactctcattcattccctcatgcatgcattcaacaactgagtacctacccactcagtgtgtgcgggccactcttctagattctatgtatgaagggttaagtaagatagatgaggtcactgccccttggagctcacattctaagttgtagagctggccagggaaggaggcagacttcagagagaccatccagagtggcttctctagggaacacagaggccttggtgttggagctgagatcctacaaagcacaagacacacatgagaaaatctaagacttatccgatgaggcaagtagaaatgtgttgagaccagaaataatttactaatttcaaggaatgaaaggaaggccagcgagtctgtaacttagggaggctgaggaaagaggtagaaaatgcaggtagaaagtcaggcaggtccagatggatcctctaggaccttagagaccatggttaagagtttggattttattctataccccatgggaagtcattggtgggttttaagccggggattcacactctgtgatttaacactggctgctctttggagaatggactgtagcaagcagaagagaagcaaagaatcaggtgcattgcagtggtctacacaaaagacgatccctagtcgtcttaccacctgcctcctacaataaccaaagaaagtggacccacaccacagctacctcggtccactgcatgtgtggaaggtgatgattctcttgggcatgatatatattacttgttgtcatggtagggatcagaatgtctgtaaaaagcaaagttttggtccatgtgccatcagaagatgccagctgccatatgccagtcagaattgtcatgtgctagagcctcatgcagatgtccacaggatttcaccaggagctctgggatgcctgggaaggggatccagggaagggactggagatgtcaagagctcctgccctgttctcagctgttatggagtcacagaaggtcatacctacatgaaaggcaaggcaagaagtatcccatcctcccaaccccaagaggccctgcccaggccactcactggacaactcttcttgtccacatctgctggttgtggcaccccatccctgggaaatttgctaatttcaaggaattaaagaaaggccagtgagtctgtaacttcggaaggctgaggaaagagatagaaaatgcaggtagaaagtcaggcaggtccagatggatcctctagggccctagagaccatggcagtcctttctgtttactgagactgctttctttggctctggtttcctgggacaggaagagaacagtaccctggactgtgatgggctgtgactgtctaactaatctaggattctggaattcactagccattcaattttatccatacattttgtcagaagatttgaaatatgccctttactttacactcagggccatagctacatgagctattttaagatagtgtatttccttcaattgggagttctgtctctttctggttctgcttttaataataaatacggggtccagtggactgaaattaaatagggtgtgaagaattcccctactgtttcccttctttcctacagttttacagggttgtttgtatccttcagcaggaatataaaaataccctgtatctcctctcctttcgtagtttttattttctacgtttctcatagtctttcctatcctactatatatatgtgtgtgtgtatatatatatatgtgtgtgtgtgtgtatatatatgtgtgtatatatatgccatatatagagatagatccatcttccatctattactatatctataatctccctatatataaatttgatacgtatataatctgtgccatgtctagtgctctgctatattgcattgatccatttggctattgtgcactaattgcccaatattactttatgacatttttaagtctaaactgaaaggaaagctatgctcagtcatgtaatgttggcaaccatgctgcgcaaacatgggtcccctacatcaggggtccccaacccctgggccacggacggccccaacccctgggccacaacatcagattgttattggagcacaaatcctattgtgaactgcacacacaagggatctaggcggcacactccttatgagaatctaatgcctgaactgaggaggaacagtttcatctccaagccatcccccacctgttcatggaaaaattgtcttccacgaaaccagtccatggtgccaaagaggttggggactgctgccctacctcacagaaagcgagtgaccccaagaagcctgcagaagggacttgtcaaacctttgatctctttcaccttcccaccaatacttgagcccctgagggcagaggctggcagcccttggctctggaagtccttccaggtcaacagctggccctggccacttgcctggaagctttcttccctgctctgagggggccctgctgagagtgagcccgccttccagggtggcgcaggccccagtaacccccactgcgctgcctgcgactcgaattctgttaatcagtttgccttgcgtctcccaacaccgacacccagaagaggccgaggcttggcaagcactcagagcagcttctgtgaagctacattacaggctgaaatgagctcagcttttaatttgattttttttttcctgtaacaagcaaagttcacattacagataaattgcccggaaattccaatttaataaggcgtatgcatttttcaggcctagaagcattgaaaacatcttgcacgctagtatttttacactgaaaggtttattaaaaagacagctttgaaaatgtcagaaatttacatagcgcgcctggccgattggtcaaaaagcctgattggacaaaagcgcacggaagccaggaagcgggagagcaggctgttccgtggtcttgagctgttctccctccacatcgggaacgatggctccaccgttcattgtctccacccagctcttagttcatgttacatgggtgctcagcaaatgagtgtccgtctgtcctcctctgtctgcaggtgtgtttctgagtaggagcagcaagctgtccttccagggcatctgtggggcaggcatacctccttgaggtctcccatgggaggaggcaccaaacaaaataagcaaactggccaggtgcggtggctcatgcctgtaatcccagcactttgggaggccaaagcaggtggatcgcttgaggtcaggagttcgagaccagcctggccaacttggtgaaaccccgctctactaaaaatagaaaatttagccaggcatggtggcaggtgcctataattccagatatttgggaggctgaggcaggagaattatttgaacccaggaggcagaggttgcagtgggctgagatcgctgccactgcactccagcctgggcgacagagcaagactccgtctcaaaaaataaaataaaataagcaaacagaggggagcagaaagagtcctgtgaaaactcagttaaatagcacagctctggatacttgattatttttttaaggaggaaaaagagtgagacattgtcctgtaaaatcacccaaaccctggctttccctggaaatgtggcgcaggcaggcctaaccgtgctgagtattgtttctgaggactgcctccgagttcatgtctctaagcattttattgaatacaactgcttctttgacaagaaacaagcaaacatgctaattgtacaacaaaattatggcatcatgggacaaaaaaggaatgacagagggagcatcaaagagcattgcttgtacgccaaacatgaaagccaaatttatttaattcagtttttatttatcttctaaactgagttgagtaatcaggcaatagaatgcggttcatttaaaactttcattatttcaaatatgttgaaccactaccaatcactcctggatcaacaggaaacttgctacctgatgagttgccttttttcttttttctttttttttttttttttttctttgctttttccatccccatgattgttccaacagaaggagaaaagatgtaataaacctttaccgggcaccgtctgcgtccaggcactctactcggccctgggggtgcagagcacaccaccccagccttaggcatgaaaaacactgtgtaccgagaagcccagcccctggaatccagcatgctggtgctacattccagctctgtctcttattaactgggccgcttttgacaagttgctaagcctctctgattcttggttacctcaaccttaaaacaaggatgatacccacttcatcaggttgtcatgagtcacaaaaataaatgtagtgatgctcttaaagggtttagcaccaagctgggcccaaggaagcattctgtgtgtctattgaccaacttttacctatcctgacaccaaggagcttagagtttagtggagatggcagagccgtcagggcccgtgttaggctcccaaaggcatttttaccagtgcatgtgcctcgcacagacctagtgaggtgattaattctactgggaaagtcacactggatgaacgagaggagacgtatgagtggggtcttgaaacagtaaaaatttgccaggtggaagcataaatgactctttaaatgaaagcctggtgtttttaaagcagttcattctcatgagtaattcatcgcttctgttttcacaaaatagtgaaaggatcattgcagcagcaagggcatgtggaagccctgcgttcgcctcatccgttctccccatctgtcccctgtcacagttgcagcatcaaaacattgttcccctaggctctgctgagtcggatgtttctgaaacattccaggggaccgtgtgagtcacatcagggaggacacacagggccatgaccccagtgagccattaacacacccatagcctgactctgcaacggctcccccgagggcgccccgcacaagaccaagccctttgtgtcagcttcagtttgccctcacagctaccccagaacaccactgggactgtccccgagtcacagaggaggaagtagaaacacagagaagtagcttgccaggctcactgttagaacccaggtcctttcctctccagagtccatgactctaacactcatgtgatgctggcaatgtgaacggctggggggaagcagcagagggtgacagcaggccttggcaccagagatccagcctgcgaatcccaaccatgccccatattagccaatgatcttggcaaagttcacatatctctaggcctctcagttcctcatctgtaaaaggggaggaataatattatcaacctcccagggctggtgtgagggctgaaggcatagatgctggaagctcctggagcggtgtccagccggcgcaatgtaaggctcgatgctgctgcagctgtgttactattaatattaaagggaggctgcaccccgaggctgttttaggaaagaacaggccagacgccttccaggaagcatcagcaggagcctctcctggcgtccttctgcagtttgggggtctggtacatccactttgcaggacaaaaacttgatttgattctcaggtcagttcacatgaccccaacacaaaaaggattgataccaacccagaccgcctctgtgtgaattaaatttacaacagcgctgtatcagagcatctgtcaatgctgactggaagcccaaagacctccagatgattggttctgagactccaggagaggctgggaacactcggaggggctctggatggtggccaggcgagggtggtaggtgaattgctgtctgtcctgggtcgccatgaggcttgtggtgactgcatagatgcccattccctttgtcagccagcaatttcttattccctggctccccttctcaacaacccaagttgaccatcccttcttcagtgaccacagcctcccccaggtaacaatcccattgcagcccccaagatgacctttaagtcatggacaagggcagttcttcttctccttggccacacaggaggcatccctctggcttccacctacatctgaataatcccacccaccacacttcgattcaacttaactctatcctcagaggccaccttttctcagaattcgtatcttcttcgaagtaagatccttcaggtgaaacatacctgctgaccacccaccctgagtcactaagttagctgggaagcagcagttttgagtgtgggttcagggtcgcagctccaaggtcagaccacctgggcccacgtcctgactctacgatttgcgtagctgttggtttgtgcctcagagtcctcatctgtaagtggggatattatacctactataataaattagtaatgccacggtaacaaagtattgcaaacatggaggctagaaatttattctcccacagttctggaggacagaagtccaaaatcagtctaactgagtcaaaaccaagacgttggcagggccacgttccatctagaggtctaggggagggtccttcctgccactccccacttctggtggctgcagcattccttggtttgtggccacatcactccaatctctgcctccacggtcgtgtggtcttctccttttctgtgtctcaaatctcctctgcctccccctgaggacacttctgattgcatttagcaaaccacaaacaaccccaagataactcaaaataatctcatctcaaagaccttaactcagctctgcaaagtctttgctctatgaagtaacattcccaagttccaggattaggaggtagatatctttttcccgtgaagactcggggttaacttgctccaagcccttcagttggagattttcaatcctgttggttaaatcaggttttaaacatccttagacccaaatctggccatacaaggcagagaaaatcaacttcatgcatctttaccagtgtaaagattcccatgtcacttcatggggatgtacttcaaagatgggtaggaaatggcagcaaagtgccaacagcatctttctggcttaggtctgcaagtggcacattatccaagccacccaattcaaagaaagctgagtcatgcccagttgagtctccctgatagataagactattatttcttactctatgcatctatattgtttaaatctcaaaagagcaacctcaaaacaagtaacattttaaaatcttggatggtttcccattatccaaagtcaaaaccccttaaaacagtagttcaggttctctataatattgtctaatctgtttctcaaaactcattaacttttagttcccttaaagaaactgtttcaaacacaaccctctactttctagtccctaaatatctgtatattcaacaaatatttagtgtcgcatatgggctaagcagtgttcaagcagctggtgtcacagcagtgaacaaatttcttgccctcgcgtaacctacatcctaatgagtgtttctgttccatctgtaatagtttggctgtgtcctcacccaagtctcatcttgaattcccacatattatgggagggaccctgtgggaggtaatcgaatcataggggcgggtctttcccatgctgttctcgtgatagtgaataagtcccatgagatatgatggttttataaagggaaacccattttgcttggtttcactctctcgtctgccaccacgtaagacatgcctttcaccttccgccatgattgcgaggcctccttagccacatggaactgtgagtctattaaaactctttcttttgtaaatcactcagtcttgagtatgtctttatcaacagtgtgaagatggactaatacaatttgttaactcatattctctcttcctggtttgtctgtcctctcactctctgatgacatcctatctattcctcctgtcttggtttggatgctgcattctctgtgaggtgcccaatattgccctggatcagaggtagtgagttcttcctccaagcattgatgtgccctgcttgtaccttcacaacagcacttctcccactagtccacatacgagatacatctgaggtgtgaaagaaacaagactggacgtggactcaggatttgggctgtgaattctgctttgcttctgtgagagcttggcagatggcaagaacatcttcctcctgggagtgtcaagaggaataaaggaggcacacatgcaaagtgcttaacacaaagcagacccagagtcagtggcctcttgactttgtgaatgagcaactgtaacagaaatgatggttttggatttttgttacctaggatccagcacctagcctaggagctcatgccctgcactctgtaaatgtttcttgaatctactttgaatgcagagtctgacattgtggggatttttttcaggtattctgtttacaaggacccagcaggttggctgaatattaaccccatcaatgggactgttgacaccacagctgtgctggaccgtgagtccccatttgtcgacaacagcgtgtacactgctctcttcctggcaattgacagtggtgagtacttgacaaagaccatcaagggtatacttttctgctacaaatatacttttacatttttaaatttcttctgatacacccaggggtgttcttgggaagaatgtaagtgtgtgggaacagcaaagtaaatgtttaaatatacacatgttgagttcagtaatatctccaagtcccagaatcctcagatctttttggaaagtgaataatgtctggtgagaggtcagagcaatgaactcaccctgtcccatcttgggcaggcgtggaggttagaaagccacgctgatgtgctttgtcttggtgtcatgctctcatttgcaaagaggctcttggacttaatacaagttgaaagtaagtcccagaggacatcactgaccctgaccattgaattgttcttgtagcttttatcctattatgacacgctgccaaggaaaggcatcaggtaccctcagttagtggctgcacaaccacaaagcaattgctgttcgttcaaaagatggtaatgcactatccatatgccagcccctgattagatgctgggggcgcagcagtaaacaaaaagaaagctgtcctcatggagctgacgtgcagaaaggaggcaaagttcaaagtgccacgattgttctctgctcctttgagatcagactgtagggcacaagggcagaaggagggcaacctcttaggagagtgcatggtaatctatgcaagatggtggcctggaccagagactaggaggggatgagaaaaagagagttcctatatactttgaatgcagagctgacaggatttgccgttaactgagatgaggggattccagttggtttggggacatgttaagctgcaatgtgtattgtgtcaatcacacaagaagttttgttctccctattattcctaaaagccagctgtttatggctaaagattcagttttgagtccttccatatcaagatgaatatttataggtgcccattgttatactcaacaagggtgaactaagagttctcagtcctggtcctcgtatgccggctactcacacaaaccattaggagacaagtctaagaagtgagcaatccatgtgacacacaataagtagagagtgcttcaaaataaaggtgagccttggggttagccttgaaagacgggtaggattcggatgagtggcattacccagaaatccaaggcagaggaatcaaaactagaagggggcacagcacaggaggtaagaaaaggaaaaaataactgttgtgtctgctataagtgcgtatgtaggaatctatttggatgtatgtggaaaagtcacatcttcaaagccagatgattcatttgatagaacagggaaccaggagaccctgaaacttcttgaggaggaaactgacacgatgaaatatcaggtagacaatgttcagcaactgagagctggaccagatcttgtgcttggtcctggagactcatggatgaataatacatggtccttgtgttcagagggctcatgaattatttggaaggttagtcaagtacacagaagatcacagtagagtgtcctaactgttctgatggagctaagcccagagaagcccctgtccagcctggggggtagtcatggagagctgcctgagagaggggacatctcacctgcgtgatgaaggatatgtggattaaaggtagggcatgctagttctggtgttgagttagttggcagcttctgattggttagccttaagtttcgtttttctttaacatagtcatttataagaaatagctcatgttggctgggcacggtggctcatgcctgtagtcccagaacgttgggaggctgaggtgggtggattacaaggccaggagtttgagaccagcctggccaatatggtgaaaccccatctctactaaagatacaaaaatgagctgggcatggtggcacacacatgtagtcccaggtactcaggaggctgaggcaggagaatctcttgaacctaggaggcagaggttgcagtgagccgagattatgccactgcactccagccggggtgacagagtgagactccatctcaaaaaaaaagaaagaaatagctcacgttcagttttgcttatgtttgcaaatcaagcaaggttaaggtgacttatgacacctaactggctttttctgcccagtggttcttcaggcctaatttccattttaatttactttaacaattgatatgactgaactgtgtcctctcaatgttgacgtattggagtcctaatccctggttccatagcatgtaccttatttggaagcaggcttgttgcggatgtggttagttaaggtgaggtcatgctggagtaaggtgggccctgatccaatatgattgatgtcttcctcaaagggggaatttgaagacaggcatgcacacagggagaacaccacataaaatgaaggcagagatcagggtgatgcttctgcaagtcaaggagttccaaagattccctgtaaacttccagcagctgggggagaggctgggaggagagccttcctcacatccctcagcaggaaccaaacctgcagatgcttcagtcttggacttcaggcctccagaactgtaagacaatagatttctgtcgtgtaagccactcctttgtggcactttgttatggcaactctagcaaagtaatgcaagatttaatggagtcattacctataaagcatttggaacagtaccttgcttgtagcaagtgcttaacttaactatttaaaaaaaaaaaaaaacaggtaaagcattctagtagaataaagatgtgagaagttgggaagttggtcagcattagtggaagctagcatggcaggttctttgtgtgcaaagataagggcagagaagcgtgtggataccggactgttctaaggttggaactgggtcttgtgctgaatgcccagcacctaccatggtgcctgacttagagcaggcactcacatgcctgtagaataagtcatgaaatcaatcgtgaaatgctccacatgctatgccatggactttggccttgaaaatgtcactcacttgcctccagaataaacattgtgttttacaaagatacacaggcacagtggctcatgcctgcaatgtcagcactttgggaggctgaggtgggcagatcgcttgaggtcaggagttcaagaccagcctggccaacatggcaaaaccccatctctactaaaaaaaaaatatacctcccctccacaaaaaagaaagatacatcctatagcagcatagaaaatggacgcggtgatggcaagatgtgaggagggaggcattaggcagctgccgcagaaatacaggtaagagaaaagagaggaccaagccaaggtagtgaagttagttggggaaaagtcagcctgcagtgggtaaatgtgttagaaaccatagcaggtatcttagttgatggggtcagagtctgcgcaagcataacataaacggaccagaggggaagaacctagataacatctgaaaggaagaaacaaatctttgtcaagagcttatactgaacatgagctagagaaatgcaatattcaggtttctggtccagaaatcaggaatgactatttcatcaacgtaaacagggagtgagtttcagaggactggtccttcttgttttcggagggtgggtgttgagattacgtcccagaagaagctggcaagatagaaatggaataaggagagattttgattagggagttgcccatgcagaagagatgcgacttatcagaacagaaaagctttccaaaaggaagaggtctggacagagtactgagtacagaatcagggatgaaaataagccaagattgtttaaaattctgtgtaaaatgaaaagtatccattactgatcagctaaagtaacaatggcagggttctgtagtatgtagaagtatctgtatctgtggagaaatttctcagcaaagaatgtcaagaagcatggatgaaatatagcgtagcatggctggcatttctttgtgaaattttttgtgcaattataaatccaaagaaactagaaatgcggtatacttgaattgttaccagaagcgagagccttctttacatgtatgcagtaatcagttaagtgacactgtgtgcgtatataccgtgtcccgaatattaagaagaacaaaaccaaaatttgcagattaagaaacagacaccaaatttagttggctttctaaaagtcgtatcattaggatagcatttttctacctttagtttcttgcatttttaacagtctttaaaatttctgtgtggaagcagcaatctggtctaaacttccgccataccacttactagctatctgattttgaagaaataatttacaatgtagtcaggacctaatgataccttacagctgtttctcatctttgagactcattgagtctcatctatgttttctcaacattcagcatacacctgtatgaactgtctggctgtgtaactgtgaaagcttctcacagactgtgagtctcattttctacatatacaaaatgaagaagataattcctacttataacgttgtgagaaatgagtgaagtgctgtaccctctagattctccatcaaaagccatattaaatgttcactacatgttaatcccacccaggtgggggtttcagaaaggaaagaatagagccaggaatgatccttccatgacccaagaaatatacagcttgaaatccacttgttgtctaactctgttaacgctaatatcagacacggaaatttaaaatctggtaccacagatgtttccagagagctaaaatgtccccaaaggtgtaatggtaaatagaaaccaggttggcattaacatacaaaaccatcgttaggaataataatctcgaacaagacccaaaggacttacagcaaaaagaacataaattaaaaagcccttataaatcagagcaacttttatttaaaagctcctttttgcctcaccaaaaacttacctctagtattatgtttaacccggaaaagccaacactatctattagatcaaagttagtaggccaagcaaggtggcttacacctgtaatcctagcactttgggaggctgaggttggcagattgcctgaacctaggagttcaaaaccatcctgggcaacatggcaaaactccatcccgaaaaagaatacaaaaattagtcatgcacagtggcacatgacttgtagtcccagctactcaggaggctgaggaaggaggatcacctgaacccaggtaggtcaaggctgcagtgagccaagatcacaccgctgcactctagcctgggcagcagaatgagaccccgtctcaaaaaaaaagtaaatagtgctaactgatctctcaactttatccaaagtgagcatttgtttttattagttttatagaaatttaatttatttgatggaaggagagaataaggatttttggcatataacactaggaaagctgaaccaaaataaattgatttctccaaacaaagagtaactcaggaatttatgccaaaacatgttgataaaatatatggcttcgggaacttccatgtaggatacagtacggaagtgtccccactgtgaaactagaaaaatctagttaaattataaaaatcagataatataaaaaaatcttaattgtaaaggaatcagggagctgcagaagcattgacaactagataaactaaaataccaaagagggaaaagtcatttcaaaaagaaaacctttttttttctctgggtgcattttctgattctaggtgagagtcaggcttggcccatgcagagagcctaggatggagggaaagaaattagaaacgagtgtcagaatcacagggagcttttgtgacaaactggaaacttgaggggctgcttttcctctgtggacaaatgccctaaaggacagagtgaaatctccttgggtctcacagaaaacagagacctaccaaaggaagcaagctctcctcaaatacatagccattctctcatttaagatatttgccagattttgaaggtacaaggagttaaaggatggggtgtgggatggctggagagttaagatggtaaccactgaagggaagaattggatttcctggagcctttcagactaagatactccagactttcaatcaaaatcccagtagggccatgcccagcaacaggagtaagccagaagttgactcagtcttgttcaacttgcaatgcggcctgacccttttcaagcccttactaagttgatgaagcaaggctccatctgatacagtttggctctgtgtccccacccaaatctcatcttgaattgtactcccataattcccatgtgctgtgggagggacccagtgggagataattgaatcatgggggcagtttcccccatactgttctcatggtagtgaataagtctcatgagatctgatggttttatcaggggtttccacttttgcgtcttcctcattctctctttgcctgctgccatccctgtaagatgggacttgctcctccttgccttccaccatgattgtgaggtttccccagccatgtgaaactgtacattcaattaaacctctttcttttttaaattgcccagtctctggtatgtctttatcagcagcatgaaaatggactaatacatcatcctatctgactaatacaggagagggaaaaactcatagcaccatatgtcatctggagcctctccaatcttttttttaataatgcccaatttacagttttataaaaattacttgacctgtaaagaagcaagaatgtgtaagtgatgaacaagagaaaaatcagactacagaggatccagatatttgaattagcacacaagaacattaaaataaacatgattagtatgttcaaggagacagaataaaagatagattcaagcagagagaattacacaagagatctgaaatctttaagaaggaatcagatagatattccagaactgaaatacatattatcatattaaaaactcagtaagtagacttaacagcagaacacaggatttttaacctggaatatgaatctatagcaaacaccacaagggaagcacagtgaggataaagaacgggaaaaaatctgccaaaagactagtgtgtggaattggagttacagaaggataggagagtgctaatggagcagaaaaaaaaatttgaagatgtaatgtccaggaattttccaaaactgatgaaagacattctccctattaaatcaaaaagtttagcaaaccacaagctggataaatttgaagaaaaacacacctcaaacactgaaatcaaactgatgaaaaacaatatcaaagagaaaatgttaaaaatagcctgagaataaaagaggcatttacctgcaaatgagctacaatatgacttatggctgacttctagatagaaataatggaatgtggaaggcaatggaataacatttctctgagcactttaaagatgcctaccaacctagaattctttagttctcaaatttttcccttcaaaatcaaggtgaattaaagacttttggggcaaaaaaaaaaaaaatggaattgtattgcaagcaggtttatgccttttactgaagagaatatttcaggcagagggaaaatgatgccagagaggcatagaaacacaagaaacataaataaaaatagaaagttaaatatgtataaagtaaaaaagtaaatgaagtaaaattgtaaggacataaggagttaaaaatatttatagaactaaaatgcatgacagcagtaacagaaaaagtgagaggctataaacatagttaaaacagtttctgcagcattggagatgtagttaaagcaatactttgtattagactctaataagtcaagtatctatattgtataacccttagggtaatcactaaaagaatataaaagaaagtaaaactaacaaattaatagaaggaaataggtttgactaatccaaaataagaaaggagggggaacaacattaaaaagatggccaaatagaacaacaaggtgatacagtaagtatatacctaattataccacagtaaaatgcaaaatgtaaacagattaaatatttcaagtaatattatcagactatttttaaaaatcagcaaactggatgctacatacaatagacacactttaaataaaagaacaaagaatggaaataaaagaaaaatataccttgatagtacagtctctcctaaaaacacatgaaagtattttttaaaacaagcttgtccaacccacagcctgtgggccatatgtggcccagaatggctttgaatgcggcccaacacaaatttttaaactttctttaaacaacattatgaaattttttggcgctttttttatagctcttcagctactgttagtgttagtgtattgtatgtgtggcccaagacaattcttcttccaatgtggcccagggaagccaaaagattggacacccctgtttaaaacaagaaacatgacaagaggtaaagaggccatttcataatgatgaagggaggtatcaaaaagaaggacatcacagtcctaaatctgtatgtactggacagcacagattccaaatatacagagcagagaaaactaaaaagagaagtagacaaatctacaatcattgtgggagtcttaaaacatctctcatatcagcttcaagaaaaaacaacaaggagtaaagctgtaaaagatttgaacaaaataattaacaaatttcatcaactaacatatatagaactctgaactcaacaactgagttcattcttttcaaattcccaaggaaaattacctaaattgtttgcatgcagagcatatagaaaagtctaacaaacgtttttaactgcaattatttctagtatatcctccaatcacaatggaattaaactaagcattagtagcaaaatataaccagaaacaccctaactgactgaacataaaacagtacacttccaaataactcataatcaaaaacaaaaatagaaatatgaaatgtcaaaacttgtgggatgcactaaaccagtgctcagaggaaaattctagaaaataggaaacaaatatacaagacaaaatcaacaaatccaggctgggcacggtggctcactcctgtaatcccagaattttgggaggctgaggcgggtgaatcacctgaggtcaggagatcgagaccagcctggccaacatggcaaaaccctgtctctaccaaacgtacaaagattagctggatacagtggcatgtgcctgtaatctcagttacttgggagcctgaggcaggacaatcgcttgaacccaggaggcggaggttgcagtgaaccaagatcgcaccactgcatcccagcctgggtgacagagcgagactctgtctctaaaaaatttttaaaaattgaaaatcaacaaatccaaaagtttgtcctataaaaagattgaataaaattgtaaactcatatcgaaactgttgggcaaaaaaagaaaaaaacacaaattaccaacactgggaataaaaaagggaaaatgactatagccatcaaaaagatacaaagatattatgaacggcattatgcaatatatttgacaatttggacataatggacaagtttccccaaaattaaaacttatcaaaaataacctaaaaagaggctgggcatggtagctaatgcctgtaatcccagcactttggaggccgaggcaggaagatcacttgaggccaggaatttgagaccagcctggccaacatgacaaagccccttctctgctaaaaaatacaaaaattagctgggtatggtggtgcacgcctgtaatcccagctgcactctgtcccaaaaaaaaagaaagaaaaagaaaagaagaaaatcttaactagcccagtgcttatggaaaaaaaaaaaatgttcttgaaaaccaaaaagaaaactacagatccagatggctttgctacatgtttccaaatatttaagaaagaaaaacaattttatacaaacccttccagaaacagaaatagaagaaatacttaatccctctttttatgagacaaggtttttccaaaacctgacaagatcttacaagaaattaaaattgcagaccgatctcactcatgagcataaatttttaaattcttaacaaaaatattaatgaatcccacaaaaatgatatgatcatctcaagagttgcatttgaaaaaaattcatgttgatttctgatttttttaaaataatgtttagcaaactaggaaacttttttagtctagttttaaaaaaaaaataacagaaggagctgctgctacagcaaacatcttcctcaatggtgaaatagtaaaaactttttttgtgacctcagtcccagccagagcgagaaggcaaacaaaagaaatactaggcttaggaattaaaagtaagaaatctctttattcataaatgatatgcctaaaataatctaaaagaattttcagagaatctattactgattttagtaaaggtcatcaggtataagatcagtatacacaattaattgttttatataccccagcagtaagcaaatggaaaataaaattctaaaagatactgtttgcaatatcatcagaaacaccaaatagcaaggtataaatttaaagaaagatatgcaagtcctctacaatgaaaactacaaatgactgcctaagataatttttgtctccctatttaagcccacattaacggagagatataccatgttcatggattggaaggctcaatggtattgaaatgacaattcttttcaaaccgacctgagggattcaatgcaataccatgcaaagtcccaatcccagcatggggatcggggcagaaattgatacactgattataaaatttatatggaaatacaaggagtgaaaaatggccaaggcaatcttgaagaataagttgtagaacttacactaccgtacatatatccagacgtattagaaaaccatagtaattgaaaccatggtatttgcacaaagatgggaacaagctgaccaatgcaatagaatagagaattcaggaagaattccacacatacccagtttctgattctaacaaggaaaacacaacacagcagtgcaggtgagaaagcatggtctttcaataaataaggccaagttgattgaataaacatattttttaaaatgcatcctgaccccctcttaaaccatatacaataattaattctagatatattacagatcaaaatatagaaggaaaaaatgcatattttagagaaaaacatatgagaacatatatgtcctttgtgtaagcaaagcttttcgtaattaggatacaaaagtactaaccacaaaagaaaaaaaaaagatagattacattgaaattaagagctttgattcttcaaatgacacagttaagaaagtaaaaagtaacctacagagtagaagatatttataatacaaagaaatgctgcaggcctggtacagtggctcatgccctataatcccagcaccttgggaagccaaggtgggcagatcacttgagccaaggagtttgagaccagtgtgagtaataaagcaagaccttatctttacaaaaaataaaaaaaattatccaagtggtgtggcacacacctgtggtcccagctacacaggaggctgaggcaggacgatcacttgagcccaggagttcaaggctgcagtgagccatgatcacaccactgcactccagcatggaggacagagtgagatcctgtctcaaaaccaataaaaaaaaaaaaaaaaagaaagaaatcctataatctgtaagcaaaagacacaacccaaagaagaatagataagagacttaaacaaatacttcacagcagaaaatacacaaatcctaacaaatgtatgaaaagatgctcaacttaattaaataaagatatatacattaaattatacaaatataaattaaaacacaaattaatcaaggaaatacaatgaagtgcagtacagcagcatacctataaaatggctgaaatgaaaagatgaaaaatacccagtgctggcaatggtgtgaaataattggaactctcctacacagctggtagaagtgtaaattgggtacagccacgttggaaacatagtatcaactaaagctgaacatacatatgccctatgttccaggaattacatgcctaggtattatctatccaacagaaatgtgttccccaaaacacgagtgccagaatatccactattcataagagcccaaagttggaaattatccagatgcccagcaaaagttgaataataaattgtgatacattcacaaaatggcatctgtacaataataatgagtgaatgaactgcaactattcacaacatcatgggtgaatctcacaaacatagtgtgcagcaaaagaaggctgaaacaagaacacacatgctaaatgactgcatttatataaagctcaaacccaggcgaaattaatcctagccagcagatcaccttgtggatgggtttcttgatctggtagtactagactacatgggtgtgttcagattgtgaaaattcttcaaactgtgtgtttgatacatgaagatttctatgtttcaataagaacctaacaaaaaatgcatggctgcagagagagagcacgtagctagtcctgtaaccattcacatattctcaagtaccttctgagcatttagacagactctcagcatcttgttccaaggaagggcaatccctgtttgctgatgggccaattttgccaggaaaggtgagtgataagagttctacataaggaacaaagcaaagcaaatcatgttccctgcagtccctaccatgctttgcaacgggcagaagtgacaccatcgttaacttgctacacacagctcaacatactcagtttataacaattttaagatggtagcaaacgataactttcctttaaataccccttagaggatacaaactgtcagatcagaatggagtgatgtcaaaagagcaggactgaaaacctgatctgaggttaacagaaataaagagccctttggacctatttgcttggggccccagagctagtctagataatttctagaatcgtgcttcataataattttgataatgcctaggttgcagatgacttgaggaggaaaagacacgttgtaaccaacagaatattcaaggtactttctttaaacttaaaagaaaatccttggctagattacatttcactgagtttagttgagcaaagaacaattggtgaattgggcaacctctcaagccaaagtaagctgagagagactccagcgcaggcatgtagtggaagaagatttatggacagaaaaaggaaaatgatgtacagaaaatggaaatgaggcacaaaagcagctggattggttacactcggcatttgccttatttgaacgctatttgaacagttggccctttgattggctcaaactccgagactggcacgagagtaggtgacagtctgtttacacctccattcagattatagttcactatgtacagggaaacctttaggcggaacttagcatatttaagaaggcagctttaggctaacttgattttacaaactgttatcagtaattttaatgcactataaccagcaaagtggctcacgcttgtaatcccagcactttgggaggctgaggcaggtgggtcacttaaggtcagtagttcgataccagccaggccaacatggtgaaaccccttctctactaaaaatacaaaaattagccaggcgtggttgtgcatgcctgtagtcccagctactcaggaggctgaggcaggagaatcgcttgaccctgggaggcagaggttgcagtgagctaacgccactgcactccagcctgggtgacagagcgagaccccacctaaaaaataaaataaaaataaaataagtaattttaatgagctgtaaattacctaagaacattgtttcaataaaacagaaatgcttttgttttgctacatcaaaactggctgtggccaaatgacttgatgagtaaagcctttaatcctatagattaataagttgtgacctttaatgctggcattttatctttagagatgaatatcgtcatttgccttatatggtccagattttctgaaaggtcaaaatagtgccttcagagtacaggcactcttttatggaagacttcaatgaacacagaattgctgccctctcttaagaaaggataaaataaaaaaaactgttaaggaaaaacccaagcggtagagagaacattcgggaatgcaataaaatggaatccctttggggatgtgctggcagtggagcaaggcagtagcaattagcactggccaaatcccagtgtcaataccactcctgcctacaggtaatcaccagaaaggtcaaatgttagtcgccctgtcttatgtgggctgaaaactgtcacaggcgatttctcgtaagggttctggaatcccactggggacggccacaggcaggaaaggcatcgttggccgctgcttcttggctcactcactccacgctcactgctcagaattctctgagactggtcttcctgcctccttcttactggtaacctaatctttccccctcctcttgcttgaaaattgtgtagggttcattgttccatgattgttattgaatggggctcttatgctctcacagaagacctaaatgatgactgcaaacaatgaagacaaatattttgctccaggaagcccaaatgccctctcacactctgccaagtttaaagaaagacgaaaacaaaaggtgtccctgttagttccccctaaggctcagggcatatgaaatagtttgaacctggcagcccaaaccatctctacggggcccgtattaagtctttatatgattatcaaacgcgtcatattccccatctatttccatttaaaagaacgggggagtgatggcttttaaaacaagccaaattaccactaaattcagcagcatgttttcatgacttagcaacttatataaagtatgtttgagcctgccagtgaaaaatgtgatgtgggttgccaagaagacacacagatatagaaccaggcataacagctgtaaaattaaaatggaatagactaagataatgatttttcataggctaagatatatcatgtcccagcctgtcttctccttcagtcctctgtaagatagatgttccaataatgccagctgattcaaaattgaaatattgttcaaaatatgcttagattgattttttttaaaaattgttattcagccccagagtgaaatgactactgaactactgaatttatagcccccaaactgagggtgggaggggctctgaactgaacttcagaaagatacctcagcctgtggtctttctcttttcatagctcaaccaagctctagactgcaggggggatatagtaagattatttagattgattctacttaaaagatgctagtttggataaaatgaagccattagttatgatggcaacccaatcaagccagtttaacaccccttatctcagctgtgatattaattgaggaggaaaaataaattgatgacccagccatcattccgccttacttcaagcactcgcaaaatatcagtcatgttgaaaatactacctacagtttgtcactgacaaaatggcccaataaaagaactcttaagatctggtaatagtgaggtgtgatcagagccattggaggggcagcacactgggtccactgagataatggagcctagtgccatctacacctcaggatgagttcagctccgcatcttagctgtgcaatgatagccgagagacttacactctctcagcctcaatttccccacctgcagaatgaagataatgccatctgcctgctgggttgttagagggttggaaatcatgaatgcacaattcccagtactcctaagcatataagaaatgcttaagtgaactgacttgaactgagtcatggactgatcttctaagcatgtcattacagaatcatgagtgctgaggcaaactatgaaaaggcacttatgaccaccgtggtggtgatctgagcatttttctagggaatggatgggccatggacccccccacttggacaaggatgctaaatccaattagccagaaaaggtgtccttggacgttggcatcaattcatggagcttgtctctggctgaatgggcaggtggaagcctgacagcaggacatttctacattgatcaggcaaatcaactatcttaaacagaacattttcattcattttttatgcaaaagaaactgattttgacattaaaatactgtcagtgatgcccatctcaaccagttcatcctgccaaagtgtcttttagctggtcccccactggagtcccccttccccagctttatattggcattgccatctacccagtcctcaagcaagaccccttcctctgtgaggctcccaccccctcagcctgctcagcctcctgaagtcagccctttactcttgcatcctgcctgccttccctgaggcccttgccacggctgctcagcctcctgaagtcagccctttactcttgcatcctgcctgccttccctgaggcccttgccacggctgctcagcctcctgaagtcagccctttactcttgcatcctgcctgccttccctgaagccctcgcaatggcctccatgacagtcctggcctcctcactcaagtccattcctgcctgtgcgtctgcatcctctgctttgtatcaaagccattctcctgctttaaagtctttgaacttctcacaaaatagccacaccacttcgtccccctacaacaaccttcatcctctctacaaggtattctcatttctagcacactcaaatgccatctcttcatgaagccttctgatctatccccaggcagttaattatcccaagccacaagtattttattatcacctctcttcctgtgcttgtaacaccatcccacatctgcttacatatctgttcctgccatagcattagcgtttcaagagcaggcacctgtaccattgacattagcacatttccatccaggcagagggtagagtcccagtaaatggttattgactgaatgaataaaatgaaactgtcatgtttaaacatggcctcaaaattaattatttccctttttttcttttatctaaagtcagtggaatggaaaaaaaaaccaaaaagttgaatttttgtacaacagtttagttttacattattgtctcttctaaaataatttttcagcccaaattatgtggataattgcttcagttctacatcaagtatagtatacacggaaacctggcgttatattattgcaaacttattttccaccagactttttgttggcttactattaacatttttctatatatatatatatacacacacacaaagagagagagagagagagagatttctgagatgaaattggcaagatctctattagcaaagcaataaaactgatcttaagtttaaaaacaatgagattctcagcttatagagctgatttgtaaaatactggtgctgaaaaaccatattaaagagaacacaaagtataaaataaaacaaaggataaccttagaagactcctggttcacttacagctttctttttttttttctatttttatcttaaacaggaggtacacgtgcaggtttgttacctggctcactctcagttttaaagcaaaggtgaaggtacatttagagtcctgttcagatgacataagaggcctggcatgtatttgctcacagctgcttattgaaggttcaacagatgcacagctacctagagggaatttggggccatagattgtaccgctcttgtgtccatgctcaagattgctcattagctcacatctaaattgtggctcctctcagatgggcccatcttcctgattatcctcccagaatgtgggcctcaggcttccttgggacactagccaaggtccctctctatgtccctggtatgggcaccctgttctgagtcccagctctgcagacctctgccccaccacacactgttttctccccaagggttagattaggaaggatttgaatttagacagagccactactctcaaaatagaagcaaacttatggaaatacaaacatatatgattacatttacaggaagagccatacatatttgttttttaaatcaaattataggttggcacaaaaataattgtagtttttgccattgcaagtaatggcaaaaaaccacaattacttgtgcatcaacctaagaattcaaacatatgctgagcacttattatatgggcttcctgttttccctgttctctgtcttcctacatttcattgttcacacagacaacctcactttgcacactgtttccaaataaaaccacttgtactcataacttccaaggtaagacatatgctgcatgcctctgggcctacctctgggaagatttgggacaagtggctggaaaagtctactactttctaagacttctcagagctaacttctgaaagtttgtgttgagatcctaacattctgtgcctatgaaaccaacccatctgatatggtttggctgtgtccccacccagaatctcttcttaattgtaatccccacatgtcaagggcaggaccaggtggaggtaactgaatcatgggggcagtttccttcatgctgttctcatggtaatgagtgagtctcacaagaactgactgttttataagcatctggcattcccctgcttgcactcactctgtgctgccaccctgtgaagaagatgcctgcttctccttgtcttctgccatgattgtaagtttcctgaggcctccccagcaactcggaacggtgagtcaattaaacccctttcccttataaattacccagtctcgggcaattctttatagcagcatgagaatggactcatataccatctcactgtggcaagaccagggatcctattcttctaatgggaccctcttgggagaggcatttggagtcttgtcttactggtctagaaattttgtaacatgtatatctagtcctttgtgttccgatgtggatagcagctgatgaggtttggctgtgtccccacccaaatctcaccttgagtggtaataatccccaagtgtcgagggtggggccatctagagtaatggaatcatgggggcagttttccccgtactgttcttatggtagcgaataagtctcaagagatctgatagttatataaacgggagttctcctgcatgagctcccttgcttgctgccatgtaagttgtgactttgcttctcattctccttctgaatgattatgtggaactgtgagtcaattaaacctctttcctttacaaattagccagtcttgggtatatctttattagcagtatgaggatagactaatacagaaacattattcgtaatagacaaaaagtggaaacaactccaatgtccatcagctggtgagtagataaacaacatggtctatccatacaatggattattattcagccataaaaaagaatgaagtattaatacacactgcaacatgtacaaccctcaaaaacattatgctaagtgaaagaatccagacccaaaaaactacctactatatgactccatttatattaaatcttcaaaataggcgaatctgtagagacagaaaattgatcagtagttgccaggggctgggagtgggcatgaagagttagtacaaattggcccaaggtttatttttgggggtgatgaaatgttctaaaagtaggtagtggtgatggtcgcacaactctgtaaatgtactaaaaattaatagtcgcaaaaataaagagtaagaaaaaagtaaagtagaattagaaaaaaatatttttaatccctgcataattctgagtttaacatgttcatggttattgtaaagaaaattaaaaatagataaatgtattattttaatgttaattacctagggaaataatcaccacttacatttttatatatgtctttctaatttttctctaatcatatgtagatttttaaattaggatcacactatgtttttagttatgtctattaatgacaagatataaagcacttatatatatagctactgaacaacagaacctgtgaaaaaaaaatctcagtgttttttagctaagtggaaatcctgtttggtcaaggtttttcatgaaataaaatccctgaaatttaaatagacaaaaaaacacacacacaaattgtaatcgcaataggtttgttaaccaatgcacacagcaaatcaatatgccatgacaccaggttgcagcagagaaacaggtttaatcatagtgttaatggaaaggggtcatgatccagaccccaagagagggttcttggatctcatgcaagaaagaattcagggctagtccacagagtaaagtgaaagcaagtttattaggaaagtaaaggaataaaagaatggctacgacatcgagcagccccaagggctgctggttgcccatgtttatagttttttcttgatgatatgctaaacaaagggtgaattattcatgtctcccctttttagaccatatagggtaacttcctgatgttgccatggcatttgtaaactgtcatggtgctggttggagtgtagcaatgaggatgaccagaggtcactctcatcgccatcttggtcttggtgggttttagccgtcttctttattgcaacctgttttatcagcaaggtctttataacctatatcttgtgctgacctcctatctcatcctgtgacttagaatgccttaaccgtctgggaatgcagcccagtaggtctcatcctcattttacccagctcctattcaagatggagttgctctggttcaaacaccttgaccacagggtcacagaacgagaagatgggagggaacctcaaagccatttccccaaggaagttgaggcttgggtttttgagggctttggagtgggcagaagtgtggagatcaagagtacagggtgaagtcataggaaggggagaggaagcagctgtgttctcatgctgatcctgttcccctgtgggagacttccaactggtggctggaattctggggaggtgtgtctgaaaaacatcttaagtgtctataggaacaatggggatgcaaatcaattcttaaacagtcttctggccttaatgtcagagatcctatctaggggaacggtggggaagcaaatgtcaggatctagtgctactgtaactgaggaactggttagccactcactgcagcagagtccaattaacaagatccaggcctggtacaagaaaagtgaatttatttttgaagctagcttggaaagacacaaagtgtcctgctttaagtgtgctgcttcatctttggagcaaaaagcagacatgtttataaggttaaaggggaagtgagcaagggcaggaagtccccctgctagcctggtgtcttatctaccaaacagctgagttggcatacagttgagttggtgccttcctgggcagaaataagttgtaaaagtggccaagtgggcgtgttttcaccatgtcctcctgaggccaccccagaagtgggagttccgtggagatgtgctttgatctgcaaattgactgtcaattctggagaagagatcactggggcacgtagatgaccttgccttgtagggaatgtgtggtgagggggaggtgagaggttattttgcatttcaaaaagggctaggtaggaagcaggctgaaaggggaaaggagaagagaagagaaaaaagtaattaaaccacctcagaaaaatcagggtacttggttacggtacatgacctactgcaacaaggaactgggccagggtgcagcctgattaacgctgaattataactgtatttgtacccagaacctggcatgcaattcccgtcaaccctgtggggatggtttcaaaacctgaccctgtttctcattgcatccacacccacagcgtcaaagcaatgccaggagaaccacgcgtggctcatgtttcttggaggagtcctggttcagttctacaggcttcccacacaaagcaatatactgttggccatgtaggtaagaaaagcacaggaaactgttttttaccctttctaccagtgtttagtaccaaccacaagcaccaaaatactcaaacttcgagctctgtggctctggctcttatggacggggaagtgctttacaattgccaggcattccattcactttatagaatagccagaaagctccagggatggggatgccctgccagggggccacagctcttaaacaggtgacatgcttgtgactggaaagaggtcccgatccagactccaagagagagttcttagatctcacgcaagaaagaattcagtgcgagtccattaagtgaaagcaagtatattaggaatgtaaaggaataaaagaatggctactccccgtagacagagcagccccaaaggctgctggttgcccatttttgaggttatttattgatgatatgctaaacaaggggtggattattcatgcctcccctttttagatcatagagagtaacctcctgatgttgccatggcatttgtaaactgtcatggtgctggtgggagtgcagtagtgaggaccacgagaggtcacccttgtcaccatgttgattttggtgggttttggccagcttctgtactgcaacctgttttatcagaaaggtctttatgtcctgtatcttatgctgacctcctatctcatcctgtgacttagaatgccttaaccacctgggaaggcagcccagtagatctctgcctcattttacccagcacctattcaagatggagttgctctgatttcaatgcctctgacacactaatgttagagcaccttggacattttccttaatctgagtgtctagttttcttttctagaaaatgagaaaaaactagaatgtagacccccatgtgctcaaagcaacagcctgcctggtttgcttggacttttcctagactgtatgataacaggtgctcgattcctctacgtaaatcttcaccttttattaatcatattaccctgcttctcttagaaaacgcacagttctgccctccctacaccaagatcacaaaaggctaagtgtaagtcatgagccaaccagaccaagagtaacccaggcaggccaggtggccaacttggccatctcataggcagttatcactgctcaacttgaagaaatacaaggttaattattggagtttgaaatccagcagtggaatccatgtggtcctatcgtggtcatataatgtgctgaggctcttacaagttgtcagtgctgagtgggaacgacaaagccagaaacaagggcaagcagaggttgaatgccaggaagaccgtggcagggtgccaagtccatgaagcaaaagcaccgccatggtctaaaaggcatagtcctctagagcaacagagccagtaactcagatccaaaggaaagaaaatgataaccctttccccctcaagacttgccattgtatggcagcaggagggctgcttgcaaaataaataacccaccaacatttgtaggttggagatctctcagtcaagagtgacaggctgtcactgaaaatgggtcggaaggaaaactgtcattcctactaagcaattttaaataggctttgtttccagatatctgtgcctacaagtcctcatttcctcatttggaaatgggatttgatatggttgtattaggaggtaaaattaaaaatatctccttacatcccattcacactgctgcatgatggaattgccaaccttgtaaccaaaacacatgtctttctaataagaagtcaatgacacaagagaaaagagattcctgcagctaaggtttgctcctggtattttccccatgatatcacccaacacaatgtacactctgtgggtggagaaggatggggggtgactttttagcttgtatacttatttgagaaccttaaatgagatgcctattaaactatccatgtatacaaatagactcaatattaagaaaagaagtagtataagactgaaagacatgcttaagagaaaggagggagccatacttcaggaatggagaaatgaagaaaaatctatactggctaaagtcaggttagctaggagggaacatatgaggaaggcccaagtcttatgctgctagaagccagggcagaggcagtaggctggaaaggaccagtggtcatcttggaaatatgtgctccacttgaagccatttggataaaaaataagaattcttagaacactggacatcccagaaacacgataaattagcagaccaaatgccagtctgcaactgctggttaaaaagaaaaatccaattacttataacactgaatataggtcagcagaaactcccggcatcaaagaaactctgaccataaagacttagtgtatatttttacaaaacacttcacagggccttgtggatcaatcatggattcaattttgttctacaaattaaaatcaagccatgtttaaagcaatctcattaagtcgcttgccaacgggtgcacacagtaccacactcctggtgtgacatgaccattcttatcattcatttttggaaccctcctttcatggatacaccacccctcacctcacttccctgcttctgccttacctgtgctttccctgtggcttacctggattatcacaaccagatcccctgcagttttcagccttgccaacatctgaacatgtcaaagaaaaatgggcaggacagagtttgaaaggcaaagcctttattcaaggctacaataagggagagagattgaactaactctgctgaaacaaacaatgggacgatttttaagagctgggatgagctaatggaaaagtactggaagatgtttgtggggaggttggtccatgtgattaggcatctgtgtttgctaatgggtgtttactggagttaggctccaacccttccacagagactgagagacagagacactattcctttccatgattacatttcaaagagatgtcaggtccttgagaaaagtggtcctgggttgcaaaactagcaacaggttggaagatttacatctcacagggacagagaaagaatttacaattgcaagtttctaaagtaaatgcttcaagaaaagagaagtcaaggcctatattagtccattctcatactactgtatagctactactcgatactgggtaatttataaaggaaagaggtttaattggctcatagttccacatggctggggaggcctcaggaaacttacaatcatggtggaaggcaaatgggaagcaaggaccttcttcacatggtgtcaggagagagaagtgctagcaggttaaatgccagacacttataaaaccatccgatctcatgagaactcactcactatcaagagaacagcatgggggaaaccacccccatgatccaatcatctccctccctcaatatgtggggattacaattggagatgagatttgggtggagacacaaagccaaaccatatcagggctctagagtctgaaagaagcccatctaaagtgtagtccagcacaggggaaggttatggccctcttggtcaagcctatctatccttaggaggtaaggaagttcttctagccttgcctcaaacccagggtgagcattagtatatggtgattctcctggtggctgagccacaggctccaacactgttccccagtcatgaggctctaaaccactaccccacagaggcccatttctataataaggtcctgctcccaagcttcctcctttctctccatccttatccctcccccttccctgcctggcatggtcttgtagctggaagacgaggcctcagctctggggtctcatttctgcttcacaaacctccatcagcacagactgtccccatgtggagcccagccccctgctgttatctctgaaaaagatctactcaactctataatcattttcggctactgagctattcgtcctacagaaatagtaaatgctattttactgtgcatggccggtgataccagcaagcctaggacattggtcccagcgcctatcctgcctattgtcctactacagggacaactatgactatgctagctggaaatgatgattccttgggtacccagcctgactatgacacaggctgtcatagtcatttccagcaagcaaaataggaacaggaagctaagaatctcaaatacatttagaatgacctagtcaaatgccatttctttttttttttctttgagacagagtcttgctctgctgcccaggctggagtgcagtggtgcagtctcagctcactgcaacctctgcctcttgggttcaagcgattctcctgcctcagcctccagagtagctgggattacaggcacgtgccatcatgcccagctaattttttgtatttttagtagagacagggtttcgccatgttggccaggccagtgtcaaactcctgacctcaagtgatctgcccacttcagcctcccagagtgctaggattatagacctgagccaccacacccggcctaccatttatttgtgaaaaaaaaataaaaaattccacttacatgggttccccagagtcgtcagattcatagagacaaggagtggaatggtggctgccaggggccaggggaaggggaatggggacttggtgtttaatgggtcagagtttcagttttgcatggtgagaaagttctggagatgaatggtggtgatgttcccacaacaatttgaatgtacttaacaccactgaactgtacacttcaaagtggttaaaaattgtcaattttatgttatgtatatttcaccacaatgaaaagaacagctcataagaaggaagctgtaaatagtaataataataacctggaattatggtttagggattatagcttgctttcatggttaaaatgagagcctgtaagactcaagctatgtaataaaaattctggtggagaaagtataggttaatgcttgctctagagaaggaggcctgacactcacggtgtccatttgagcctgtcctaaatctctctggacctcagcctcaccatacctacaatgaattggcctcagatcttctgctctgatcttgcaccaagcctgggcttgcaatctgcgtgtctgtggactcttcaggtatatttctgaatgcaggtgcgtttctctggaggcaggggccatgaccttcagcagattcccaattggaaactcacctcccaaccacgttgaagacctgaaagctggaatggttcatctgtcagcagtccttacagctcctaacattataaagacagaagcccctacaaactcagccagacccccacatgtttagaagttagacttctctgatccttaaaatggctaccatgagaacatggcccctgggctccctccagaagggagctgcaaagagggagtcccattctagctccatttctgggtgttttgctcaaattgacctgttttccctattgaaagagaaaattccggccaggagtggtggcttatgagccaagatcgtgccacactgcactgcagcctgggagacagagcgagacgctctgtctcaaaaataaaaaaaaagaaaaaagaaagaagtaaaagaaaagaaagagaaaattcataaaggagggaccccgtcttcactgtgccttggttttgattcttggttatgagtggttccatggtggtggaggctgctgatggaaagaggaacagaggggtgagggatttttgctgaaaatctagagaatacttagaagcccctatatttcctgggccccagaaatgattggagccaaatgggcttgtgaggaattttgaaattttgaatttcacctgaattttggatgtgatttttctctatcccgtgcatagaaactgagagaggctctttccctcaggattttgtgaatcttgtctttaactcatcgcccaaagtaacaaactcatcttactaacttcagaaaaagacatcaccagcctggcctgggaataacacataggaaattgaagacagtagtatacttaagttcacaaaaggccaattcttatggccgtatttcaaatgctcataacgccttctcatccattctaccaaatgacttgtcttcataatatattcagagtgaaaaaacataatggattcttccgagatattcaattagttcaataaaaagagaaaaataatttttcagtaaagaaatttaactaaatgactaaaactgacagtgaaaaaccaacttcaaagtaattatgcatttcttttgagtttgcgctctaacgaaagttgatgatatgccaccattagaaatagccatccttcaaatgatcaattgcatttgtgttgctattttagcagacatttatttgaatgtttactctgtagctgtctttgggtgttgatatatttaaatttccaccagccccgctaaagagtatcggctcgcacttcttcatgactcactgctcagcttcctttaagctggttttttccccgttaacagaaacctcttccaaaagtgtcaccagtaacattctccttacaaaatccggttacttctcttcacttcttatcctcgtaggggtcatgacacatttaattatgggtcattgactcctcttccaattctctcctgcaaaactagcatctgctctttaaactttggggtctctcaggattccgtattccacccctctggcattctgaactttcaccctgggtaaccactttgttagagaagtttcaaagccatctatgtgttgatgacttcccaacccctaactcagcctgggcacttccgccaagctgcacaggtgcattgaattcaaggggtcgttagcacaatcaagactgaaccgctggtcttcccacttcccactgcactctgctcttcgggcagcctcatctgagtgcttgatcaccaagaaaagacactgctttcctgctcgagctgcacacatcatgcctctcttcatccatggctggtccgcctgcctgcagggtctcacatttcctatcaatccaatcgtgtgctttctgaagataagtcagatcagattgttcctggatcactgcctttccggaaagcctctggtggcctcgtgcactctgtagaattggtacaggtcccttgtgatgctactcaaggccctccaggagcccatgccatcctcagtgccctcagctctggaggagcagctccaccacggcaccccatgactttgcatgtagagccacatggggagggtatgacctgcagctgcgctgagtcttggcagaacaccctgcggtcccccagccagtttctcattgccttccgggttctgtgaggtgcgggggctttctgcctgcccctctcaggacacagctgctgctgtaaaactgctgagaagcagcttggagttggctctactgcaacatcccttctttctgttgcagttgtccattcccttttattctgccatgacctgcgccaaggccatcatgcccacgcctgcttctactgtctaagtaataagctgtctgcatctaaagaggtctccttgcttctttgctaggacttgcctgcgtcctgtatgccaacttcaaatactcactacccttctaacccccgtgtaacctgatagcctaactgcaaacttaatatgcgtttcaaaacataaatatagtacaagagaaaataaaattatacttggaaatctggctaagtgaaaataaggattagaaaaataaaagaaagccataggttagattagtactgtatagtattagtttattaaactgataagaacagatctgtacttcatcttagccaagaggccaagaaacgattgtactactgtataaaattatggtgctgtaattttagaggtgcttcaaattattttgggaataaggcaaatctgtatacttaaaatgtgtgacctatgaatttggctctaacctttcttgcagaaaattagaaactactaacaaatggtttgtcccaagagcaaacctctaatgcacaaatgattaaagatgaactcagagaaaaatgaaggcaagctgagttttattaacattgtttaatgtttaagtgaaatacattattagggctgggcacaatggctcatgcctgtaatcccaacacattgggaggccgaggcaggtggatcacttgaagtcaggcgtttgagaccagactgaccaacgtggtgaaatcccatctctactaaaaatacaaaaattagctggacattgtgttgcacacctgtaatcccagctacttgggtggctgaggcatgagaatcacttgaaccgaggaggcagaggttgcagtaagccgagaccacaccactgcactccagcctgggtgacagagtgagactcaccaaaaaaaaaaaagaaagaaagacattattagattggtgattatgagggccattatcttaaaatagtatttcctaaaatgaaaaacatttcaggaagtagctgaaatatcaggaaaaaaacaaggctttaaaaataaggtccaaagattatatgatgattgcttctatgcccctgtagccagctagtgatctcatttctcatcactaacccagctttctaaatctgtcctgtccagcagggtcagccatcccagcccccagtggcaccatcagccatctgagactctttttcacccccagaagaaaatgtcttggatttaatctttccctctttagtcaactcctcagttagagtagagctacagcagtgaaaccatggccatctctcacggagactccgtcctccccctgccaccaacatgtgtgaatacctggctacttatgtaaaagatttaatttgataagtgaggaaaagtcatatttatctccattctttgaatagatttcagtgtgtgagaatgactttttagtgtgtgtcagaagcttagtattctaagggtaaagtattaagcctaaagaacttcaatcagaagtcttaaggccggatgcggtggctcatgcctgtattcccagcactttgggaggcctaggcaggcggatcacgaggtcaggagtttgagaccagcctggccaacatagcgaaaccccatctgtactaaaactacaaaaaaattagccgggcatgatggcaggtgcctgtagtcccagctactcgggaggctgaggcaggggaatcgcttgaacccgggaggcggaggttgcagtgagtcgagattgcgccattgcactccagcccgggcgacagcgcgagactccatctcaaaaaaaaaaaaaaaaaaaaaaaaaaaaaaaagtcttatatatgataaagggctttgtaaaccactaaactttataccaaaaaaatctattattgttagtcttgtttgcaactattaataacaactgagaaatgggctgggcatggtggctcacgcctgtgatcacaacacttttggtgtctgaggcaggatgattgcttgacgccaggagtttgaaatcagcctgggtaacatagtgagacaccgtctctacaaaaaatacaaaaattatcctcttagatgtaaatgctaaaaaaataaagttagccaggtgtggtggcgtgcacctgtggtcccagctacttgggatactgaggtggtaggattgcttgagcccaggaggttgtggctgcagtgagccatgatcgcaccactgcattccagtctgggcgatagagtgagaccctgtctcaaaaaataaaataactgcaaaatatactaagtttacaatgcaaaaagtgctatggtaaattgctctcgcatataccagttgcataccaacatcttccctttttcccacaggcaaccctcccgctacgggcactgggactttgctgataaccctggaggacgtgaatgacaatgccccgttcatttaccccacagtagctgaagtctgtgatgatgccaaaaacctcagtgtagtcattttgggagcatcagataaggatcttcacccgaatacagatcctttcaaatttgaaatccacaaacaagctgttcctgataaagtctggaagatctccaagatcaacagtaagtctggctaaagcatttctgcctattcttccagctttcagtttattttctctttcccaaaatgctgtttctctactgttctctcaagtattctcatttggttcattttaagttattggcatattataaatactgagaattttcccaccaacaaacaaatgcaatttataaaaatattgaatatctgtttcaaacacagacattttctcttctgcttcctctctgatattttctatactgtacaccctgtgttgtatatcctaacctgtctgctacatacactatttagtataactccaatattctatctttaaaattttcatatatttagggggcacaactgcaggtttttacatacatacattgcatagtggtgaaatctaggcttttactatccccatcacccaatagtgaactttctcttaactaatctgtagtttctgccatcccagagttcccagccacaagactgtgattctttgttcttcctctttctcttccttttttcttttaattaaactccacagattctttgtttgtaactagcttacaaagaatattggccaacctgcccagtctcagaccttgaaaagataggagtctctgcttctccccagctatctcttggctcagctgtctttccagtctcagagacagagaactgtgttaacattaactttcaccagcgcattggagaggcttttcgtggtgtacctgctgtcataaaagactaaaggaaagagaagtgctaggataagaatctttatagtcttcaacctccaaccttccatagtacgctgcagacctcctcagacttgacttggtttaatgatgaccttgggttttttttcaaatccttggccaccattgactttgatgtcttcttccatgcatcttctttctcctttataaaacttgcaagcaatgtctcctcccacaagtccttccacataggcaggtggaattcaaaacttaacccaacttctatcacttgccttattaagactgaaacaccaacatattaatatggagtatccctatatccacaatctcacccactttcttccccaaatgtaaactaactaccaagttcaccttgtcttccaataaagtaaaagaaaaaagaaaaagaaagacattagacactatgtcttcaataatatacttatcctgctgttgaccccgtcagggttcccacttcttatgtcagtggtagaacttttgagggagacagagaattacgcatttcattaggttttgcaaatgtattgtacaattgtgcataacattttctatttaaaaatctcatatctattgttatagccctatctcatatctcatttttttagtgccttttgcttgttattgattctatttgcctgtttgtctattttattgctttttaaataatgaattctgttatactgattatttttaattaaaacagaccttctcttgtttgaggggttagtgttttatttgctagtttttatggctatagcctatttgaataatcatctccagttctttccaattggaactttctcattcaagagtttcttttttgggggcgtgcagaggggggtgagcatcaggataaatagccagtgcatgtggggcttaatacctaggtgatgggatgatttgtgcagcaaatcaccatggcacatgtttacctatgtaacaaacctgcacatcctgctcatgtaccccggaacttcaattaaaaaaaaaaagaagaaaaaaaaaaagattgtatcctctactaaaggaagatgggaaaatgctgtttgatttaatctgccatctcactaggtgagcatcacattagtcattgctgctcctgtcaccttctggtaatgatcatgcttcatgtatttttatttccctgtcattactctcttgttttttctcctggttttacctaatagataaatgccttctaaatgattttgttgtctcacagtttttttttctgaatatttagccctgtttattcccagaaaggggcacttaaaaatacatatgaccctaatcatgtgagtgactttatctcaaggctaaagaataggccagctggtgcagccactgccaagtgtcacccaggggcctgggtgatggtggctattgccaccgcacatgacatcagggaagtggaggggaagcttaaagatccagtctctatgttgcgggttcccacccaaatgtagagctgtggacagaggattgatcaaaaaaaacaaaaacaaggctggactcagtggctcacacctgtaatcccagcattttgggaggccgaggcaggcagatcacctgaggtcaggagtttgagaccagcatggccaatatggtgaaaccccatcagtactaaatatacaaaaattagctgggcatggtagtgtgtgcctgtaatcccagctactcgggaggctaaggcaggagaatcatttgaacccaggatgcggaggttgcaatgagccaagattgcaccactgcactccaggctgggcaacagagtgagaccctgtctcgaaaaaaaaaaaaaaaaaactaaagacaaaaaatgtaggctatagaacccatctccatgataacacattagggtcctgcccacattgagagcaggtggattttcaccttagctttctagatgtggaacgcagtctttgtcaagatggctttttcgtgtaataaatttgcagggaggagttcttggtaatcaatcatcttcatgaaaggagctctccttgaaactgattataatcgcgccgaggcacagaactctggtgatggaaacactctgtctctgtgttgttcattacaggagccagcagccatgtgtggcttctgggcacttggaatgtggcaggtgccactgaggatctgaactggtattttcacttgatgttaatgaatttaaatgtaagcattcgcacaattataaatgaaaatgcaatgcctgtttggtgtgactttcatcaccaaaacctcactcttttattggaaaaagtctcatccactctcaccagaaccctccttgcctttacagatacacacgccctggtaagccttcttcaaaatctgaacaaagcaaactacaacctgcccatcatggtgacagattcagggaaaccacccatgacgaatatcacagatctcagggtacaagtgtgctcctgcaggaattccaaagtggactgcaacgcggcaggggccctgcgcttcagcctgccctcagtcctgctcctcagcctcttcagcttagcttgtaagttgacctaactccagtgcatgcacaaacaggaaattgtaacttcactgggttcgtgaagccagcattttcccatatacctttccaagaagatgtttcccagaagaatcattcatctttagtgtatgtctgtatgatagaacatgttatatgtaaaagtgctcccactgatgtttaaaggcatcttaacaatccctgccagccagtctgagggattgtgcaaaggtgttcattgctagcctgcaaactaggtggtaagcaaaacttcctacagctgccactcaacttgagctaatgaaaatgcgcccagattagttaactagtctatcagaggcctgtttctctctacattatgcagaataatcttttgcaaggttaaaacagatattatgagactttctgagaatagtcgtgagaatttatggatggagggtgggctgcagggaaaatgataaatgcataatttacactgttttttcactggctagtaataatgactataatatcatgaaacattgtttttaacaaatgaattattatgccaagtagtatagatgtgaggataaaattaataaatacatgtctcagatattccttatttatgaaatactagtccaatgttaactttagccgttattcatatataactgttaccatccaaaagccttttgggccttgcaatttaccttttgagaacgtatcggtgtaattgtgaattaggaagttgggaaattgacagaaaaagaaaacagaaggttttttatcctactgacagtggtgagctgccaggaaatcacatagtacaacattggacattcacgtatataaagctctgtgcaagaccagagtcctgtgagtagaaggaaaaatgaagggccaggcacggtggctcacacctataatcccaccactttgggaggtcgaggtgggtggatcatctgagatcaggagttcaagaccagtctggccaacatggtgaaaccttgtgtctactaaaaatacaaaaattagccagccatggtggcacatgcctgtagtcccagctactcgggaggctgaggcagcagaatcacttgaacccgggaggcggaggttgcagtgagccaagatcatgccattgatctccaacctgggtgacagagcaaggctctgtctcaaaaaaaaaaaaaaaaaggaaacaagaagccattatagcatttcactggcccttcagactgggcatttctgaaagcgaacatatcatcttcccctcctgacctgcccctctgcctgacttgtctctgatgactgtaccaccaccatcatcatcaccatcatctccatgtctccttcctggtcttcccactgcaaagcccaacagagtctaagggtccaacactttccatccatccctgcctccaccctcctgtctcaggtactaatgtcacttaacctcgattatctcactggctttctaactttatcttctgcaaagagagagagaaaatagaaatcaagaggccacccctcggaggcttctcctgagtcttttctgtaaagcagagacaatttcagatgaagggttagagatgggagtggggactgagaagaaattaggaaaccttgtcaaagcacagataattcggctgtacagcaattgggctaaacgttgagcaggggtggtccagaggagtttgtatactgtcttagtccattcgggctactataacaaaataccataaactgggtggcttataaataacagagatgtattgctcatggttctggaggctgagaagtccaagaataagatgctggcagattcattgtctagtgaaagcccacattctggttcacatatggcgccttctccctgcattttcacatgatgggagaggcaaggcagctctctggggcatctcatcccatcccatccatgaggacactgacttcctgacccactaatttcccaaaggcccaccctcgtagtaccatcaccttggggatcaggtttcagcatataaactttggaggggcacaaacttcagagcatagcagataccatgaatttatagcaacacattatgcttgtttgcccccttgctttgctgacagatatcctagacctagatttctagagtgtaggaatgttcccttcgtgagggtatgctgtctggggcctggtttgctgagtcatcactagcaacctgcaagtcactcttgcatagtatcagctggggagatggtggtggatctcaagtctggctgcacaacagaagcacctggggaacttttaaaagtagctacccatacctgagccctaccctatggctggaagggcagcttagacatttgtccattttaaagcctcaccaggtggtccgaagacactgggaaatcaggaccgtcctggtgagtgactccaacgtttaggtacaggctcctggacattctaacagtgtcctccaatcttgtccccaccctaaagacgtgctggttccttcggttcacaactcaataggaaacaggtggaggagagtaaagttaagaatacaagtgtgaagatgtttgctaccgatggtgccagaaaacctggcaccatccctcctccagagaggagggtacggtgagatgacagaacacatccagtatgagaatttctatagcaccaactttccagaaagtgtttcagaagcttacagaattaaaatgtgaaccagacaggaagttaaacttgacaaggaagagaaaccaactaggaagagttggggatggagttaactgacactaaatttggcctgagcttctcattggcttgccgtacacaattgccactgtgtgataagagcaacgtgttaattgcagtggtagttcctaaatgctgctgcacgtcagaaccacttaggaaacattttcaaactacgaattcctgagctcagtgccctagaaactttcatttgtgctctagattacgacttgagcttgaggaatagggcgttggggaatggtaatgaatggacgcatggacagacagatggataaatgaaaggaaacatatttctccctcttttcttttgttctttttttcttctttcctttgtctttcttttctttttttcctttatttgtttacttatttatttatttttttgagacagagtctcactctgtcgcccaggctgaagtacagtggcgtcatctcagcttactgcaacctccgtctcccgggttcaagtgattctcctgcctcagcctcccaggtagctaggattacaggcatgcaccaccatgcccggctaatttttgtatttttagtagagacgaggtttcaccatgttgtccaggctggtctcaaacccctgacctcaggtaatctgcctgcctcggcctcccaaagtgctaggattacaggtgtgagccaccacacccagctccttcctttctctttcttcagaaagtaaaatattacaggcaaaggtaaaattgcctatgtttctctgcccaattttattttctgttctctctcctcagaaacaatagctaccatgaattagctattcatgtgtgtgtccagatgttttatccttttactacacacaaactgacacatacactcactcacacacattcacacatgacacatacagttctattttgtgcagtttgtaaaacctcctgtaattcatattatattgggcataccattctgcgacttacttttcttcctacctgtgttacattcacaaggtccatccacgttgctctaattcagcgttcagcaaactttttctgtaaagggccaggtggctttgtgggccatattagtctctgtcacatattcatctttattgtttgtttgtttgtttgtttctgtcttttgtaccaccctttaaaaacgtgaaaacccttctttgcctgggagctatccaaacacggacttgaggttagagtcagcccacagcgttccttggctgaaccccgctctgctccatttactcctcctgctggaggatcctgtcatttgaatacggtgcagtggattcccttatcagcagacacattcgaatcatttactatgaccaacgctactacagtaagagatctacgttttccaccagcttctggagtgagcgccagacagaccacaagcccagcactgcccaaagaccagcacttagaagccactgctctacaagcaatgcttgcagctaggtgcggtggctcacccctgtaatcccagcactttgggaggccaaggcaggcagatcacttgaggtcaggagttcaagaccagcctggccaacatggccaaaccccgtctccactaaaaatacaaaaattagccaggcgtggtggcaagcacctataatcccagctactcgggaggctgaggcaggagaatcgcttgaacctgccaggcagaggttgcagtgagccgagatcacaccactgcactccagcctaagcgacagagcaaaaaacaacacctgcagagatccaggagcaactggaactcaagaataacagagtttggataaatcggagagcagtacttcctatgtgattgcaaagagataaaaattctatgtgtgtgtagtgggaatgcatatacacacgtacatgtatgtttgtgtgcacgcacgtgtgtgtacccagaaagtagacaattaagggggttacatcacacattgccctctgtaaatccaatttctgaacatcaaagcctcactccgtgacatctctttgaagaacaaaggcactgcaggaccctgctcacggttcagctactcgggactggaaatgagtgttttaaatggagaccagagccgctgtgcacctgcttgttaaaatacagatttccaggcccatccaacctatggcatcaacatcccaggtgacaggggcctctagctcaaagcccagtgtttggttatttttatacaatatttttataataatacacattctgctaccaacactccccatatattaagtattagtaaacattgaatttttttttttagattaaaaaaaaaagacttggcagtatttttttcttaccaacaagggattttcttgtggtcctcactttgagactcctgatctacagatgacaatcatcagcaggttgccaaggatttcccacttctcatctctcaactgagctcttgggtcaagttaatctaaggcagaattgcctgataatccctaaagaattgcttcacagttggtatcattgataaaagacaggcacaggtacactagctgtgaaataccaaatgtgctttatgtgctcgtctaaggggagccatcccatctagcatctgatgattgtatctcactgtaagtaggggcacctgtgtgtaaagtcgaaattattcccacagtgaaactctggatctccttgtgtagctggaaagtattcagttgacactccaatggtttgctgtacaaagacagtagtttcagcccccaaaaaacagttaaaaacaggtgttaccacttaccttcaaaaacacacttggtctggtcatgtgtaaaaggcataagattttctaatattgttcatttaaatgttagagatgcctgccaaatgtcatgatttacgttttattatatacctagtccaagacattcttcctaaccaaaaagggatggacataataagacatgtaagaatctgggtcagaggtagcaggaacaggtaaccaccagtgcccaaccactcaaatgcataaaagcagacatcaaagtggccgacccacgtgtgctaccatttatatgacattgagaagaggctgcacagaagtgagcttaaacccttaagcaaggattggagaaggaggagggtgatttcaaaaaacactgaaattagtagctttctttttttttgtttgtctgttttgttttaagactgagtcttgctctgtcacccaggctggagtgcaagggcgcgattttggctcactgcaacttctgcctcccaggttcaagtgattctcctgcctcagcctctgaagtagctgggattacaggcacctgccaccacgcccagctaatttttttgtatttttagtagagacagggtttcgccatgttggccaggctggtctgaaactcctgacctcaagtgatccacccacctcagcctcccgaagtgctgggattacaggcgtgagccaccacgccaggcctgaaattagctattaaagtacataacttcctaactcagccatagtccttacaagaattttgggagcaaggaaatcagctggtagaatctctttgatgtttctttaaagcagggtcagcaaactctaagacacagaccaaatctggtctactgcccatttttgtaaataaagttttattggaacacagccgcgcctatcatttccatatcgcctgtgcccgttctctgctgcagtggcagagctcagtagctgccaccgagaccagctggcccaagaagccgaaaatattaactctctggcccttcccacttcaaagcatcattcataaaacttcagtgtgatgtaggagaagataatcacgtcacattcatggcaagaaaaaatactcagatccaagtagactggcagcaaccaaacatgctgatgtgtggggctgttttctgtattttcttcagtggtctggcagttgtcccattttctagatgagaaaactgatcctcagaaaggtctccaggtgagtaatcagcgaggccagcattcaccattgactgcctcccttacagaaaaggataataacaacatttcagtttagtatgacctgatcctgtaggtggctttactgcaactgagagttgaactgaaggatctgcatttctttctttgacatctgaaaataaaggaaataaaactactgatattgaaagtaataaaaaatgaaaatgaaatgatttttactgtcagttttttttgttttgttttgttttgttttttcacagagtcttgctgtgtcacccaggctggagtgcagtggcatggtctctgctcaccgcaagctccacctcccggattcacgccattctcctgcctcagcctcccgagtggctgagactacaagcgcccgccaccatgcctggctaatgttgtttttgtatttttagtagacatggggtttcaccgtgttagcctggatggtctcgatctcccgacctcgtgatccgcccgcctcggcctcccaaagtgctgggattacaggcgtgagccaccatgcctggcccggttgttgtagtataaagtgcatgtcagtggcatgaagtggatgtgtaattcttcccctagcaccctcccagtgaggcaagccggcattgccattaagctgtttctgtggtttttctagcacgacttttatggtatggcaagtctcaaaaaaagaacttgtcgggaaaccatttctgaccattgctttctgcttaattaaccagtattagcaagaatgtaaaaggacagatcaggtgaactatcttaacaaataccaaaagtaaatgtctctatatggagggtaagatgtagacaaactcagacacaataaagaaatttaaagaggggagtgggcagggcacagtggctcatgcctgtaatcccagcactttgggagactgaggtgggtggattggataaggctgggagtttgagaccagcctaggcaagatagtgagacccccatctctgaaaaaaagaaaaaaaagccccaccccatgtcagctaaaaattaacattaaataaaatgtggaccaggcacggtggctcacgtctgtaatcccaacactttcggaagcctaggtgggccgatcacctgaggtcaggatttcgagactagcctgaccaacatggtgaaactcatctctactaaagctataaaaattacctgggcacggtggcacacacctgtaatcccagctactcaggaggctgaggcaggagaatcgagtgagcttgggaggcagagggtgcaataagctgagatcatgccactgtactccagcctgtaggacagagtgagaatccatctcaaaaaaataaaaataaaaataaaatatgcatgcctggctgggtggggtggctcatacctgtaatcccagcactttgggaggccgaggtgggcggatcacaaggtcaggagttcaagatcagcctgaccaacgtggtgaaaccccatctctactaaaaatacaaaaattagctgggtgtggtggcacacgcctataatcccagctactcaggaggctgaggcaggagaatcgcttgaacccaggagttggaggttgcagtgagccaagactgcgccattgcactccagcctgggcaacagagcaagactttgtctccaaaaaaaaaaaaaaaaaaaagccaagatgagcaaaagatagccagtaaacacttttaaaattttatttttcaacgtattgtttgcataaaacaaaatgcatccgttgcaagtgtacagtttgatgcattttggtaagtgtacagaattttataccacgccctagtcaaaatacagtttcctttgctattgatcccctttccgcaatccaggctctcattgatctgctttctctaataatggctttgtcttttctagaatgtcttaaagtgtaccagtattttgttcctttctattgcgaaacgtattatggacagacacggcctgcaaaggcattaaacccaggtagagtgggctgtcttcggcctgcagacggccgcggtcatgctttgcagaggagctgtggccccttaaagtgacatgacattatggacaatgacagttgatccttgggggctttccatgcaccttgcgcatgcaagctaagggctttacataaattaaataaatttcctcaagtaaccatctcaatagccctgggacgagtcacttatgttatcatctaaattgacttaaaacaggaatttgagactctaatttgaaaacaagagattggagcctatttagtggattttatgcagccaaagatgtttcttgttgttgttgttgttcttgcttttaactaatttgcctcccaggagacagttgaaatgtctagagacattttgattattatgcctggcaggacgccactagtggcatctagtggatggagggtaagggtgctgctaagcgtcctcccatacacaggacagcaccccccacaaagaattatccaaccccaaatgtcagtagtgctgaggctgagaaaccccactctgctctctaaccaaaattagacacagaaagtggagacattctaccaccctgacaacatcaatggcttttgcccatttaaaacaagaaagaggaatatgtatccaacccaaaacaacatcttaacattctttctaataggcttttgcaaaaatagttcatattttataactgtcttgcagcatggggtataagtgtaatcattgtaaaaatgaaacctaatcattgtaaaaatgaaacctaatcatggtaaaaatgaaaagagtgcctcaaaacatctgaagttcttagcagagggcagcctgtcttcagtgggcacttttggatggaggcaggactagggtatcagtaggagtgagaacaaaggtcagaaaaatgagtacacagcacatgtatactgattaatttctttcttttttccttcttttgatggagcaagactgtaacagaagcctgagagtgaggaagggctttgccaactattactgtagacacagtagtttactcaattttatgaactcttagtcctgggctggaattcacgcctctgctggaattgcacagacaaaacgtgcttgcgaggagtaaggtggcaacaaaagaaaaatgcaggcaaaaacacgcctcattttgaaaccggatctgagcatcctagagccagagcctctcccagccaacattgctgagttgagcagagtgacagactccacactggagccagccccgcagctggccataaggaggagccacgagcaggtgctgggaagacaggctcttgaacgcacactatgctgatgtctctttctgtgaagttttctacatgagtgacgttctcaaagtctgcaacacagtctgccatgagatgccttttttcctctgggaacacaatgctactttcgtgattggctgagtaatggcccccaaagatgtactcttcatcctaatccctggaacctgtaaacatgttaccttatatggcaaaagagacttcgggcaggcacctgtcatcccagatactcaggaggctgaggcaaaagaatcgctcaaacctgggaggcggaggttgcagggagccaagattgtgccaatgcactccagcctgagcaacaaagtgagactctgtctctaaaaaaaaaaaaaaaaaatttctcagatgtgactcagtgaaggattttgagatggggagagtatcttggattagccaggtgagcctgatataatcacagagtccttataagagggacaaaggaagagtcgattagaaacagaccatgtgatgacagaaacagagggaggtcagaggtgaaaaagagaagatgctgcagtgctgcctctgaagatgaaggaaggggccatgagccaagggatgcaggcaacccttagaggccaggaaaggcaagggaacggatgctttcctagagcctccagaaggagcacagcctggtcaacactgatttgagccccataagactgagctcagtcttctgacttccagaactgtaagagaatagattcgtgttgtttgcactttatggccatttgttacaggagcaacaggaaattaacataccatgtttgggccaggtgcagtggctcacaggtgagcctataacccccagcactttgggaggccaagatgggaggatcgcttgaggccaggagttcaagaacagcctggacaacatggcgaaactccatctctataaaaaatgcaaaaattagccaggcatggcggtgcatgcctgtagtcccagctcctccggagactaaggtgggaggatcgcttgagcccaggaggcaggggttgcagtgagccaagattgtaccactacactccagctggggcaacagaatgagaccctgtctcaaaataaaaacatatcatgtttgaagaaccaccaataggtatcttgctctgtgacttgtgatccttaagtcaacatatatatatatatatagtcacaggaagtcgatacatatatgggataatcaccaatctctaagatacatagcatgctcataaaatagccaagctctgtgctgagagacaaagacataaggctcattggtaacggtggtaatagcagctctcggtctgagcgatgtttggcatctgaagtcaccattagcattttcagagaagtccagctttttaccatataaccattcattctgtcttccaatgtgatccttaaggaaaaaaaaaattcccccatagtcgtgtgatgtttaaaatgtgtttattataccttgcctgtcatttttctggcttttagctaaaatgttttgaattgagtggtgatattcccgacttaactctgaaccctctctattcaggtctgtgagaactcctgacgtctgaagcttgactcccaagtttccatagcaacaggaaaaaaaaaaatctatccaaatctgaagattgcggtttacagctatcgaacttcacaactaggcctcaattgttccggttttttattttctttacaatttcacttagtctgtacttcatcattttgacagcatcttcctccctcctttaattaatggaatcttctgaattttccctgaatgtttaaagatcatgacatatgacttgatcttctgggagcaggaacaatgactactttttctggtgtgttaacatgtcgctagccagtgctccaggcacccagctttgtctgtgggttagtattggtgtatgtatgagtatctgtatgtatatatacacggtatttatagagagagactatcctggagaagcctcgttttgatgccattcttccttgcaaggttaagcaaggtgggtggaaactaagacacctgaaccctccagggcctcccgcatcaaggtcagcatgaggacagaccacagagctgtcacttttgctccgaagctacttctccactgtcccgttcagtctgaatgctgccacaaccagccaggcaggtccacagagagggagagcagagaaagaagtcctttctctttattgagttcgaggactacaaccaatttacactgccatctgatgccgtgatcctgagccaaggaggtgaggagcagagcaggcaatttcaccaccaaatgccaagaaaagggctgacattttctttcatgggcaccaacctgcatttgtatgtgtcccgaatccacagtcgtactgattctaatggggacacagatcatggtagagaatctctccctcctcagtaaatgtacaactgcacctgtcatcatggaggtcatacatgcatacaaagaggtgtacaggtaccatcttgtatacacatatatacccacatgtacagacatacatttatgcacattcacgctgtttgtttcatatatacaggcataaaatagagtaaatacaggtagttttaaaagtacccttttgtgtgaattgactaccgttgtttgcaaacccgaaaataaaagacgttcattatgtatgaaaagtaactgatttgtattctgtgagcatgtaaaagcggaaagttagtgcttgttctaagattaccttcttgttgataaaccataaatgaatcatcaaagctcacaccaaatttttctatcaaataaaactagtgacagcttgtggctttttattagagctcgccacgaactagggtaaggtgagtgtcttagcatattttaatgcagttgcttactaaaggttttaaccgcacatgcacacacacacgctttcttatgcaatctatgtttgcacttgtgctttcagttagccttctgtaggaagtagaagtcatatgttgtctttgttgtagtgaaattatacagatagagttccatatattgtatttgtttcaatggtaaatccttttggaacatatagaatgcagagatttttttttccattaaaataaatgggtattggtggttaaaactgctggacagtaa

SEQ ID NO: 2386 - DNA, 1169818 bp, Homo sapiens; identical to SEQ ID NO: 2385

SEQ ID NO: 2387 - DNA, 1169818 bp, Homo sapiens; identical to SEQ ID NO: 2385

SEQ ID NO: 2388 - DNA, 1169818 bp, Homo sapiens; identical to SEQ ID NO: 2385

SEQ ID NO: 2389 - DNA, 554233 bp, Homo sapiens
caacagtccaaagaagcaaatgggatgccacctccgcggggctcgctcctcgcgaggtgctcaccccgtatctgccatgcaaaacgagggagcgttaggaaggaatccgtcttgtaaagccattggtcctggtcatcagcctctacccaatgctttcgtgatgctgctgctgatctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtagggaagaggggctgccgggcgcgctctgcgccccgtttctgcattcggatcgcccggcacgggcagggtgagggggctttcggggggtcggggcctccggtcgcggcggcgaagacagatcggggctcggtagggaggtcattccgagcccagagatcctaggcaccccccacacacaggctcccactctggcgtgcgtgtgtgtgtgtgtgtgtgtgtgtgtgtgtgtgtgtgtgtgtgtacgttcgttaacgggaggaggagagagctcccagtccttttttgctagcaggggcgacattctcgcccacatcaagtggggtaactttggttccctcctccggaggctcggtgcattggagaaagactcagttagaggcgactccaacgagccgcggttttccccagcccaacgcccagcggccgaagcgctgctcgggtccggattgcgggatgcggggctggagaggccgagcaggcaccaccgacttcccagggcgcccgggccccctggtacagcccggctgcccgctggaaggcgcctcggggcagcagagagcctcagcccggctgctgctgtcgctcaaaggcgccggcgccggccgcacccgcatcggggtccttttgctcccagaccccgggcccgaaagggccggagcgtgtcccccgccagggcgcaggccccagccccccgcacccctattgtccagccagctggagctccggccagatcccgggctgccgcctctgctgccttccctgagcgggagcggagcgcagagaaaagttcaagccttgcccacccgggctgcagctgcttgttaaccctcagagcgccacggcgcgagggaagggcacgccaaccaggagagggggcgagggagatgcggtccgcctgcagtcacctctgcacctcagagatttcgggaagtttgagtgcaggaaagcagcgctccgaggccaggcctggggtgctggccgctgcggggggcacgccctgcgctgctcaggggcctgtggtttcggagagcaccccgatccagtcccccatcgcctctctggcaggcgttgggacttggagtgagctggcagcctgcaagtgggtggataagagccagggcagggcagggccgggcagagtaaggagggaaagagacagggagtgcctcagggtgctaggaatgagtgttgagttcctggccggggtagaggctcaggtgagagtttgcgggtgaaaggcaggggaagggagttgggttcccaggtagggactgtctgggatggggagactggtgcagacttctaagggagaccactgttagagcaatgttgggtttagactttggaaatgggctaacatctcagaaatgcagtgatgggtgatagtaccaggggagattcaagtgcccggctgctgagcccgctcccaagctcctgacttctttcttggatatacagtcccgattaaggactgcccagttatagctccttttctaccaggcttttctggttgattatcttggggtccctacagccttgagtcttgccatggatcccaagcctggctgtgaaccagttttccagatgtcctgtaccctagagaccccaaggctgtatgtgtgtacatataccccaatttagcaaggcggtttggagcatgcctcagacagaaaggattcagacagatccttcctgccatctgctagtggtaccaacccgggcaagttgtttaacctctttgagcttccaagttctccattgtaaaataatctgctgccttcctaggactgctgagtggataggattgcattcaacaggatgtcctatgcaatgcatgccagtctgggagctgtcggtgtctgagagcacttaccattgccttgtccaggacttcacagtcctctttctttcttggcaggtttcaacctcagttcatattccagggcttgcccaaagttatgcctcctttaaagcaagacagaccacgtgacagggccccaggatcgatttttatgcactaagggctctgcgcacggttctttttgcaaatgaactggtgtgtctcctcacccagggccaggctggcacaggtgggttctgaaggctcactctatttatttagatgaaggaagcagagattttgctgtgaattgaaatgattgccctgagaggcttatttctattttcaattgttatgcatatcagagcaaatgtccacattaggatagtaattgatatcctggtagcaatagtacctcacagagaaatcattttgatgcaatccagttaaccagcaagaagttcacgtgcagaactctgtgtgccatagaaaaaagtggggaaagtcttcgaggccttgagtcgacgagcaaaaacacaactttcctgaggcagagagaaaacagaagggaaaaacaatgtaataaaacaaattagtcactcggccctggtggtgttcaggcaagcctgtatgtttttttccaccacagttgtaaagcatcgggtctggctttggaagccatcaatctctgtaagcttattggcttggttgttgttttaggcattttggtaggaggtgaggaattctaagcaacaatgactggaagctggcaccgttgaacagtcacctctcctatcccctggggtgttttgggaaagtctgtcccagaagtggcttctggaatttgcctatgataagtaatgactgtgaaacaaatcaagaaagaaatgagcaagaaattccatggtaaatgtgattcccctccctatttgggtagcacttacaactaaccaaaagttctaacaatgagtgagtaatcccccaagaattaggaatttagggaggggttcaggcttggaggacagtcgcttgggagtgactgaaaatgttccatggaattctgagatttcgctataaagtggggagttctctctaggggtcagagtcttgattttcaggattttcaatgagaatcagtgtcttatagtgctcctgcaaatttgtgtgttatgttttaagagcagtgtttatttgcagaactttttggatgaggaaaaggacacagggttgaagagggtgctgccccctccccccctagggtcaatacatgacagcctgtaagatttccagagcactagggaaatggaatatgtagtgaaaggagtcagtgatagagttcacctgtctgaatatttttttttagcaagtcccaaaacaggtttaataaactgcaaagctgagtatgtaatctggaatttgtgtaattccacagtctatactaaaagccccaacagtcatcttagctgatcgctcctactctgcctccctcccttctccccttttctatctttagcccttgggttttccgttaagtaaaatctgtttacttccagaagtatcctctatgtgttatagtgaaattgcccaacaaaccaacatactcaataactgcattatctaaaagcatcagcacttggatgtgtaaactgagcctcaatctgaagttcaatgtttaggttaaagtgtagctaggttcttgaaaacatccttatttccttccaaaaatacaattgcttggggagtctagttaatttatatttagtggaatgtaggaaaaggacaaactatggatttaatttacacctgaatgacagtcatatcatctacgtagccaacagtgtttctgtgtgcgcgtctgagtgagtgtgtacatctctgcattttgatcttgtaatacctgttgaaaaatttctccagaagagggctccatccacagcattacaaaattctgaatctacagctcattttaaagaacttcaatgcagcaactccatcaaaacaaaactattctccttattccacattaattgccacaatcacccccaaatgagaaatcctgccatttttcactgtatttatttctgtgtctctctctttcttgctttccttcttttgctctcttgctttctcgctagctttcttcttgctttctttcttttcccctattgtagttggttctgttctaattcattctttgactctgtatcccctctgagtattggagcagggaaaatttcaaagatgtttgtagacggtgcaatacgcaatgtgaggaagttctgaaatttcctggcatttgactttggttggacttgatttcattctttaggtagccaaaaggcaggaacagttctgcctgtggaaggagataaccttcccccttacataaccacccagaagggtgactcctgagctaggtccactcactttccatcactcattgaaaaggagaaggaaatatccccctgtcatccaattacaataatcagctggacagaatcaaaccaagtgaccagtggttttggcattgtttctatttagctgtcagccaggtacccatgcacctgtgagaatctgaccctcctgaaggatgctgccaatataattccccacagcccgcttcttctgcagccacctgggatcccaggcctggctcctcaggtatgaacaggctgcacagacaatgaatggctgggctgtaggatctcttgctcctgcagtaggcactcagcagtggccttattctagagttagggtggaaagtcatctttctctgctgagagaggcagcttgggggaaggcaggagaggagaagaaaggacatttctaacttgaagtgctgactgagccagggtctgtggaggtgaatgtgtcaccctctggcttagcaagttgaacctcgagacatctgcttggtggtaatggaactcatctatcccaaacctgcaactctggcttctgggcagaggttgccaagtagcagccacaggctaaatttagccatggatgcagtttgtttggctcaaatgttttgcaaattgtacattaataaaaaagaaatccaggtttctagcatttctgaaaaagtcaggtcaggcaaccctagatccacacttcaacatggccgtacttgacagggctgagtcactactgccctctttaggcaggacgtgcctccgtagcttgccataatcgtcaccactctctactacccagccttctgtgctcactaattttgcctgcttgcccctagggctttttgagtttgggacctctgctttcacaaatgttgaggtttgatcaaattgatgcagtttatttctcagtgatggactatttggaaagggagggactggccttttctccttccctgtgattgaattccattgatgtgtgctttggaacagcatgaccaaggggactgcagcccctccctgagcacattactggcagtacttttggacaggcacccagagagacatagcacccagatcattgcttcaggtgtaagagtcatgcagagaagtgacacgctgcagctctgagtcagtacgagccctggcacaccagtgtgttggtacaaaatgtcatcacgcaccagcagccaagggactctgaaaccctgggatcatatagaggcctgcataccctctctgtcagcagtcctcaaccattttggtaccagggaccggtttcgtggaagacaatttttccacggactagaattggggggatggttttgggatgattcaagcacattacatttattatgcatttaatttctgtattgttacattgtaatatataatgaaataattctacaactcactataatttagaattactgggagccctgagcttgtttttctgccactagatggtcccatctgggggtgatgggagacactgacagatcatcaggcattagactctcataaggagaaggcgacctagatcccatgcacgcacacagttcacacaggattccaactcctatgaaaatccagtgccacggctgatctgacaggaggcagagcccaggcggtaatgcgagtgctggggggccattataaatacagatgaagcttttgcttgctcacgggccactcacctcctgctgtgtggcctgatttctaacaggccatggactggtactggcctgtggcctggaggttgggaacccctgctctacgtagtgttctaccaagagcatggctgtccttggagaacagtgacagctgagcatcatcattccatgagtgttgctccctcacggtatagacataaccagaacgtcacaataacttactctacttagacttgccaaggcctccgggaacactgctctaatattcagcacctttgtaacttcaggataaagctgaatctgcagctctgtcacctactttttttctttgagacggagtcttgctttgtcacccaagccggagtgcggtggcgcgatgtcggctcactgcaacctccacctccagggtttaagcaattctgtgcctcagcctcccaagtagctgggattacaggtgcccgccaccaggcctggctaacttttttatttttagtagagacggggtttcactgtcttggccaggctggtcttgaactcctgacctcgtgatccacctgcctcggcctccccaagtgctgggataaacagacgtgagccactgcgcctggccaagtacccttatccataggacactgtcacatcctagcaccgtcctggagcttgtgtgatgtttttatatctgttttaacagttaacacccacggccgttctacatacagtgttaatgctacaattaatgctctctggctctgtaaatactagactaatctgtctgcctcatcccataccagcaggtgagcctcagatgattcttgttttccatagctacagaccccaaagatcagagtaaatataactccatatacacatatgaaaaaaagtgattgtttttcctctgccagttgccaacagaagtcaaattctagaaaactaacattaacaacaggcacgttttgacttgtcatgtctcatttcaaagacaccaatgagcatcacccgatctgctgcagaggcacaaagaccctgtgtctcctagctgaacgcagcccgggctggggcggagggcagcagctgctcagccatcaacagccctgccacatgcctgggcagggcccggaaatgagctcagcctctggaggagcctggggaatggaaggaaggaatgtggcagcttccatccttgccttacggggccttcaggccaatgtctctttccctcaaggtgtcagggaaccgctttcttgtgttgtgtgctgcaggaagaaggtggtggctgcagacacctgaagcttgagcttctgtgattgtctccctgtggactgattgctgtagggcctgcggaaagttgctggacactgccagcggaaccgaggctgactcagactgcccggagtatccctcctcaactgccatcagccgtcgggcatctgggatcatctcactcaggggttgcaaattatggcccgtgagccaatttctccctgcagtctggttttataaatagttttattggattatagccacacctattcatttatgtaattgtttatggctgcttttgtgctataacaacagagttgagactgtctggcccctgaagctgaaagtatttactatttagtccctaaaagaaaaagtttcctgactctttatctaacttaaagttacagccaaagaggcttctgggcgtcttctcaaataagaggggcctgagaagttcagccgttggggacttttcctcctaggccccaagcacttgagcaacttgacttcagggagattcacctgagaccaaatggttccaataaatatctatgatctctatggaggatctactatgttccaagcaccacttgtgtgtgcaggatacagttgctcataaggcagactgagtctctgctctcctggggctcacagcttggcaggaaggatcaatagcaattaatgaataatttaagatggagacaactgtgatgagggaagaaagcccagctgtgtgaggtcatgccgttctaaatattttgcctaggtgttctttgtctttctcctccactagactataagctctgttgtggtccacattgtggcttgatttgttcatttctatactcccagggcttagaacagtgcctggcacatagtactcagcaaacatgaatgaacaaatgaatgaatgaatataagaaagacatcagaggcagatgaaggatctgggcggcttccctgacaacctgatgcttcagcccaaatctggaggagcagtagggcttacagacaaagacacagtagagggtgtgggtggggaaaggcattccaggaagaaggcacagtctgggtgaagcctctattcaggggaaacaccacacagccaaggcagtgatgtgaagtgtggctgggaggtgccagagccaatggggccatgtcagccactgcaagaatattggtgtttttctcagagcaagtggcagccattgagggtactgagggaaaggtacagagtgatgtgatcagatttgcattctggctacaagtagcaaatgggttggagctgggtaagaatggaaaggaaaggccagtctagggctgagatcatgggaagctggattcaggaacgacggtgcagagatggggcaggtgattgaagtagactgatatggtttgggtctctgtccccacccaaatctcatgtcatattgtaatccctaatgttggaggtgaagcccagtgggaggtgattagatcagagggcggatttctccttgctttaatcgtgatagtgagttctcacaagacatggttatgtgaaagtgtatagcacttccccctttgcgccccctctctctcctgcttgctgtgtgaagacgtgcctccttcgccttccccttctgccacgattgtaagtttcctgaggcctttgcagccatacttcctctacagcatgcagaagcaagccaattagacctcctgtctttataaattacccagtcccaggcagttctttatagcaatgcaagaatggactaaatcctattcagataatccaagagacatttaggtggataacttgacaggctttgatggtggctgggtatggagatggcagggccagagagaggtgaaggaggcctgcttgagttctgactcttccaattggcaggaagagtcaaacaaggagaccaggtgtttgacattgtaaacagggtcggtctgagggcttctctatgtgggagtgtaattcaggctgcagaacgttcctgggagaggcacctaaggcctgcattacagtattgccagcagatccagtccatgcctgcatctaggatgggcaccgtgggggcctggaaatgcccttgaataaagtgaccgacgtgcagcctgtacaattaaccaatctctgagacttttcatgcacaagatatttgagagaaacattgccaagccctttaatcgtttcttgaacattcaatcagcagcactggaaatatgtcttacatgaagcaaataatgatcttctaccctcagcaatcgctttgccaatgctaacaagcctctgcttcagcatgttgggtgtagccttggtgacttctgtttgtggtgtagtaggagaatattcaactgggtgccaggcagtggtatattggtaaatgtttaacaactgggccactctaaagaaacacccaaaccagaaagcaaaacccaaaccaagacacaaccaagtaatttgtagctcttgccaatttctgtgatgtaaatactcccgtcatgggcaatttgaatctgccaacctgagagtttcctaaaaacttaacaaggggctcttgctacctgatactaactggctccagcacaccatggacctggatcctgtttctagctcaccccctcactcgtggtatgaccttcagcaagcagcttgaatgttttcatctgtaaaatggaccaggttacttggaggttcaagtgagtaaaaagatgttagaatgcagggaagtccaatttgctgcaaagatgcatgcagattatctaaatcattatcacttacaaggaaacaggacctttggccaggatcctacagctgtctaattgggccctgtaaaaatactttgattcagccactgaatgaagtttgatgtgtgagaaacagagggtgtacctctgcttcctgcagttctgcatgtttttgcagtaagaaagattattgcgttctgtggcagtattgattccgaacgtgtctatcttgtttttctgctttcccttcttttcttccttttctcaacaaagatatttagtgagtgctgtatgccaggcactcacctaggtactttatcctcagaagctgaggtctgtacagttactgtgccttttttttttttttttttttgagacggagtctggctctgtcacccaggctggagggcagtggcgcgatctcggctcactgcaagctccgcctcccgggttcacgccgttctcctgcctcagcctcctgagtagctggggctacaggcgcccgccacagcgcccggctaatttttttttttttgtatttttagtagagacgggttttcaccgtgttagccaggatggtctcgatctcctgacctcgtgatccgccagcctcagcctcccaaagtgctgggattataggcgtgagccacagcgcccggcctatcgtgccctttcaacagatgaagaaactggtgagtttaaggaactgacccaagatcacagaataataagtggtgagctgggatttgcacctgggtctgtgcgtgggcgagtccacctggggcccgtgtcttcactcagcgagtatttattgagcatttagggaattcagaggtaaacgagatgaactgaatccctgtctcatggagcttacagttttgtgggaacagcagataaaaacaagtaagtacttgaaataattacaaatgtggtaattgttacaataggaagcagtagaggctgaaatccattgaagggagaagaggctgctgtgccttcctttgctcctttgcttcctttcatctgccttgcctccctctttctgctgtctttctttctttcttcccttaaatgttacctaccaactatgaagaacgctgcaaacctgggaacccagaggtgaacacgacagtccaggccttcactaggaaatgtgctggagcagaattagagcctggggctggcctggacccagagctgctggtgccttggactgcttagggactgctgagcagacctcctagccctttagaagtgagcttgaatccctgcccagccatttacacactgtgttgcctcagataattgacttcatttccctccttttctgttttcccctgtattaaaacaactgaaaaggaatatctatgcttgccctgcaggatttttgtgagaattaaataagtgtatgttaatgatgtcatcctatgcttaagaaatgttggttgtattacttttcaccctatgctccaaggaattttatggtctgaaggtgtcatggggtcttggctttcaggatgtgactcacttaaggggggaaatgactgtgcatgtcataatgcgtggacattaaaaaaaataaagtttgctccccagggaggatttgccaattcccatattagtaggtcccccaagattgttcccctcgggattcatgcctcataaaatcatttgatctggtgggatctcatcttcttaatgtgtctgcccatcatctgttcctgggaggctttattagggcagtgtgtgcgtgtgtgcgtttgtgtgcatgcacgcaccagtgccatgagtacttgtttaaagtacctccatgtaaccacaattcactgtagttgctatgcactagttacccatgttatctggaatccttcctgcaacccttagaggcgactcttattcccaattttatatacgatgagaagaagttttgagtggtggagtcatttgctcaaggccacacagtcactgagaactgggaccagggtttggacccatgcgtctttattcctgtgcatatttattttcctctatgttgcactagtatataaaagttgcctttcccactcccctcattatataaaaattctttcctttgtctattttgttctctacctcccttaaagtcaagatagctgcctgggatgactacttttttgagttcctagtctctcaaagtgggtctgggccctggacttcctgtctgggctactgattgcaaccttcagaacagggtcagcccggggtcatttgtgttctttgtctccatgtccttgcttttgaccagggccaaacaacccacctgcactgcatggttcccccagcaagaacatcccagtgagaatggcccacagatgcctgggcgtgacccacctgcagcttcaaccatgcaggtaaatttgcctgctgctgtgtcgtgtggctggatggaattcttccctagggatgctaagaaaccctgttgcctaagtcagtgcttcctgcaagctactctttgtaattctttccccaaacaaaaagaaaacaagaaatatacagtctgtagctatatagagacacctggatctatattgtgtggcaattggattgaatgtaacttgaagtttatttttgtcttaccagactagtgttttttcctgttaatttaagtgctttagtgagggttgccattgattgagcaaacatgtgttgagtgcttattatgtacccagctccattttccgtactagccacagagcagcgagagcatggcctttgccctccaatcctgttctggtggacagacactctctcccttgacagggtcctcaccactgtgtgcaccgtcccgccacctggtggccgtgcctatctgtgcattccctatttggttaactcattcacttaacaaatatttactgggggaagacaatatctcaagcacaattctcagcattgagggaggcagcagtgattaagaaagacaagattgcctgcccccgtggagtttgtgttctgatagcagagaaagacaggaaacaagaaaaataaataaatatggtagttttgcgtagtgatagtgctatagaaaaacgttcaaatggggtagagtgatagacagtgttgttctgagcttgtccaccacaccctcttgggacagaggattctttgttctgatggaatggcctttctatagcatagagatgaaatgtgctaccgtttgtgaaaggaagttagtaatacatacatggcatttttgtcttcactgataaagtgttgttggtcaacttttgtcaactctctactttttgtttgtgttgaaattttactgttgggaatttacgaatatggcaactaatgatttaaaccaggggtaggtatcctttttctgtaatgagccatctagtaaatagctggtttctcttgaaactgttcaattctatccgtgtagcattaaagcagccacagccgatatgtaaatgaatgggcagggtaataaaatgttatttacaaacacaagcagagctagattggtccttcaggctgccatttgccaaccactaatctaaaccagtagctgccttaccagttggtcaaacttgtttaagacagggatagggcagaggccagcgaggggaaccaggcattctctttggcctcagttgccatgaaaatcatggtacttctttagggtcacatatcactagattatttgcattaacttttatcaaggtaaagatgctaatagtcaactatggaacataattctcagagtagatctaacataggaataatttagctttgtaatatttatctggactacaatttttaaggcacttttgctacccaaaagtatcttggggttaaacacgctcttggattgaattcctctaaataaatagagacacagaattgggttcagggggttaagttggtaaatgatctcaaggtccataagtgagcgagtggggagagtgagaccaagaagaaggaaagccagcaagccaacagtgaatgtgtcattgaggtggtcacagtcatgggaaactggcttcttgctgctgggtctctacaaaagcactgtgtaaagctcatttccgaatggtccctccacagaataggtggctgagggtgtattcactcgcccttatcttctgctggtcaggggtgacccctgccgtcattaacttctctgtgcttccctgctgagcctttgctgtcatggggagcagtcatgactttggaagcatcatagcagaaaaaatggaaaggtatggcaagttgttggactgtcaggatatgccctgggtagggtatgaatatatgtgatttctcttgccaccattacatgttactggaaacttcctcagtagagctaatggtaacagaaagaattatggtagtggtaatttttaaaaccttctgaatttggttaagcaccctcctgcagatattctctttcccactagatggtaccagtatgccaaagccctagaatgctaccttagggcctcgtctttgacatgtgatatattctcattacttttcaacaatgaatgaataagccagttgaggtcaaaggaatcaactatggatgttttagggacaggagatgggagaaaagtggaggctgtctaaacagttaccctcattcacgcattcagtcatttatcaacaaatattactcagcactgactgagtgctcaacacttttctaggcactgggaatacagaaatgagtaagacaggccaagtccctgctctggtgagcttatgtactggctgggagagagacaataaaaaaatgaacaggtaggtatgtgatgtctgcaggagggtgatgagtgccatgaagaatgagaaagcaggcgagggggtagatagcgacaggcagaggtcatggcgcttgccttcgctgttggctgtagggtgagagattattttcatctgcttcccaaacccagttcttccattcaccaactccttatgacacccctatgcggtttatttttgaaatgaaactaacagctcatggagggcaaaaaaaaaaaaaaaaaaaaagtggtgcttggcaaatgtgtgttcactagtcggggcccactgcagcctaacacctaactcattggactgcttgttggctgatttaatttgtctggaatatttctgaattactattgttgttgacacacaatagagttgcatttaactcagaggttagactataaggtcagggttttaggcaaacacagttgtcattagccttgaactcttttaagttgcccattaaagtacagtaggcgtggtttagtctatgcatccccgtattgtaatcaatagggaacaatgtataatgcacgcagtaatgtacagggcataataaagaatatatgcaagatataattttatagcatttaattgcagtatttacattgttctttttctctctctctttggtgggagagctggctttccattagttaaatgtgcatatgatgagacttgactatattcatttaagccacattcctaatcatacaatctccaccagactgtgcattacgtaaggcaagacctgttttctctgttgtgttctgtttatctttggattcccactaccagtcagatgctttggggtgggggaattgaggaataataatagtagaagtggcagtaatagtagctgatatcagtgtggtgctgattttgaaccaggcctggtgtgagtgcttcagatgcattaatcagcacatgtaatcctcatagtgactctataaaatatcttctatggttttaatcccatttcataggtggggaaacttcaggagaacttagtaaaagaacctaataaagctttaggactctagggctgagattcaaactcaagacaattccagacacacaagaccacatgttgtatgattctatgaaatggaacaaactgtccagaaaagtcaaatccagagacagaaagcagattagaagatgtctagggctgggggcaggaggaaatggggagttactgctaatgggtatagaattgctttggggaagatgtaaatgctctggagctagatagtggtggtgattacattagctctctgtaaataaaccccaaacctgggaatcatatatcttaaccggctaagctttatagtatgttacacatgtctaaataaaactggtattgaataggaaaacaagcaaaccttgggcaggtcagcctcagggctcctgtttgttcatgagcacacaccacctgtcttacagttgttcaccacctgctggtgatactctacttgctttacttatattaacactgcgactcctcaaaagatccccattgtccaccctactgagatcagaaagcggaagcagaacgatgttgagaaacttggggctggcaagtggtagtttcaggattaagacccaggctgtttgggtctaattccttctggctacactggttcttacatgtgtttcattcattaaaagcaacctgtgttatttggaactgcaggtcaccttggcctattggaaataaagcaagggttcttcacgtttgttttgctgatttgtaaagtgaattaagaaccatcttttgcctcactggttattattctcatagtagcctaccctggtgtagagttctggctgcaaagctctcagagactgaagaaaaggagatggtttagtgttactgactttttttaagacagggtctttctctgttgcccaggctggattgcagtggtgcaatcatagctaactgcagccttgaccacctgagctcaagcaaccctcttgcctcagttctggaaatagctaagtgggactacaggtgtggaccaccaggcccagttaattaaaaaaaaaaaaaactttaagacaaggtcttgttatgttgcccatgctggtctcgaactcctggcttcaagtgatcctccaggagtagctggcattacaggcttggctgacttttaaaagtagtaagtggtttaggatggggggtggtatggaggtcgggtggggagaaagaggagagaaatctaattgatatgctaattgtcattgtactcaagttgatagcagattgctgaaggatttaggatttacccaaattaacatgaatgtttggcaccctttggctggtgcggctgaagaattcaatagcctagtaatgagaagtcaatctaaggtctaaggctgggaaaggagctcccacttcttacattcagtgctcatcactctgcaaatcaaggccccccgaactcctcccacccctgccttctgcgtctccctctgtgctctccatcacccccctacggagttcctttgattctcaggtcccttaaccatggaacgtactcctgtctgccctcactcgtgggttgatgatttctatcctttgtcatgttgaaaatgctgagtgacaaagccattagccatgcacagtgaaacaaggaaagcagcctagagctggtccccagaccaggcccagtgcacgagtttgggtgctggaaggggaggctttatggaggcaaagctgaggggctgtacgtgtcttcataggtctccagtctgtaaaagcaaccacgctttgggctggggcagaagtcaggacttgaactggctctggctgggacccaggctcccaggtagccagctcccaggtgacaggagtccgctgggctccctctgattcttaaagcctttccaggtagcaacaggagatcacgcaaagccacgtaagtgtctgattcagtcctccctggtcagttttccagcatagcgttttgcaaaatgtgttctgaagagatactggttccatgggaggttaatatgggttctggggaaaaaaaattaggggaatcaaaaaattacttgtataaactaatattttggaaaactctggagttagagaagtggaccagattgggttttgttttttcacaaatgaaagtctctgagattgtagtgtgtttcagtttcagagggctcttcccaaacccctgaggttaaggaaactcttgtacacagtgggtctcgggcactaactcacagatcacacttctgaaaacaagctcctaggatgccatatctcagagtacgggcttcgacggggcccttcacccagctccaggaccaactgggagcctgttaggactgcaaatcctgtcctctggacctagagaatgaaagcctctgggggcaggctcagaaatctgtgtttccagattccactgggttttcaactccatccagaataattcttctggtgtcactgtgaatatttgctgatccttctgacgtctatccgtggtgcttgtttctgaagtgtagtctaaaccgttggctctcaactgttggggtgaggggggttgtgaccctcgggacagtttgcaatatctacagacatgcttgtttttcacaacctggggaggggagtgggcatctagtgggcagagctcagggatgctgttcaacatcctacaatgaacagcacagctcccaccacaaaaggttatcctgacccaaatacagtagtgctgaggtggaaaactctgatccaaatgcatagcttcatactcacccagcacacacagggatttttatccttatcttatcctgttattactaggaggctggaatctgaagctggggctgtgaaaagatacctcacagcaagccgctattcatgtataatttttcaaaaggtaaaaccaagactcttgggtaaatacgcacttcaactcattaatttatgaagaaaccagtaagatgccatggttattccaaagggcatttaagaagctaaggtattcgtaaggaatttagcaaagaaatgtgaagacgagattgctgagttagataaaaagtggttaatgttcatcatgcctaaacttttgggggttatctgttctattagataaaaagtatttgcatctctactggacaaaagttgaccacttaagtggtgacttcacaaagtctgggatcttcaagagcaaacaatgagatgaactaagagcatgctcctaaacaacttcaggttgtccctgactgataaccaaaggatgtgccatcaaccatttgggccttgtttgcaagctttgaataatttttctggtgctttaaacacattattgttagtattttgagacggagtctcgctctttcacccaggctgaagtgcagtggcgtgatctcggctcactgcaacctccatctccagagttcaagcgattctcgtgcctcagcctcccaagtagccaggattgcaggtgcctgccatcaggcccagctaatttttttttgtatttttcattgagatggggtttgaccatgttggccaggctgatttcaaactcctgacctcaagtgatctgctcgcctcgacctcccaaagtgctaggattacagacatgagtcaccgcgcctggcctaagcacatgacttttaatttactggtgctgcatggtctgtgaaaagtgggtcaaagaaatgggaagtgatgggaggagaggtcacaggaggccaaggttgtaatatggttagaagccatttcttacctgtcttctatgaagtgtgggttgtgagcgatgctttcattcaaacctatgaggtgcatcttgtcatcatccccatctacagatgagaaaactgagtcagaggaagagttaggtatgtcagtagcaggcatgggcaaaggaaggagaaagtaatgatcaagatgatagagggagaattgcaattaagccagagagaggaaggatgatgttataagctcgagggaagcctgagtccagatctgaagcagatatactcacagcacgttcagggggtaatgaagaggctgttatgggtgactatgaatgtgaaggcaacgtgagattggatcagagttagaaagatgacagttgttaatagcatcagtgttattttagccaaaggactttactattgctgtagtgcagtgcctcgcagtacaccatgacagttaagagcccaggcctcgagggaaggttacagtttgaagcccagctctgccactgtagggctgtgtgaccatgggcaagttgcttaacctctgtgcctcagttaccagatctatgaaatgtcggcagtgaaacctagctgatatgactgggatggggattccagagaaccttgtaaacacttggtccagcaaataatatggcctcagaaaatagaagctggatgtgtttacgtacatgaggaaatggacagataggacttaacagaccatggttgtgagtgacttggctgtaagtgtcacagtctcagtttgagtttcctcaaaagcggatgctgtgaggaggatttgagtgcaataaattctcttgggaggtggtccaaggggaagtgtagaggagtgggaaagtgaggcaaggaaggaaaaggaaacagacgaggggtctgttactcaggcaggtactgctctgggtgtctggagcttaactcccctgggaacctttgagaatcagtgtggaatacctgcttccaagccatcccacctgaggggcatgggagctccagattttatgccacaaatctggttggcattgattcaaagctgccccagggggcactgattttgagactactggactactccagcctcagagaaagcagtcagtgaagaggtgtagatatttgcagttggaagttgagccagccctgtaatggaaaagccagaagagacaggagcttggggttgggtggtgagctgtctgtcagtgtctaatgtggtaagtatctgatatggtttggctgtgtccctgcccaaatctcatcttgaattatagctcccatagtccccatgtgtcatgggagggaccctgtcgggggtaactgaagcttaggggcaggttttccctgtgccgttttcatggtagtgaataagtctcacgagatctgagggtttcataaggggcagttcccctgcacatgctctcttgcctgctgccatgtgagacatgcctttactcctccttcgtcttccactgtgattgtgaggcctcctcagccatgtggaactgtgtgtccattaaaactctttttctttataaattacccagtcttgggtatttcatcatagcagtttgaaaatggactaatacagtatccaaaggcataaaaatagtcatgcactttggggaagtaatacacatctgagaagttaaacagaggtaaatacaggaaaatatgtacaaaatacattatattaaatgatatatgaatattgtatatgttttatgcattgtatgtgaaatagtaataatagccaacgcttaggaagtagttgccacatgcctgactctcctaaatgctctgcaaataggttagatttccagcaaatgaaaacaggttaggcagctcaatagaatattacataaccattaaagaggatggttataaagatgatgataatggcatggaaaaatcatatgaatgagaattgaatactaaacaggagattgtgtgtgcagtaggattcctacaaagcaaaacaagcctctaaataaagaaaaagaagggtggaatctgaaaggaatttatcaaaatcctaactgcaattttgttcatgcgttgggattcagagttgttttttcccctctggtttacaagtctccattgatacacttgcgttacatctataatgaaaaatacaagaaacttgaaaaagtacaagaagaaaaaaccttctaaaaaataggtggtaagacccagtgaaagttttaaagaagggaataacataatggaaaatgtatttcagaaaaattaatctgggggcagtgtggaagatggattgaatcaggaaacacccaaggtgagaagtccagcttgaaagcttgtatgagttactgggagtatggaaaagaaagagccaattttagatggttgatcatgaatgagatgatggggaagaaagagaaaagtgccagaaatgattccaacattttaaagcattttgaatggaagaaaataagcaatggaactaatataaatatagttagagagtgagcgcgcaccggctttctttacatttgttgcttgtttaaacctaacagcaatcctatatgctatgcttttaatattcctattttacaaatgacataatagaagattagagaaataaagccacttatccaaggtcacacagggtccaaactcagattattgtgaaatgaactggctagatagaaggatagatgatggatggaaggatgaatgcatagatggaggatggatggatggatgatggatggatacattgataactatatgaaggggaaggaatctggtgaattgtaatgttatagtggaaaatagggcatttcaagaaggaagtggcagatagtcttaggcagtgaagaaggaagggaacagagaaagcactagattcaacaaaaagaaccagtcactggtcctctttgagaaggtccttccagttaaataatggaaagtgggcttaagcagcatgggggactgaagggccaggacatgttggggaacctgtgaaatggctagtcagagcatggcatgtatgagcttaaaaccagatctgaacctaaggaagagatccaacaataggaaggagaggggatgtaagagagaaaaatgatggggaagggagaggagggtaagaagacatggaaaaatggaaaggaaagaaattactggttaagaacaaggacaccagactgcctgggtttgagtctcaactccgctgccctgtaaccttgagcaaaccccataactgtctctgcttccgacccctcatctgttgaatgggaaaagagtaataagctctatatcctggggttcctgagaggaggaattgaagcatgtaacatgcttaagacagtgcccggtgtgctgtaagttgaaactgtgtagggatcctgttgccttagtcatcacaacaaggaccatttcctgggcaacaacccaaagctatagattaagaaactgaggctcagtcacttaaagaatgttctctgagaaagtacacttggagcctcaacattgctctacctgcaagtagttacctctcctgtcttccagggagaaatagattttgtgtaaaataggatgcatggctttgttagtggaaactaaccttcagcaattgtaataaatgaggtacgtgaggttgcatttttttctcctttttgaaaaaagagttaataaacagaggctgttcaataaagcagagttagaaggagtttaggaagcactggagagtggctgaggagcaaggtagtgaggacttggaggacctggagaaggcagatgagatccatcagatcccagaaagctccatcaactcagtgccctttctctattccagaaagtcttatgctcatatcattgatgcttggagaagcctgcacaccacagacttggcatgagaagtcctaaaagcctcattaacccaaccacttaggctttctgagtgcaacccctaccctattctatttgggctcagggtttgctgggccccaaaatgtcccgctgttgggatgaggagattcagttaatacctttctttggttggctctcctcccacatccccctacctctctagccttggtttccagaaaactgtatctgtgctcagcctgctccctcctgcccttggtgatcatgaaacctgccaaagaagcattctctctgaggctgagccactggagaagttgcacatccaggattgattttgcatagtgtagaaatcaatccggtgaacctggcagcataggtatcctctaagtttggttgtaagcccagtggggcagggcagtaaacagtttaaattggaaagttaaaacaataaacaggagagacaggtgaagttggggtttgaaatttgctgggctagaatgggttttctctttctgtgttaatcttatctggcagctaatctttacctgtcatgtggtttttgggggagaaaacggtaccctctttagactgcttccttttctgggaggagaaccctgagaaagactatcagtttgaagttgtccctcctgggatagaaatttatctaattttagtgggtggcaagactatgaacaaccatcattatctgtgctccaataattattaatttaatgacattttaacaaataagaaataacttttattgagcactgtctacatatcaggcacccagctaagtactttcacatgtgatgtctaattaaagcttctgaatatgattaacttcattttatagctgaggagtctacagcctatagggcacacacacatataccatcttcattgatcttcacccaaccatcagaagcctgggaaagacattttgcagttaagaaaagtgaatctcagggacttgtcttcttcagcaaacaattggcagaaccacggtttgaatccaggtcttctgactccatattactttgattttattgggagagtatatgggtggcgtatcttcttaaattcctctggccaggtcctgagaaaagcatttactgtgcattgtctcaacacttgtaataaccctattagggaggtggtgtttttccactttacagtgaggagactgaggcttagagagggtaggtacgccattggaacaaagccactcaggcagttgtaggaagtacagctggggcttataccttcccattctaccctccaggttttccctgctataagcatttcttacagcagtgccttcaataggagaaacaatgacaagtgatttttccagtgggacagcaagaaggtgattgtggtcttggaccttgggatttaggacgggctattgacattaacagttggataggctgctaggtcagtccagggaaaagcaggagggaagataagacatgactgagaattcaggaagggccagcgccatccaatcagaacaagttggagcttttcgtcttctttaagcctactagtttcacttctcattttgaaagaaacaacttgctcggccaacctattgttgctgcctttctctgcctaccacagctatgaaagcaaagttattggaacatgtgaacgtcactagcatccgaggcaagatttaggttctgaaaagaggtcatcagattgtagagttggatctccatttccctggagagtcttgtgcttcagaaaatcattattggtttgtcatcctagcctgtcatggtggaacccctgggctctgaaagattacaggaaaatagctggtccttggcagttctcagaaggttctgtttctcacctgggccaggattgtgcctgtggtttttgttcatgacaagatgagaagagcttggttaaataaggaacgacctctcgttatatatcttctatcctgattgattgcatcagaaaagccattcatctggtttgaagatagacaggtggttgctgtcactgcaccagcagcttttgaagtttgctcagtgatatgattacagcccatacttaagcttctgctccaggaagtgagattgacctttgatcctactcctcatttaaaaattacagatcttggaaaatgaaccaatctagaaagatattggaagctgctgctgctgctgctgctgctgctgctgaggttggctgtcaaaccaacttaactggcctgcattacctagaattgtttttttttttttttttctggttaaaaccaatgacctttaaagcctttttatttttcctctgacaatctctagtggacctatggtcttttgtgagttctgatgggaatcccagaatctttctgtaactgtgggttccaatgagagaggcacatttaacaaagaccagaagaaaatcaaaactgttgctcaaactgacagtgtatgttcttcatcccactccttcattagctcattcattcattgattcgttcattcatgtgctggctctttgtagaagttgggggtaaacaggcgaccaaaaggtagtccgtgaccccaggatgttgtaattcagaagggtaaacagacaaggcagtcaacattgtccattcagtgtgaatgagcttgggagtacaaccactttggaaacccattttgttaatttacctttgatagatacttattgaacggtttttccaagtgtctgtgaagaagacatggtggtggtagggggtgggtggatggtttctgaggacctgataatgtttctccttgattttagtgccagttacgtggcaactcatggaaaacattgagctgaatacttgggcttttgcacctttttgtagtgccttagtgtattttacacaaaaaaataaataaaagtatgctcagcctcaggtgtgttggaaatacagaggagagaccagcccaactttggaggagaacagagagagggacccaggaaggccttctggggaatatatttgacttgggccctgaaggagcaacagaaattaggcactgagtaaaatgggactggatgtacctgcacaaagccagcagcagaagaaaagacatggagtggagggagctggcagttcatgcttgggggaagctgagagttgcttgtggggctggaggccaaggtgcagggctgcaggggtaggagggagcagccagggagggggtggattggttaagaaacacgatgtgcatgtcatgttgagaaacttggatttcaccctggaggcgcaggaactaggggggatttttcagcagcagtgacagacgctcttaaatctgggttttccaatgatcagcatgcttgtgcctgcaccggggcgcaggatgggagacagatgccttttgcagtagttccggagaagaagactgaagaccacattcaaggccctgagagagaagagaaggggacagataccacagagatcatgagatatagcacaacagataagacttgctaattaactgtacggggttacagggagggacagggagaaatcaggtttcttccagcccagcttctggttggaatcactcaggcagagacacatgggcctgagagaggattccccttatgacataaagccgcaaaaattctcattagtcattgcaaaaacatctatttccggcctacactgcaccagccagtgggggaggtcctgagagatagagaaaggatgaattcttgcccttagagagtcacctagagattctggggagacagcaggtccgagtctctctgcctgaaacctctggacagtgtctttggctgacacttacatggtggtcttggtttcttattcaaggtcggtttcccaactctcatagcatcagctttagggcatccccaaatctcttgcagaagagatggttctttccccttgagttgttttgagccaagcatataacattgtgtgaatgtttgaaaacttctcttggttctcagaatgcaattctgacagtgctgaaggctgccaattaaatgaagatttagataaaggctgtgtgggaggtggaatgcaatattcttaaacctaataatggcttccttctgtctttttgaagctctcaaataatcctgattgactgactctctgctttgggcattcccattttctggacaatttaataccatttaaaatgtttgacaacttttatttgggggcagacatccttaggggatggggccgtgggcaaagatacaaatgctgtaccatcaaaggaaccatggatttaaataaggatttttttttttttcatattcagaagaggtgggtacagaaaggatgagggcagcttctcaggttatagtattaaccacgtgaagcagctaacaaaggtatgtgcctggccttgtgctaaaggctttcctcgtatcagttctttcatccctcccaacactactgaggtagatggagtgactagatccattatacaggcaaagtagctgaggcccacagccatagcaaataaactgtggagctggtggtcccagatttcatgcttttagtcattctcttggctctggggtacaggtaagcttccagaactggaggatggagtccaaaagaaactcaagataatttccctgcctttcccattgtatcaggggattcatctgttcatacattcattcattttcccaacacatttactgaatgcccgcaagcaccaggaaaatagcaatgggcacaaccaggttcctatcttcatggagctattgctttattggcagaggcaaacagtaaagaaaattcattagtaatcagtgttgcaatcaatgagccggtcaatcaagcaccataaaagggtaaagtgtgacgaaggtgctccttgtgataggggttgggggtgaggggaggtgtcctggagaggagacatttcaactgagatctctctgaagtagatgagatggccatgtggatctcaaaaggaaagtgtatgccaggaagagcaaaaagcaagtgcaaagtcctaaagcaggaaatagtgaggctaccgcagtgtcgggtccaagagtaggagatgagatcagggaggcagattaggctgcagggagggtgtgcgtgtgatgctgagagtgatgggaaaccactggtggggttgggggagggcaaggcagtgacatcatttgtttttatgtgcagcagaggaagccaaagcaattcagaagaagcctacagaagcttacctcctccacaggctatttttttcttgtttacatttgttaattttacatatatattaactcagtcctcacaaccaccaaatgaaataggcattgcccttattatcattctttcccattttaacaatggggaaactgaagcttagagtaggcaaggtcgcccagataggaagcaatgccttcgggtcatggctcactactcaagtgcctgaaatttcagctagcctttagtgggcacctgctatgtgccaggatctgtatgaggtttggcaccacctagacagccccttgaaccagtggcatgtctcaggacagtgtgagagacagaaacttcagctgagagttaccgtgcaaggcagaaaatgctggtctagcaaaaggaactctgatttcgatttggaagtacagagaaagagcatctgccttggacagagttatcagtgaaaagatgacatatgagctgagactgaaaatcatgttgaagatagtcaaacaaaagctggcagtgtgggagtgggggcttcaagcagagaatcagtggttcaaaggcacagggtagaaggagaatggcagctggctcagtgtggctggagaaagaggctggagtgcacctggttgcatttgaatggtgtgcgtgtgtgtgtgtgtgtgtgtgtgttaatgatggtgatgagatgaggggctagagaggaagacaggttggcacctggtagcattttttaaaaagcaagtaaaccttattttttagagcaggtttaagttcacagcaaaatttggtggaaggtacagaagtttcccaagtacctcctatccccacaaatgcacagccttgtcccactatcaacatcccacatcagaatggtacatttgttacagtcaatgactctacattgacacatcattatcactcaaagttcacagtttacatgagggttcactcttggtgctgtacggtgtatggtggatacatgacaaatgtgtaaattcatgtatccaccattatgatatcacacagaatagttgtacagccctaaaatacttgctctgcctatttgcctacccactcccttctccctaacccctggcaatccaccgatctttcttctatttccatagctttgcctttcccagaatgtcatatggttggaataatatagtatgtagccttttcaaattagcttccttcacttggtaacatgcattgaagtttcctccatgttttcttatggtttggtagctcttttttttttttttttttagcattgaataatatttcattgtctggatgtatcacagtttatccattgacctacttaaggatatcttggttgcttctaagttttggtgattacaaataaagctgctataaacatttgtgtttcctcatatagatcttgtatatatacagtagttccccagttttcatggggaataagttcccagacacccaatggatgcctgaaactatggattgtaccaagccctacatacattatgtttttttcctgtacatacctgtgataaagtttaatttataaatgaggcacagtaagagatgaacaacaattgctccataaaatggaacaattatgacaatatgttgtaataaaagttacatgcatgtgggctgtctctctcaaaatctgttgtagcgcactcacccttctcttttaatctgtcagtctgataaccaagatggttactgagtgactaatggatgatgggtaagatagacaggatggatacactgaagaaaatgataattcacattcccggcaggatggagtgggatgacagaagatttcatcatgcaactcagaacagcatgtaatttaaaacttatgaattatttttggaatttttctatttaatattttcagactgtgattgaccacagttgagtaaaactgtagaaagcaaaccttggagaaagagagactactgtattttgtacatttcatgtacacagtttgctagatttatatgtaaatattccaatttggggagggtaatgtaaattgtattgtgttttaaattcctgatttcattcattcattgctggtacataggaaagtgattggcttttttacattaacctcgtatcttgtaatcttggcataattacttattcttggagtttgtcaatttttttggatttcttacatagataatcattttatctgcaaactaagttttgtttcttactttccaatcactatacctttgttttcttttcttatcttactgcattagctaggacttccaggacgatgttgaaaaacaatggtaagagggcacatccttgccttgctactgatcttatcaggaaagctagtttcctaccatgaagtgtgatgttagttgtaggctttttgtagttgttctttattaagttgaagaagtttctgtctgttactagtttgttgagagttattatgagtattgattttgccaagtgctttttctgcatctattgatatgtgcatgtgatatctattgatatgtgcatatgagcctcctggtcatcatcccaggcttagctcacaaaagttgtgagcagggaggccaccaggaatgtggggcaggtattatgcttcccattttacagaaagtaatgccagaagaaaacagtgcacagttactgctggttcccaatagttgatttgactcctttaaagatttagctgtcccatttatgtgctggataacatcaattgattcttaaatgttcaacaagccttgcatacctgtgataaatcccatcatggttacattttaatatacttacttttcttcatacctgtctcaagagagaaagtagctcagtggttaagactggagtcaggctgcctgggtataaattgcacctccgttgcttattagctgtatgaacttgggcaagatatttaatctctctgtgcctcagttttcacatctgtaaaattatgtcaaatagtactgatctccaagggtggttgcgtgggttaaattatacctaaagaacttagcaccccactcagcacatggtggctgccatgatggtttgccgtgacctctcttcatttgaatgtgtgcccagtgtcttgtttctctctgtattctcagtgcctggtacaaagtcgatagattttaaaagcccatagaagaaaacatacatttttccctgtttgtgggtatgtatggaagattctgtaactttgactagacacttgatattcagataaaatagccctaaagaaggttctcaagggggtggattttctcagactattgtgagcatagttcctaaagctgactctatgtcttgtgctgactctaatcccctcctggccatcatcccaggcttagctcacaaaagctgtgagcagggaggccaccagggatgtggggcaggtaatatgcttcccattatacagaaagtaatgccagaagaaaacagtgcacagttgctgctggttcccaatagttgatttgactcctttaaagatttagcacctgagttagaatccggatggcagaacttctctattggaacctagtcccactattcctctctcccttcattcaacactgggtttagaatgcttgccagcagcattgtggaaattacctcaaaggtagaaacacgtaactcataagcacacatgaataggtataggtcataatcctggaaagacggccttgccattgagaggggaatagcaggagcaaggctacggaagcacgggactctggttgagtctaggcactgtctgcatgtacttggcacattccttaaaaatggcagcaagcagtccattctcaaatggaaattggaacaaaaaataacgtaaaaccataaataacagaaaagaatatatactcaaacatgtataatccatatgcatgaacataactcccctattgggaatttctcataaagaatccccccaaaatataataccacgtccacaagaacccacccacaggccaggtactgtgcgaggcactggaatacaatgggggtaacatggactaggagactcatgaaaacgtcatgacaaacacctgggaaattctgaacgttaaatagtagggaagggtttctccaccatggcatggtggccactttgggcaggaagattgtggtgaggctatcctgtgcatggcaggatgtccagaagcatccctggcctctacccactagaggccattggaagccccatcctcactgtgaaatccaaaaatgtctccagacattgtcaagtgtctcctggagggaaaggggggaaagtgactccccattgagaaccactgctttaggggaatacttaagaagttgaggcatatctgctcactggaaaatggaaatgagctaatttggaggcttaaaacagcagcactgggaaaatgacataaattttaaaaagcagaaagtaatactgcatttattctgtggtttggctgaggttttgggtttcagaggaagctgctgagaaaagagagggagggaaaatgtgacccagaaatcacgggaaccagggaatctcaacaaattgagtatcttggtttgtgtaagattaggaacctggagataaatatgggtcaggcagatgcaagtaaaatgatcacacgtggggagcatggaaattgggtcttaaaagtgagttaagtcaagggtggtatttaaaatatgtcatatgtaaatatgacagagaaaccaccaatcaaaacagccatctgctgaaaccacccactatgggcgttcctgtgcctgccggggcgtgcggggaaacccaagagggagcaccagttggtgaacgtcagtcaatccacaaaccatctaacagaggcacagggattaaattcagagcaagacctggcaaaacagaaacagcccgaggccagagatgaagtgaaagaaagatgacaacctagggcccaggagggaagcttccagaaggttgagttatatttaagccctttcactgtatacctgggaccaaagaccctagagcagcttcagacataaattatgtatatacatgaacaaagacagaaagggagcaaagaaaaatgaaaacagcttgatttgtagggctttcagcatggcgggtggttttctttcccccctcgttttatttagacgtctgctgctgctgcttcaattttgttccggcaatacaagtaaaatatatgtggatgttaacaaagatgtaaagagccttttgaagtatataactgattataatttaacattcattaagtttcttttatcaaaaaaaaaaaactattaagttcattgaagaagtcataaaaacaaaccaaacacccaccaccttctcccctcctggggacatggcagtggccacttcaaagtgggtcaggtctccgtgaaggaaaggggctcttgagagagtgatggtggcccaggggccggtgtgatgtttcatgctggagggatacagctgtccgtttcctttgcctcttttcatcctgatggagcaaacggctcattgtttacgctgacctagtgaggttggcttcaagctctcccctcaccatgttgtaatgagatagtcctgaggacacacgctctgtccattgaaacagattagctctgatcacagcttaattatgtgaagtacagccaaaccctatttatgcttttcctagggatggggtggaacagataggaacgggtaattgacagacattaagaaatagacttaaatattgtttgtcctgctttagtacgcacgatattaatgagatgttattgtgagtgctgagtaaagaggttgctgccggctggttctcatgccaggcagccagcagaccttcttcccaagcagggaattagcgcaggtgttcccttggtgaaagcctggctatcagcatcaacaccttctagaagatccgtgcctcttggtttatttcagggagcctgtgcaactccaaaaggatggatgctggatgcatatggaggttccatgccttaaggctagcttacaaatgtatgaactcgtctgtcttttattccatcagaaatgaatgtacattgtaggaaccagacttagcagagaacacggagtattgggggaaacctcaattagggaataaagagctagtacacacacagatgtgtgtcacatcagactatgtaatggacacaatttaggaacaactaaggtatgtcctgtaattaggggacttgttaaatctgcactgtctaatatagtagccactagttacatgtgactgtttacatttcatttaatcaaattaaagaaaattgaaaattcagtgtcttgatcacaggagaggaattttaagggctcctttgtcacaggcggctagtggttctcatgtgcagatgtaggacatccccgccatcacagagggatttgctggacaccactgagtcaaataaatggtagtatgtccatagaatggagtattctccatattctcaatgaagtaaatgcagatattctggcatagaaaggtcacccttgtgtattgccaggtaaacaagttacaaaactttatgatattaatttcacttaaaaaacagatgcaacacacaggcacatactttttggataagagtgcaaaaaacacagaaaggatgcacaccaaattgtcggcattagttaccttgaggaggcgggggtagatgtttactttttattttcttcacatgtgtattgtctgaacatatttcaatgagcatgtgttactgttgtaattaaaaagagatttatgtgatgaaaactgatgaaaatgattgagaaacatgaacagagggttttctctttgcctctttagagactggttaatggtgctacctgagtgagattgaccagatggcttgttgggagaagaagggagctggtttggagtaaatccatccccaccactatcaggtcttgcccaggcataccctgcttttcctgaatgtcctgaatgttgttgtaggacaacaaatgcgctttataattattcataggacctctcactactaatctttgagtcgataacagcttctgctatagaagggggcagatcactgggcttaaatgtcaaatagcgcctgagaggcttaaacaaccaccagtatgtgtccctctgggagggcttctctgccatttagaagatcaatgagaagatgtcctccaggccagtgtgaggtggtagaggtgtgtgcttgcgtgggcatgcctgtgtgtctggtacccttacccactgaaacagcaaaggacatgccttctcccatatgacaaatcggtacattgatgatttcgagttaaaaacattggataaattgcagtttcagaaagggctagctgacttgtctcttcctacatgtagcaggccagaaagattcctctctgggaggggcatcctccccctgccagggcaagaaaatagcccttatcgccagagactgcggattgcaggctgcagtgggcttgaataaatacccttactgaagtggcccttagcctccactaggttttttgtttgtttgtttgtttgttttgagagggagtttcgctgttgttgccctggctggagtgcaatggcgcgatctcggctcaccgcaacctctgcctcctaggttcaagcgattctcttgcctcagcctctggagtagctgggattacaggcatgcagcaccaggcccggctaattttgtatttttagtatagatgggtttctccatgttgttcaggctggtcttgaactcccgacctcagataatccacacgcctcggcctcccaaaatgctgggattacaggcatgagccaccatgcccagccaccgccactcattttacacagtcccctgtatgtctcctagtgactcccctagaaattcactgaccctagccagatcccatttgtcctgtctttgtcagatttatcattctttgtctaaaaagttcaaaagcatcttgctttggccgcttcttcagacatcactctcttgtgaagatcccttgtacctggaaaactattaagatccgtatgcttttttcctgttgatctggttgtctgattcgtgtccatttggtttctaggtccagccaaagagcccacataagaaccaaggtggggttgggggtgatctctggtcccctttgtgatcctcttctaggagatttacctctctgctagcttacatactatgtgaatatagcgtgggctttcttcttgctcttcagaaagtcttctctaccctccctcctcctaccatggcgcattctgcagcatgacaggcattccactctgaggtgtgagccatgtgggctctcaggactcttttggctccacttctgcctttgtagctgtggaccacgaggcagtgactttgaaattcagtcttattctgcggaaatattacttactcgtccctacctcatagggtggtttttcgaagtcagtgagacaaggacagtgaagggttgaggcagtgctcagcacatagtaagcgctaaataaatgttagcttttgttgaaattaatcttacttttcactaaattgtgctgcaaagcaacgtgccattgcctgttcttcacatggctgtgtctctcctcctcagatggatggagtaggagggttgttggaagacaaaagcatcctgcttcactcttgtctctccaggctcctgacagtgatttgcactagctgattagtaaattcatggcagtgcctggtgcctgagagagcgagggttgggtgcagcttggctacagctctgaacacagcagtgggggctcagttgcttggaaaagctgccagccagtgagcccagcacagtcagagtcctgtcaatgcagtaggtgggtaaaataagacaccagtgtgcctttgaagcatgactttctgagggagaaggctgggagcctttacatttgatgactgggagaaaggacccaagtttttcctgtgtgtttccttaaaacagccttattctctagatgtgatttgttttctgttttattttcaaagagaagaaaatcttgttaatacttgcttattaactaacaatttcactttactggtttggtatgtaaaactgagggttttcttctacccagtggcagtttttgatatgaaacagtaacaacaacatcaacgtaacttgtatttttgaatatatttgatacagatattggttaaaagcattttgtacatatatattcttacatatttgtgggtatgtatgaatacatgtatatatgcatatatatgtgtgtgtgtaattgattctcattattcatgaattctgtctttgtgaatttgcctactcagtaaaatgtatctgtagctcccaaatcagtggtcatggtagtgttgtggtcacttgcagacatatacagagctgtgacaaatttgaatcatatgatgtatatgcttccaggtgcattcaaactaggtgagactgccttcttgttttagctttcatactacaaacaaatatccttttcatgaaccatttaatgccacatttgccacaattttatgctatttcttggcaattttgctgtcaaaatggccccaagtggactgcagagtgctctctagtgtctctaagtgcaagaaggctgtgatgtgtctgactgagaaaatgcatgtgttagataagctttgttccagcatgagttacagtgctgctggctgtgataaattttaagtaaggcatctttaaaccgaggcgcacgtaaaacaaggttatatattgactagttgactgaactgtgaccagaggctcacaggaacctaaccctgcatttctactaggagcaatggttcaatatatgttaagtattcatggtgacttcatagaacataagtaccataaataagagaatcaattgtatgcagacactccttgatttatgatgagattttatcctgataaaccatcctacatcaaaaaggcggctgcatgcctacctcaaacatcacaggtactctgcttcaccttcctcaactatgtcatgcctcaactctgcttggactctgcccaactccagacagggacaatgtgacagtagccagctcctctctgaactgacaccctgtaaattggacctactgaacagcaatagtttagcctaacctactttatatgtgcttagagcacttgcgttagcctacaggagggcaaaatcattgaatacaaagcccattttataatgaagtgttgactgtctcatataagagtattgtaccacatatttctggaccaggaaaagatcaaaattcaaaatctgaaaaatggtttcaatggagtaagtatttcttttgtaccattgtaaagttgaaaaactgttgtctagtcattctaagtcagggaatatctgtgtataaatcgtgtaaaatcctcccagaacctttatgagagggtgtggactgtgattcttaagttaatggcatccctctctgcctataacgatctcacgtctgtttttttgccaaaaaatatagctgctggggaacctgttcagggaagttgggatgtgtttatccttaggtgtttattcatctttccaagctcctgcaatcaaccagaaacacaggggaatggaaggcttagtgtttgttgtaccaattatgccacaggcagtatcttgtgtattttaagtaacagcactgctttggtaaggcagttgatcctactttcaaaggcaaggtacctgaatcatggacaatgaggccaccatcagccctccctctccaatcaatggatgaccatacactgtgcttgttccttccacatggagacccatacttgaatacttggtgggtaccttgagctaacctctcactttgtgtggaataggcagtgggctataaggggaaagcacacactttgaagccagactcacttgcattggaatctgggatgtctgacataacaacaactactactatttttttggccatttactataacctagtcgtaggttaaccatacaacaaccatggtaactgaggcacgaagaacatctttcttatttgtggtgcatatcacaatgtaaaggtagtcctgttgatacacccatttttagaaatgttaaatggtgtgctcaaggtcacacagatggaagctggtgaatccagaatttaaaagtagaacatttaatcccagagccagcctgccttcccaccatccaaacgatgctatgccacatcttgaagaatcagaaccaccttgtcaagatgggtgacaattacaacagagaaatgatgtaaaatgcagtgtgtagtttctgcccctgagatgagttcaggaatgggtccagttcctgttcttaaacacgctttgccctactgcttgcaagccaactcggagccttctgatgtttctctccaaactgacaaaggaatcagctgttccttctagagggggaatactttgacttgtgtcttcagaagttatctgatgccagcttattcacatcgcctcacctcctagcagctggagcaggaatgcagcagtagggtattgaaatttaagaggttggccttgagtcactgacttagctgggtatcccataaagcagagagcttatacatttctatcgtattagggagacaattccagagagtgagagtgaaggaagaggggattgaggcaggtaaggaggggaggcttgcgaaggcgcgtactgagctggccatccccaagtgcaactgattgagaggtttgtagagctttgtccctgagaagcctgcctcaccaggatgtggtgtggggagatgaaataattcctccactcattcccatctgctattggccatatgttggctcaaggggcgttcctttccttgcaccgtaggattgtgcatgtatgatggggctcctctaccgagttaagaaggaagcccttggcaagggcggagaggctctcagttcagagaggagttgtctgatgtcacgttgcccctatctgaagttggacagagcccaggcagagctgagatgtgacgtgagtgaggaaggcgaagcagtgcacccatgatgtttggtgcagtcttgaaagcgcagtcactatggagccgccccccgcctctccccttctgagccgccacagctcacgcttgctttctatgtcctgagcttttctgtacctctgtcttgctatgtcaggcattcatggctgtgctgttagggagccttttcaatcttctcatgctccagtttcaaagctgtctcaaaatgagataagttaaagcctaatacagttttttagaaacacctgtatttgtcacgctgacctaatattaacacaggttctcgtctctacttgaatgttacgcatctatcgcgacaccattaccaggactgcgctctgaatctttagagattatctgtgtgcctgatgtcatgaataccaagtagatgatgtaggatggctataccctgccagggagacctgcctggggtaccagtgagtttacaaagacttgcaggaggcagcatacagaccatgggcttgtagctttccagttcaactacaccaccaaaccctggcacctaagactttggttgttccccgtgtcctatgagccctgatcacaaggtgagcaatgccttctaggctgggaaggcagagttggcaagaactgccaaccccagggatggcatcaggcccgctgataattaaagggtgcctaggacatattgcctaagctgttattggttctagaggactcgacttcattccatgaggggtaaaataagtagatagggaggcattcagagcctgaactggtaaaggggggacagttataatattaccccaaagctacagctcagggaaaaccattagggcaatgtttttttgttgttgttgtttcttccttaagaagggatctgtgctatgtactttagcatcacctgagatggtgtgaacaatgataagagtttgaggccctgtcttttatctacagattcagcattccttggggtaaggtctgggagtctgtgttttggcaagagttctgagtgattctgatgtacactaaagtttgggaatgactgtcgtaggagtgttcagtaacttgggcctcctggaatgctctaagttgtgtcacagcccagctgagtacctgggacagaacagggaaaagcaaggagtgacgatgtcagagaggggctgtgagcccctggctttggagccagacctgtaccttcctggacttcagcaagttccagaatttctgtgcatgtgagtttacccctgtgtaaagtgaagatgacaacagggctggctgttattctagggggctgccccggtgtacctggcacagtgcagtcctgctgattttcatattgctctcattgccatccacatccgagggagtaaattagcgggatccacaagccacggatgagccttgaaccagagaagccacaaactagcatttaggacttcctgaggctcaggtatgagcaatgctgcccaagtgcatggcatgaaacccactacagaccatcggaaacctcttgaggacaccattcctctctggtagcctttggggcatcattgaacattgggtcagcatgttagatacgatgaagttccagatccaaggacaagccctttagatgcctagtatatggctctgccctggcatttaacgcccaggagattatattaccctatcaagcttatagaaaatggacgcaggtacaatatatcttatctactgccacattgataaagtctacagagaaaatagtgggtcttttaggacttacccattgagccttttattttaagtgacacattctagtacggacttaattgtaattctgataacattacttgtaatactgtctccagtccttggaattaatttgactggaaaaaatccagaaggacttaaatgtttctcattaaaagcattatagataacttattagacattgtgactaattgtagtatggcccaatgtaaagccatcccaattaagatgctgtttcttctcttgtgattagttggcaaaccttttccatacaactgtgccctctagaatgtagatcaattaagcatatataattggacggaaccatttgctccccagttatcaccctctccagtgagatataccccagccgggttggtaggcttgtgaagacaaatgtcctgatctcactttagggagttgacaaatggatctctataaggcagcttatgtgctaaatatttctcctggccccattggcagagatgtagtctgttttcccagtacagagaatttcttgcagcctgtacattttccctttaaaagataaagagaaaccattatgcagtttttattcctgacctgcctcaaggagcagatacggactggaaagcagcccctgttggataattgctgcttgtctcagagtttgagattctgccggggtttcttgagtcaccgagcatatggggcttcaggttggactgcccactccagtgcctgagaatttactgggaagttttaataaagtagagcagaaattttccagctgcatccgaaatatttgatgtcatgctgaattgcaaatccctagtcggaacatttgaacatcatctagagggatcaggaaataacccaaaggtttggtaggcgacttagaacaatggctgctcttaagagggaacaatttagagcgatttctttcctcttccttctctccaccttccccactgatttctccttcacgcacctatgggtgtgaaatgagaaaaaaatatcacttgaaaccaaatcaaaagctacagcaattctggaattaataaaagctcacatgtagaaggaagtgtgggtttatgggtagggtgaccatgcactacccaggtttgctttacctgaaggcagcggggcacacgtactgaggactattgggtagaaggacagatggggctataattaggggatgagcttccaacagattctcggaatgagctaggcatttgcaatgttcagagtatatagactggcacgtaatttggggtagtcgggtatgaaacttatagacacatccatggatttccctttaataaatcgtctcttctagtagtcatttgtcatcaacgagcaattcagtaaaagttggaattgagcataatgttgcatatcatttcagaacatctggccctaatatgtagtaacagctgtttagtacctgagatataaacaaaacatttttcccatggctgtcactgttcctcctcctggaggtgcagtatcaccgaggcttctctgtatttcctatcatgggtaatagtaacaatatcaataacacaatgatgattatcatgtattgtttaactatgtgtcatacactatgtcaagcacttttcatatatgatcttggtaaatcctcatgccagcctttcgtgggtattagatggcgaggggaaagtcatcaagccagagactgactactttgaaaattgaatacaagtctgtgcagtgctacagctaacattctttaagtactaaaataaattgcttgtaaataaagtaaatgaaaaaagaacacaactgtgtaagtcacaaatgaagaaggcaacaaaagggaacccagaagggttttttattttttggtgtggtcttcctttgtttgggatgtaagacactgattttcctgctatattatagtatgtacactgttacgaggtggcagtgcagtaccttggtcatgtaagccaatcaacaagacttgttcttttcctgatgttcaagggagtaattccttaagcaaaatcacatttatacacatgtcttttcaaatttttaaccaaatatttcaaaatcagttgtttaagaaaacgattacacctataccttcaatatcaaagcagatcaatttttaaaacaaatttactaacctagtcttcagatacataggtttgtttttctcactaatcctttgtggtcactgaaagagcataggccaccccagtcttttgcccagatagtgatgaaaatgctgatcttcgtgaatccaactgaaattttaacttcgtgcccaagctgttctagaactcaatttatcagatccagatttggtattctaaagactagagtgttttactttctgggtgttctttgggcttcttttctattcatgaccctttggattataaaagaagagaaacaccatggggcagatatgtccaagaataaagaaaagagaaagttgcgcacctgagaagtgccccctgctggccagcatcatttctctgtgtctcactacagaaggaggtctttgtttatgaattctgccctccccctcttgccctgagactatcacctgctttggaaagaatggcatcatttccagaatgcccctaggggcattagcttctcttctacactctctctcttgcttttcaatatggaagttaacaacgcagtctttgaagctgggccgattggatttcaaattctaactcagtaacttcccaactgtgagtttgagcaaggtatacctcttaaggctcagtgttttaatctgtaaaacaggaataaaatagaaataataacaataactatctcatggggttattataagagtcaactgatataatgtatgcacaccattgagcagtgtgtcttcctcattattactccttgatagatagctagaattactgagcatccgacttagaagtctaattctctattttgattttattcctaaactcccatgtatgcaccaccaccttaaactcggtacatctatctaggccgtgatgacccctctactggcagctttagtccctccctaatcactgtatttctatcattgatattaatattcttgaaatcacccggattcgaaacgtccagtatcattcttggctcttccctccactcttctctgatcctttcgcaccatatcatcccctactgcttccccacacctctatctaggtgatcagtcaccaactcctattatttcctcctccatctgccttgtaaatcttaattccattctcctcactgattcactgttctccatagaattccttgtgactttcttggaggtggggatctcatgtttcctttaagaaaggaaatatatatgtgtacacacacacacacacacacacacacacacacatacacacacacacacaaaatatatatatttggagacagagcctcactgtgttgcccaggctggagtgcagtgacatgatcatgactcactgccacttctacctcctgggctcaaatcttccttctgcctcagcctcctgagcagctgggaccgcaggattgcgtgccaccatgtatggctaatttttataaagttttcttttttttttttttttttttgtagagatgatggggtcttcctgtgttgcccaggctggtctcgaactcctgggctcaagcaatctttccaccttggccttacagaatgctgggattataggcatcagtcactgtgcccagccccaggaaacatgttttatttcttgtgcccccatcagtgttcgacgaagccccgggtaggaatttggtagatgcaggtgtttgattaatttccccttccttttgtttctcttctcagccgtgtgtctctttcctctgtcattcattcaaccattcattcattcattcaataaacacttactgaggttcacactcagtcaaggaactgagaacactaatgccattactagttctctctagaaactcactagcaggaaataaaagtatccccaaggagaaagccttgggaattaaaattttttgcacaacaaacgtttattgagcactgactgtggcactttgctttttagtgatgaacaagatggacacaaccccagccctggtggagcttaaaacctcacaggtattagatgagcatgagataaataattctacgagccatgaaagtcatgaaagggagaatgcaacagcacaacaaaaaggttttcatttctgagatggcgagagcctccctaaagaaatcatatttaaacctatgttgagaaatcgagtatagtttagttaaacctgtatatgttgagggcaggaggcagagtgttcacattagagtgggcagagaatgattgctccacaactttacaggcatgggttcttgacatatgcatacaagctcatccatgtggaagtgttagcaacagaggcaactgtatgggcagcaactccaggtcctcaaaaactgagaaaactaaaattctatccaggtccggcaatgtgtgctttctgcatctttagtatgtgagttggtttagtttgttaattaagcctatggaacaaaagtgttctttctcctccagactttcaaaggatgtactctagggctcgaagaaggggaacagagctgattatgttggtcctgttgtttgtgtttttcttcccatttaagaacgtacatttgaaggtgcagtcttgaaattcttgatatggatggcagacacttgtaatgagagaggaattagcagaaaatcacacctcatttcaataaatcttcaccccttaaggcagcctggtgcccttcctgcattggcctatggaagtcaccatctggactgggaggattgatgacttcagtttcacccctttctaaatagtgtttatgaagatccctttcttcaggtcagactagagattgtacctacaaataatattgtaattggaccacttagttttcatctttgatttgaggtatttgaaatgaatgtgagattaaagcaaatgaaggggcatgagaagtgttagcaatcctccagacagggaaaatttcttttcattctgtctccatgatatcaaactgaaatcctcagttaaccacagcaggggcaagtgcctgagttgaaaatgtcttcatccttgtattcttaattcatcacctgagaagtccttggatcaggtacgtgaaaccagaagagagatctccctggggatttcatagatggtggatatttaaatatgcaaaacattattgagaaatatgagatgtgtcagccatctcctgtgctaacattttttccaagtcaattactttgtggatgtttgaggtgggggcacactggaaagaaagaaagaaagacaggaggaactaaattatttataattatggtatgtgttggcgggacgggggctgccttctgagacacaaatggatgacaaagaataagttatctctttatagatagaatgtggcaataattgcattgtctctggattcaaaaagtcataatctattaatttgatggatatcaaaaagctataatctgtcaatcaggtgtcagaagaaagagtctctcaaagctttgaagcatggcatttagaatacccctggatacctttatttctattctaatattaataggaaggaaggatacaaacatttttggcatagttagggaatggatatcattttagctgtcttaataattttgcaacttaaaaatcgtattggataagggtgccgtattgaaaaaaatgtgtaaaagacacactacagtgaattagagggagataatttcatcctaagatttctctgacattaggcattgtggcatcgctttcttggtttaaatgtgaaatagaacctgagattatttttcataaatttatctagcccatctattatttctctatattatatggctgtatacttgaaacataccaatggggactgaagaaaatgcttaagtctataaatggaatgtcaaactgatggaaggaggaaattggagatgtcacacacagtaaaaacacagcttttccaggacccagtaagcttgccattaccaaggaattaaggtattctcctctggtaggaaaagaatttgactccttggcccagcacagtttcaaagctgcatgaagtcacgtttgcctcattacaattcctttggttaaagatgcttttctaagtacttcagaaaatgtatgcaaaaatattttttggtgcggaggccaccaaacctgctggactcacgttcctgcttttggcaagcaaagcaaaagaaccttctgggttcccttcctgcctttcctactgagatcaagctgaaggtggaatttttctatatatccagtccagcctttgtgacctctgcctttaacacaaacaccttgtttaaaaagtagacttgagggagggcacttgagttcagaagccaaaagaaatgggtattgctctttccgcgctaagcagttctgaacctagaccatatccttgggagaccagagcagctgtaagcagcaaactgcctcttttctgcctccctgtgaacctgcttccctggagggtatgctcaaactcaattccctgttttattgttcaaaggacagggaagaaaggagggagaaaagattgattaagcccccagtctgtgcctggcaacattctaggtgctttgtatctgaaaatctattttattttcacaatgatctcatccatgtccatggattcaactttatctacctgaccaccaataattcatatatttggtctttcggtttagtcatcttggtgctccagagctgtatacccactgcctacttgacattcttcttacatgtctcaaaggcaccttggattccacgttttccaatttagtgtgtgatcttccctcctaaactcaaggctttctagtgttccctacctcattctgtggcaccattctccatccagtttttcccctttctcacagtcaattaaaattctgttgattttgtctgctaaatatctcagcaagaatccatccagttctctccctctccattgccagtatcctaatctgagctaccatcatttctttttttttttttttttttttgccttgaatatcaatctggccccccagatggtcataccacaatcactcttaccttcttccaatctttctcttctccccaaccagaatgattctttgaaagcttcagtatgatgcatatgacgatgtcattcatttgatcaaaatccttcagtggcctgccgttggttttttttatgaaatataaaacaaaacctcggacatgagctataagaccttgcatgagatgcactttctgagaccagcccctccattctcctttcatgccactctacactttcaactccagccaccccagtccttgttaagttgctgagactatcatgcacaaaggtatttacacagttttgttttgggtttctttgttttttgttttgttttgttttgttttgtttttttcaacggagtctcactctgtcaccaggctagagtgcagtggcgcaagctcagctcgctgcaacctccgcctcccaggttcaagcgattctcctgcctcagcctctcaagtagctgggactacaggcacctgccaccacagccagctaatttttgtatttttagtagagacggggtttcgccatgttggccaggatgatcttgatctcttgacctcatgatccaccctccttggcctcccaaagtggtggaattataggagtgagccactgcgcctggcctacacagtttttatgcatattgctctctgtacggagaaaggtaatgcagactcattcatcctttgtatttcaggtctattgccacttctttgggaaacatcacccctcagtctagatctgatacccctcttattccctcttctgttttatacctcttcttcctagcccaggtgtttacaattcccatttatttatggggaatatgtgattattgtattttccctactgagattcaaagctatacaaaggaaaggactcttctgcctttttttttttttttttggtttttaactcattatgaaatccccactgctgagcacaatgctgaacacctttgaagtaattaataaataacgactaaattactgctgtgtagataaggcagataggattaggttctttcaacagtgaggaaatcagagctcattctaacttaagggtttagaagtatcagaggcaggactctgacccgggtctccagactcacaaaacacaatacactataaggtgtacaatagcactgacagatattttttaaaggttcctctcatctcactatactaacacaaatgttttcagttctacaatctacatttccccctccaatttttctcctcttttttgactgccttgatggtttcagtgggtcctggttaagcctgtctttaagtttctaatcaaactaatccaagtgaatttggcttctgaccttgctctcacatatttgccatctctaaatgattgatgtctgcttgatccctgttggaaaagcgtctgaagatatgatccagaaaatctatagttgcaaatctagcataattttaatgaatcgtggtcagaatagtaagaagcattgcacagaaggcttgcataaaaaatatgcatcttctgtcatcttcaccctctacactggcctcccaagtccccatggaaggtatctagtacgggaaactttcttttcctgtaagaatgttgtggccaaacatgctgtgtattggatggatggatgggaggatgatttatattttcatctcggtatagttcataggtctaggatcagaaataaactagaataaatataaatattgcttttcttaacgttggtttaaaatgcaaatgcatggcatacagaaaaaactttttttttttttttagctctgaaagctcaatttttactacatgatttccctagtagaagtactttttgcagggtataagaattttctgtttgcttatctgttttcagtctagaatgttcacttcttaagggcaaggaataggttatgtttaccttcttatctctggagacttgtataatcctagctggtcctaagtactcaaaagttttcttgaatgaaacaaagccttctccggatgaggaagcttgtcagaagcttgagtgactggtaaggagggtgaatctctgctgctgatttactaagaaatatttggatctttccttgaagctaagggtatatacctacttctgtgcaaaacaggtggcatggctggcccttgaagagtacacagtttaaggagacagtaatgggtacagttatcttcttaaagatctgggccactttgttcctgaaaaagtgtgggaagtttctctcttaggcagtctatctcttagagcccagtactcacagcaaaatatttataaaagaaaacaactctttcatcatccctgacatagcctgccctcagcctagaaagaaaaggccaataattgggactgtgtggttccaggagataggacagaaggatagggccaattcaacaggtaagaaagacagcacactcaagggagcagactccagttgatcaccgctgtgggcagctgaggcacactcctcccaagacagctatagaaagtgcctcagaaatgtctgtctctaggacacggttcccattatccatgggtcaaagcttgcccgaggaacgccagctcctttgcattcccaaactttgcaagcatgtgtcatcctgcaggttctcttgggtattccattgtaaggagtctgagaagctccaaggaagaatgcagaaatacggggtatagctgaggccaggtgctgtctgatcatatacctgggaagctgttgttgatcacgtacctgggaagctgtctgatcacatacctgggaacctggttgttatatccatggctggggagcagggtagcagggagcaagaactgtccaacataatctagtttacctatggactttcaaaggtttgcaaagatttacctcctactaaaatggcttgtgagcatggaaggcttaaacattagcagagcaggtagaaaaataacgcctggtaagatgccaaatggtggaaaccgaggcagaagatagtcctctggacaaggtcagcataatctagtacatatgaactcactcacgctcctgcatcagactcccctggttttggaatctgtctctgttgcttcccagtggaacctgagaacattgtttaatcagccttggttatgtattcgtcgtcagataaatagggacgttaataccaacctcatactgtttagattttggatcatttacaatgagaatgtgttcatctgttacctgtgtaactgaacataataatactatgtttgaacagatttcaaaaatgggtttggatctgattttaaaacatttgaaacagatgtggaacaagtttttaaagaaggaaccctatctcataagattgtcaggatcattaaacatcacgagtatgagcccacaggaaaccttcagtatatcgtgatcttcttgacggtggtgaagaaggacaaggaagaccaccaccataacacacgggtcttctttggaatggaggttccaggatctatggggaatttgcttgtccctatccactctcatccctccactggggaagagagagttggtgccagtcttccagcgtaggtcattgttggctcagcatctgggaagaatctgggcctgcaggaaggactcctggacagtgccatgagcagctgataaagaccaagagaggggaatgtggggcctggtctaatgagagttactgccataactggcatttactgagcacatcctacatgtgactctgttctaagtactttctgcatgtcgtgtgttagacatcaagagtcgaggcaccctcattcacattctacacatcatgaaactgagacttgtagaggttaggtagtttggccctcatcacagtgccaggaggtgcgggtgtaagatttgaacccaggaagtgtgattcttgtagcaattgctgtgtggttgagatctggtctgggaagtggggctaacacagaagtgtggataggacagattatttctgcgctccaaagttatgaatatatatactccaaaatatgcttcagtgactgagtgagacataaatgggttactctgtcagtgatcattatattactccccatccctgcatgcatgttagaaaggcacacacaagctggaataatatgaatgacatttaatagactacttacaaaaatgttggaagatctggggaaaactaacgaaggaactttccgtacttgaggcctatcaatagcaggaagttattactacctctaggcctgaaagggcaaggagaagggggccaatggaaccaggagatagaaggctggtggagaggaccgcctaacctgggtggtggccataaagcgagggagctggagagaaaaagacaccttaaactcacttgctcagtagctcccatgagccaaatctagtggaaagccagagaagaaagtgagaagagaagggagcccataaagaagacaggactgcctacaaaggccagtgtctcagagcacaaatgaggatgcagatgagagcaggtctgttctggcatggcaaaggggcttgcccagcactatcagcaatctgcaaaaagatattcttgggaagactctggtgtctgaaagattaaagggaaaatgcatccacgtgataaaatattattcagccagaagaaggaatgaagtactcttacatgcaataacagggatgaaccttgaaaacctgatgccggtggcaacgaccccataccgtgtggttccatttagatgaaatgtccagaataggcaattccatggacacagacagtagattcgtgattgccaggggcgtggaggaggagggaatgggaagtggctgctactgggtacaggatttccatttggggaggtggaaacgttgtgaagctagatagtggtgatggttgcacagcattgatagtgttccagatgtcattaatggccaattttatgttatgtttgttttctgacaattaaataagcaaatacataaatgagaaagaatttttctctcataatgtttgtttgcctcttactcattttctgagctagtcaccaaaacgtatctgacactttcttgcttaacctggcgggagtggtagcggatgctcctggtgcccccgttgcattccctcacctttctgccagctcagcttccagtagccagcgcctgcctgtgtttctctgcctgagggctctctccggctgccaaagcccgtgtccacgcacagcagtaccagagaattaccaggtcccaggagcagcactcgggtgaggactgacatgcgtcaatgtgtaaacaccaacttccctgcactccaggtggggtccagagctcagtgcgtcttgctggctcccagaggccccagcccggttgagctccagttgcctgcagcagttcccaggcttagtgcacttgactgtgctgccacctctcctttcatttcccctcttccctcctggtttctccttcaccttccaaatcaggtggggctctcaagcccttggctcaggatttataataactacggagtaataatagataacatgtattgaatttttattgttaaaatgtgtatgagaagacactggcttgtgttcattttgcctctcttgttcccaatgataagactgccttcacgcatcaggcaaataactataattggttcctggacattagcataaacagaatcccctagggaaagtgctaaaagtgcagattcccaggccccacccatcaacatgctgattccatctgtctaggtgtgagccttggaatctgcatttatcaagcttttctggttcttctaatgcagaatagagtagaaagttttcattgaaaaacactggacactggcatgatgagaaacagaggagaggccacctattggaggcaggcactggcatctggtcagtatttcaacaaatgtggtccctcaagttctgcagggagaaatactccattacatgtatacatttactttctcttaaactgatgggatccatatccaagtatgaaagttaatttcggtatttaataatcattaagtaaagagagagtgaaatatctacactatgtaattacataaaacatgcttctggcaatatttgccccctaggaaattcaaataggaagtctccaaggagcaaggttgtattcttggaggtggacacaaagtaattgagctttgctaatggagataattaattaggaaacggatgtgcttgcttctgagaaaaatattggaaagatcttctgagaaggcctagccctctgctcttgtaattttccgaagtctgtgccaccctgaggactggtgcttcccctgagccatgacccagccacagttaggaattaagggagcagaaaacacacagccattgcccacagttcaggctggtcctaagaatgcctgggccctaggaacacactatctccaggaagcagctctgaattagacctcgggttcaagttccagcccccacttatcagctttctgaacttagccaagttattcagtttccatggagcttagtgttctcagcttaaaactaggggttgtaatagcagaaacagtcatcagtatccagtgaaacaatgctctgcaggaaaataagtcgtagatcagaagatgtcgccctggtgtggtcttactaaaccttccctgtctcagcccggggtcttgtttattgcatctgggttacctgtttgcccctttctgtccaggtttgatctgcaggaacctagccttctggtctaacctttctagcttgtctgcttatcaccccaacctccccgctttctggttccagatgctagcctgttcttgccttgtatatctgacttgctgagctcactcttggtgctgcaaagtggccatgccatgaatcttccatagcccgatgcaatgtcaccccagtgacacggaaggatggccgtatggtgagagactgcattcagaccactgagccttctcttccctaattatatcatgccagaaacagctagaccaaggagtcaagcacacaaatatagttggaccagaaggaccagcagctctcaaggggtaagagaataaggaatcatgtgagcattcatggattgaggaatgcatccattattcaagcaagttgatagagataattaattaggaaatggttgtcttactgtcctattcaccaagctatccacaccatctagctcagtccatactttcttaatgagggagaaaatgagactcaagccaagaaggcaaagacttgatgtggatgatattttttctatttttgctttctggtgatggtagacattatattacatattattaggttaaggtaccgatggttttgttttctgtgttgataaaaattgtgcgctttttattcttttacagaactaataaaaacatgacacattaacctttgacttgtctagtctcctcttttattaaatctgctctaagcagttggatggggagtgccttttcgcctgtctaccccttcccaaggactatttatattgaggcaaccaaatgatcaaggaagaattcgtgaatagccatgatcaaagtaaccagacagggagttagaggttcaatcgtatttggggaaaatggtccaatgatggggaaagggcccaggttttgacacctgaagacatccctggatttcaggaatttgaggcagatccctagagctcagatctaggattcagaacgaaacggtgactgtgagagtaaaccatggtgtctgacataagggtttccttgattaccctttaagggcccctatgaatgtctctgggtcatcagtcccttagataacatcatgtgtctacagctgggatagcaagtaggttttgttttgtgggtcaactcacatgaagaggatgcctagatgtctgcggtgagcaagattctagagctcatcaggaaagtatgctgtagtcaattagtgatgtctgccatgtgcacgggtagagaagttatgtcatgcataccacagactcaccatctcagcttaatagaccatgaagtcaggatctggggagctaccttaatgtatgaggactgtttccaaaatatttctgaaaactattgatactagatcctacctggagtctctactggttccatagcatggaactgtttacaattgcttttgatcctttttccaaatgattgagtgctttggcataaacaggtcaggtacagaaagcacggcatttgagaattatcctctgcaaacatgacttgcaggcatagcctgagcccactcagagcccatacccaagttgtgctttcttaaggccacagcctccttctgagagctgaggaagataagggtggaggacaaacaacttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacattgccaggcaaggcctttctgggagaaatgatccaatgaggggaaaaaatacttcagttttgttgagagatgatcttaatctgtttgagctgctatataaaaaaataccatagactaggtggcttaaaaacaatgaatgctcatttcacagttctggaggctgggatgttcaagatcaaagcgccaacagatttagtgtctggtgaggtcccgctttcctcatccatggtgccatctagccgtgtcctcacttggcagaatggatgagggatctggatggagcctcttttataagggtactaatcccattcataatggctcatcctcatgacctaatcacctcccaaaggccctgcctcctaacactatcaccttgggggttagacatttaacatatggatgttggggggaataaatctttagcctgtagcaaagataatgagatcaggtgtaggtgattaagtgacatctggagaaagaattattagctgctaagaaagatgtgtttgtgcctgtgtgtgtgcacttgcacatgtgtggatgtgtgtgtgtgcatgtgctctgtgtgtgtgctttgtacacaaggcagagtttgcagtctgtgagggggccagcaggtgttcaaccccgcctggctcaggcagctttcgcttcagttggcttttatctcttcctatgtgccctcagccctgtgtcccagggagaggtttaaccaagtctagaatgttccactctgcttagatgccacttcagaggtcttaaaacagaacctttgttttaagcagagacagtcctctttttgatacgtggttttcaggtgctccctttaggaatggccgccacccacatatcatggttcctctagtggttaaatcatgatgaataggcacagagagctgataattaaggtaggaaagagtaccatatttctcttctgcattatccctagtgaattacaattttttctcccaactgcaagtagaaatgataatcacccttagctccacttccacacccttctcagaaatttgggtaatgcatcctcatcttaattatcaaaatacagggttatcatttgcagagaacatgtgttttgtgtttgtggggtctggagagagtgatcatacaatttctaattcaaagcagaatactcttgaaagtaaatcaggactttcctgttgaaactagaacaggaagtcaccttagcagtggtagatctttgaattcgtctcctcctggttctgcggagagccatgagagactagaacacaatcaccagttaggatcaatacacttataaatgcagagggtcttagcatccatttgggtgccagcttcccttgtgtgattggttactggtgtcaacggagattgtatgggagaggaactaaagaatgcaggctcggcttttcccagaggcagcagtgcgatgcatgggtcacagaatatgccagagaacaacgaggccagtcgctcactgactatggaagatgagtccattatttaatcactctggccttcggtttttcagctctaaaaatgagaatattcctttcctcaatgattattgttatgattcccggagataacgtgcatgaaagattttagtgcaggcctttcttccttccgttgacaacccagaatgttgcttgatgcacaggggaaatagagtgatcaagaagagcctttataaatgagagttgatgttgagtaatcattttgggtattatcaatacccatggccataacacccccaccatgtggaacaacacagggaacacgacttcttactcaagctacaacaggagaattcttccttggatctctcttacacagacaacattgtctgtttttcatcaaaatgctagaaatgagagctcaacatttgtaagctcttgcttcgttcaataaagattgtgtatgggaaatccactgcttctctcccttcgtagatgtaggaatctgcctcagacattgtacaaatgggcagagaggggaatggaactgagtcttacccattacgtttaggatttcagggctgcaggtcatctgtttacctaagatggagaggccaagtcctctctcatggtagctttgaagctggtgtcagggaaaggtcagtgcctgtgaacagtgatggaaggtgtgtaaaggaggaggcagggtttagcacaaggggtaactaaatcttaacttctgggatactgggtggtggtggggttactatttccaatttatagcaagatgtaagtgatatcagctggaggacaactttactggtctatgtgggtgtattagtcggttctcaagctgctaataaagacatacctgaggcagggtagttaataaaggcaagtggtttaatggacttacagttccacatggctggggaggcctcacaatcatggcagaaggtgaaggaggagcaaagtcacatcttgcatggtgacaggcaagagagagcatgtgcaggggaactcccatgtataaaaccatcagatgtcgtgagacttattcactatcacaagaacagcatgggaaaaccctgcccccgagattcagttacctcccacccacttcctcccatgacatgtggggattattacaattcaagatgaaatgtggctggggacacagagccaagccatatcagtgggatagatatcatttggaatatggttgccttccattctgatctcattctatcaaagttggtagatcctaacatggtgacccagcaagagtctcttttcaaactggctgtcctcgggggtaggagcagagccagggcaaaccgtcagggatgctaagtaaggagcttcaaggggatccaaggcacctccttggactcagacatgcttgggaccgcgttcgtaggacaacttttactgtccattgccacaatgaaacatggcagtgacagatgtaggccctcagtgatcacagatctatatggcagcaatggttcaagtgcagaaatgacaacagtgtttgtgattttacctttttgtgaagctgggttactggggtttctgtcctggaatctctaaacaagtaaccacagggtagttgcttggctcttgcctcaagtgaaccagccaagagatctcgtccaacactggtatagcctggcagcaactgctacttccaggctgtgtctcgaatgccctgctgggctccatgtgtatctgggaacatggtttctgatctacaaatctaagcccctaaatacacaaaagcgctaaggcaaaccatatgccttaggctcacttttaaacctctctgagcttcagcttcctcagctgtaaaaagaagccatgatcacaggcatgtttatgcactaaatcaaataatgaagctcacaagttcagccctggtcatcaccattcaagactctgaagtctatcaaagcagaattcatgttctctggttgcattttccatcaatggagactcagaaatatttattgaataaaacatcaactatgacaacatattttacagtgtaatagtgaaaacatcattcatctgatgacatgcttcttttgaaccattttgggatggttctgatattgtttgtaacaagaaataaagatccgaggatgatcaagtgagcattcaattattcttaccttcatttaaaaaatatattttcaatattaaggaatttgttgttattgttatttacaaagcaataaaataaggtaagaaaaatggagaggcctgggttggtgatttggtcaccaggcagattgagaatggaaagaaaagggaacagggtaaccatgtgaccaatttgcttcttggaaaagggaccaaataggacccagagaggggcttggtcaggcttcctggtcactgccagtgctgagacattaaagatccaggccccacggagaaccagggcacctggactttgatcttgccataatggtatgcctccatttaagaactaggtcagctgtctttcacaccagctgtgttcttcatgcttagggcaataacatgtataaagtaatgggtatttttctagtagggttaacacacttactcaggtttattcttctaacttgcctgcatccaaacatttttttttttttttcaagataaaaccagcctgtcaaactgtgcagttgacattacttggtaggatgcagaaaatatctgaattagaaatgggcccatacaggttccagtgggaatggctttctcagcaggtatgaatcactgctattaaaaatgtattccgtaggtaaattgttagttatcatattcatccactcttacagaaagccaatgttatcatttgggtccattattaagactatcattatcatagtcagtttagtaacctccttttacataacattggattttttgtgggttttcaagtctcttccaaactgaatctcacaatctaggtttatttttgaggccaccttgcctgaaggctcgaggatgacaggagtgacttccgtcactgccatatttcttctacacttgaagattgttttctgggatgttgctgcaaatggcaaatgtgtttgatgccctaatgtttaacataaatcaggatcatggatgtgcatagccccctcccgtttctgtaaagtattgtaaagggactcctgtcctcagagtgccaggcctcacatttacattctggacaaactgggctgtctgcttgaaagggcagataccacaggttggagcaaacatagcttctgaagaagatgtaatgcatttctgtcccagtaagttgtgcctgattaagatcttctcatagctgggggcagtggctcacgcctataatcccagcacttttggaggccaaggtgggctgatcacttgaggtcaggagttcgacaccagcctgaccaacatggtgaaacgccatctctactaaaaaaaaaaaaaaaaaaaaaaaaaaaaaaaaaaaattagccaggcatggtgttgcatgcctgtaatctcagctacttgggaggctgaggcaggagaattgcttgaacctgggaggcagaggttgcagtgagccaagattgtgctattgcactccagcctgggcaacaagaaactctgtctcaaaaaaaaaaaaaaaaaaaaaatcttctcatgaccccgggtgggtggctggggtggggttggtggagggaaataaatatgaagaagaatggtgagacaaccagtgggcatatactgtgtagactaccagaaagctttggaaatgtgtcaaccctaaagcattgctatttttaaatatttagttgtattttaatatttagctataaatgaagaacttggcttggacacaaaaataacaaaaaattaatatctaagagtcatgttctctgtggaataatcttagggctggtctgtctttacacatttattgatgatccagaagaggaagcacacaagtttgtagattagcctaagctattctggatagaaaatacacagggccctagcacagcctcgtgggcagaagagttcatctcgtgagaatgagcaaagagacacttaagaaaaaaatctgatgcccaaagcctttcatataggtgaccattgtacccacagtaatgaagcagaactactgtgctctggaagccactatgcccaccgttgttcatgaataaaagaaacatggtagatatccttatgcatgtgtgcacatgcagcacacctggcctggcacaacctgctcacacctctgggagtcacctgggtgttggctgacgcagcctggcctcggctgagctgactgtcaaccccgcaactgcctgtcccatcatggaccagaagcagagccagggatgaggatgaacgctctagttgcctgtggcagataaagaatcagtcatctagctgggaaggtaaaggttgagaggaaagccagccaatgtctataaagacacataggaaatgggagaatagagccagtgagggacatgcagagaaacacctagattttggattcatttacacattcagcaaatatttattgggcatctatggtgtaccaggcgctgcactggactcagagatataacaatcagccaaatgaacaagtctggaccttcagggaccctcgtggaggtgttacctacaagtgaggaaaggaagaccaaagtgtttgttagttagttactatgcatcaggtactgtgcacctcagaggccacctgcagtcagtctccctatatgccaatggctgccagcatcttcctgctttggggaattctcagcagccagtagcagcttgcatagcctgagcatgtggcaggtgggacttgatgcaaaatccatacccaggaaaaatcttcaagctataggggtgaaagttggtgaatgggtgtcccagcctccctgccctttggtgggacaattctgaggcctgtgccattaacttcggcagtaccttactcattaatgcaccctttactgacattttctccttctctgtctcacttactacttggggagattgtcttccaaataaactacctgtatccaggtccttcttatagatccactctggggaaaggcaagcaaagaaaatacattataagcctgttgtactattagggatggtgacttccagaagctgactgtgataacctttcctcgggcttcagaagaggctaatggagagttgaagggagaaatcaggaaagatggtctcccctcaatattctgacatgggttaataaggaggcactggttcttaaattgggatctcgatgatgctggactagcagcagcaatatcacctgagaacttgctggaaatgcaaaccctcaggctttaccgagacctcatgaatcagaaaagctgccagcaacctgtattttcacaaggcattcaggagattctgatatatgctgacagttaggaaacactcatgtaaagcatgtctatcttcccttcaattatgtttttcataatctgcaaatagttctgtcacttttaggggatatggctggacaatgaattatctgtggcttcattagaaaagtacatgaattatattgtggacagcaaagttatactgaagtgctgaagggaagtcaaatgcttaggagtgtaagctgcaggaagaaataggcagagaagctgggatagtttacccagcatggtaacttctatgttattaggctcaaatgttcacactctgcctttgaaataagtcattagaaactatattagtctgttctcaccctgcttagtaaagacatacccgaggctgggaaatttataaaggaaagaggattaattgactcacagttctgtatggtagcggaggcttcacaatcatggtggaaggcgaaagaggagcaaagtcatgttttgcatggctgcaggcaagagagcatgtgtagggaaactctcctttataaaaccatcagatctcatgagatgtattcactaccatgagaatgacatgggaaagagccacccccatgattaatttacctctctcttgttccttccatgacatgtgagaattatgggagctacaattcaagatgagatttgaatgggagcccagccagaccacatcagaaaccttctgagaggatgccttgaataggtgatatggcagtgtggtccttagcaatcagaggagagagaacgtgggttctctgtgaatgaaatttatattcctagtttccgtggagctgtgtgcatgaaaaacctaggttctcagtagctgggaggagacctgcacaggcatttttagtatatgtggtaggcagcttctaagtgaccccggtgatcctcacttcctggtcttcacggcctcaggtaatcctcttcccttgaggaactggcttctagccaatagagtacctcaacattgagggaggtgtcttctgtgatcgttttacaaaagattttgccttccaccttgttagattctctctcttgctggctttgataaagcaagttgtcattgttgaggagggccatgtagcaaggagctgggggtggcctcctaccaagacctcaccagaaactaggagtctcagtataatagcctcaaaggaaatgaatctgccagttatcatgccatggactttgagatgagaccccagacctggatgatcctttgaagccttttgaagcaccttgaagcagagaagatagctaaggcatgccctgtttcctgacccagttaacccatggttgaataagtacctctttattttaagcttcttagtttgtggcaagataactaacacatacatgaaagtctaggcttgggtatcatcaaaggacctgctagcagaattcttgtacatgaaaacacagttgtgcaggacatatctgtgcacctctttgctgaaagcaacatcctcaggaagaccacttcccagcttgcgacctaaacatttaggtctaaacacttgagctctaaacatttagttactcgctctcccctgtattaatgtatgctgcataaaggacccccattttcctacattaaaccctgtataagaacctccaagtagacacttatgcaaacatgccaagatgcaggaccacatccaaatgataagttgctgtcagtgaatcattaatgagcactgctgtgcaccctgccacatgttaaaaggtaaaattacattctgatgtttatttgagctattgcctattgccacttgaggcatatttcatggaatgataggagtagagcaaggtatttattttgcattattgacccaaggtgccatcagagtcatgaggtccccattaaaattccagtgaactcttagattctgccattcctagaaaatcttataacattcttggttcaaacttctcatctgtgatttaatgggatacactaaggtacagtgaaggcctggattaaaatgatgtcatttatttgctgcgtacatggtcctgggcaagtaattgaaacaaactctgaacttcaatgtccacatctggattaaaataaaaataaaacatatacttaaacactatgatcataaaaaattcagtgcctggcacttagtaggtactcaataattctgtctccccagttaatttattcacttgcatatagagctatttatgcagaaaagtttatgtgacaactaccagatatggatacttttatagaagagtatccataggaaatggctcagccttctgtcctgcaataaaaagtaatgtttgactccaagtacatgagattgaacagagttatttgagctacttttgataaaatgtgacaggcagactttggtatttcaccaccccaacatttttttatggactgctcactatcactgcaacattcagcacttttttctgtgtcaatgtgatagacaatattcatattcttcttgggtaattgcctttttagctgaatcaatggcttgcaggcatgagaaggaggctgttttatctcaactttatttatcttatgattatactaagactataaaactgaatctcccctccttcccttcctcccaggcccattcccaatcatcttctaaaacctctgttaatactcagcttttttggtgaattttcccactgccatgcttcatgttaccaaaatatttcccttttctgacaacattccaaatataaataaggacctactgaatgaatgaaccaccagtatgattcacccaatcactcattcaaaaaatattctttgaggatttactgtgggcagaccctggagatataagagggagggaggaggatgactatgcctacttgtaaagtggacagctgtggtctcttctagaaaggaggagtgcctataaaggaggcgccttgggtattcttactgagcataacagatggaactgaggagtcaaggagggaagccttctctgattatatgaccatggagctaagatttgaaggaaaacacataatggtgcatgtgtgtggggagggtggagacaggaggcagtggaggagctaagtatcccaaggtggaggaggcagcgtgggcaaagtcctgtcggctggaggaagggcatgttcttggtaccagaagcagctcagtggaaaggatcctgaagcggaggctggtgggccgagtccagaccctgggggccttgtcaacctagctgctttgtgcctggggcaatgaggaggctgtgaagcatcaacagggagatacagtatttagagtatctcaaagtctccctctgtgtggtgtttggatctttctgaatcctcagatgtaatataaattatttgaaagcaaataccaatttgcttctaattctggatctcttactcaggacttggttgcccagaggaggtttaataaattctttttaactctacttcccaccaatttttctcccttcgatctgttcctatatctctaccattcatggcagggttagcacgtggctccaatggtgagcaggaaggacttcacctcttgtctgtcccttagctttggtgtgtgctgctcctaacgtagctttggagttggagttaagaaccatctcatggcattgttgggttaggtattctctgggtccactcaagcttcctatcagttttttagggacagaaagctactgtgctgacctcagtcaaagcccctatctgaattcttgaaagagacatgattgttaggtcactaattgattctccatagtgttagaacagcaggagatttgaacacaagggcatggtgctataccatgcagcctggtagagttgagctgaataacttttaggtttgtaagacagcacatttaatttttaacagattatgtacaagatattgagtgacattaaacacagagttaaatcaaccataacccatttaaagcagccttgcagataaatgtctcaaatctactagcctgccaaatgtattccttatctacacacatttatcaatttttccacaacactaagcctttctaatgtttctctgacagttactttctctcccaagcctgaaattcgggtgacatctactttctgtaaactagatgtgcttgaccagggaaagcccctagatttgtgttaatcttttggggccactgacccttctgggactctgatgaaatctttagtttgctgtctaagtaaaaaaagaggtgatataaacatacacagatttctttttgcataattctattgtgttgcttttgaaattgattttattcacgttatatattattcaaatacatctttactaaaaagtgtcactcactctatatattttatatataaatgaaagattactttctaacaaaaattagaaaaaacacagtcaatgtaagttaatcagaaagtaaaccttaattgtattcaaaagtaaaactcaatgggaacaccgttgttttgtaagagtaagaaattttggtagtcacaaggtctttgacatggcaacatgaatgacagctttgcagttaagttctgcacctttggttttgatggcagcaaatatgtaaaaaaaagtcattgattcaggtgatagaaacaaaatcagaatgcccatagctcatgttgcaacgaaggctgtaacaggaaagcaggccctacatgactcttatcatttcatttatgtcccatgatttcttcaactcagttaggtcaactgtggtggtttcagtgggatgctatctatgtatgttaattatctattgttgcattagaaattttccccaaatttagtggcttacaagcaagtattattacagaaacattgcaatgaggtacttgtagttcagagtctttcacgatactgttgtcaagatgttggttgaaataggagtcatctgcaggcttgactggggctggaagatctgctttcaaagtggcaccctcacatggctggtggtaataggcctcagttccttaccacaataggctctgcataggactcttaaggtatttacacaaaatggcaagtggctttctcctgtgtgaaatatcccagagagaaaaccaaggaaggaaccagaacaccagttatgtcccaattttggatgtcatatattgttacttttaccatgctatatctattagaaatgcatactgagtccaggtccacactcagagggaagggaattaaactctatgtcctgaagggagaaagatcaaataatttgtggatatatttcaaaaccaccacactatgtcatcaaagaaggcgttgtatattcatgattcagttttaaggtggtttgggtaaagttaatagcacagttgatccatattcccaggtactggtgatttccatctgaagagaacaagatgaggctttgtcactctcaccccagactatcctccaacatcctttaatcacctttaagggggccaaggcatttcttttttcttttttttttttttttttttttttgagacagagtctcactctgtcactggggctggagtgcagtggcgtgatctcgactcactgcaacctctgcctccgggttcaagcaattcttctgcctcagcctcctgagtagctgggattacaggtgcccgccactatgcccagctaattttttgtgtttttagtagagacgggatttcaccatgtagaccaggctggtctcaaactcctgacctcatgatccacctgcctcggcctcctaaagtgctgggattacaggcgtgagccaccgcacctggctgggccgaggcattgtgtgtgtgtgtgtgtgtgtgtgtgtgtgtgtgtgtgtgtgtgtgtgtaagttttttcatgaattcaaaacatagccaaatggttttgaatatatagaatttatatttgcactgctgataatagcttgtaataaagctgtggaactatactgtttattgttgccccaacatgacagtgctggtgaggaggaaacaaagactggaggatgtaatctaccccatagatgagctccttgaggatatggctgcatgttaatgttccagcgcagtgattggcacataggggctataaagaagtatctgttgaatggatgaatgaatgaatgaatgaatgagtggagactcatggaatttaacttggacaggcaggttctaactgttgctgtaggcctaggaataccatgttcaaagtatggaagattggagcattggtaagaatgagctcttgaattctaaggcagtgctatctctagtctctttagtgttttctgccaggttggaagagtctttgcatgtcaagcatatgtttgccttcaaaaacaaaggtgaaagctggttgggattgcttgcttttagtgaagaccaaggcaaagaactctatctcctgggtactctctgtagatggtgggaaaaaggaagagaatgtatcaggtagcttttgctctgtgacagacaactacaaaaccttggtagtatattaacaagcagtgctcactgcccatgcatatgggctcagccatcagttaggtggctctgctgatcttagctgagcttgttcacgtatttgaggtgggctttgctccgtgactttcccatattgtagcagtgtagcttgggcatgtttttagagcattggaggaggcatgagagacaagctcaattctacaggtgattttcaagcctgttcagcaagcaatctactggccaaacatcccatggctgagcccattgtcaaagagggagggcactgaatagctccatggcacaggggggcgtgaagaatcggaacattttttacaatctattacaggaagccaaagaaatagctagtttttctctgtttaagaagggttcacacacattgcctttaaaaggacagatagtaaatattttagactttggggccacgtacaggccctgttctatattctttttttacttcttttccttttcttattatcctttttcttttaataatcctttaaaaatgtaaaaaaacagagatattcttagcttccaggctgtataaaaatagactgcatgccacatttggcccgtgagccgtagtttgttcatccctagtttaagaagaaaaaacatcttcatactaataataatatacaatattctgttggcaaaagacattttgatacttgtcatttaattgatcttcatagaagcctgattgttgaaggtggatatttctaatagctcccctttcatatggggagagatgggaacttatgtgatgaaactgggattcaggctgtagtagggccagggagggtcactgatgattacctgaggttgccctgccaaggacagctgcttgtgtcctctgcctctgagaactaagcttccaggaggaccaccggtagtagggagtgcattcagctccatcctcctgagaacatacactctgcaagtggagagaagccatctcattatgttaatttcaacccagcccagactgagaggaggctgatttcaagggcaaagaaggtgaggcagccgattcccaggtcccatttcccttgctccacttcattaacatggccacccttaatgcgtgtcataactctgccttccagcaagatttcctctccactaagaaccttttagaaatggtatttaagagaatgtgcataaaacaagtcttcatggtgattatgacatttctgctgaaccaaaatgtaatcagtacacacattttgcatccttacacttaatccacaaacatagcttttactgttttaccttctcccacccacaatccaaacagtgccacagaacaaacgtaacaggatattaagataatctcttttgtctatgccaaatgtcatttagctgttgagagaggaatgtcccatctagtttttacaaacaataaataatacagcttatgaaggtccacatgggtgacactgatgcaatgtttcaacagttttccgaaaaaggaaaataaaatgagtcatccaattagttggctgggcatttgcctgcaagttgccagagagctttgttgatttatcccaacttggctaagattggcttactctagaagttcgcctgttacagaagtttggtctttactagggtgacacaaagtatattttatggatattagttcatcaggatgctgagaagggttatagcatcaaagacaaatatggctgaacatattggggatcatttaggttaaagaaatttaaatgaatttttcctgcgggacttctcagaggctttaatctgtgaatgtgcatactgaatttccaagaagggtttagaatgtgcagcagtttccaaatctacttgacctgggaacccttttgttcacagggcatcccatgagagaacactttaaagaacagacgatgagaatcagtaccatgcgtaaaacgtgaccaacgttctatgcagaggagatttttgaaagtatccccaccagtgaagagttaccgtgtatgtgtataatgtacataagtggacattagcttgtattttcaaataataaagtcaaactttattattaaggaagatacaagaattagggctagtaagtgtgtgtgtgtgtgtgtgtgtgtgtctgtgtgtctttctatgtgtaaatgtccatccccagggattaagaagtctggatttgggttaaacttaatcatttctaagaatctcaggttttcagtcctgtcctagaatttcaaaaacagtcagagaaagcaactgtgagaagatcacagcttctcatcctgttttgagtctcaccctcctctttgccctcacaaaggatttcagtgattatgttcctgacaggatgcattttaattgttttctggtatgacttcccaatacatcaagttgtgttttctatatagccgctatcccaaatgattactattcagaacactaatctgatctctaaatctacaaagaaaaggccatgtaatttgcttctctttacagtgcattacgtgcaccattgtaagtgctggaacccgcccccccccccccccccccgccccgggcatctccaaactgctgtcctgtggatagccccagttgcatgtgctcaaaagcaaacttcttatctcctccatgagtcagttcctcttcctgtttttttctctcattgcagctaatgacattaccatcccctcaatgtccaaagttagaaacttctgagtaattttttatttctttctcttcctcaccttctactaatattagctgttaaatcctgttgatgctacctctgaaatatttctcaaatccacatctcctttcaaccttgggcatggccctagttcaaggtcctatttttcttagatggaccacggggtccttttgccatgatctctttttccatccaacttataatttttctacaactttgacttccatcctgattactaagacttttaacatttctgtgtgctccttcttctctgggtgtttgacatgcattgtcattctgtcttctgattgcaagtgatagaaacctactccagactagctttcagggaaaagaaaggaggtgtttagtagattgcacaactggcaaacctggagttgatttagctttcatgaaggctagaccttagacttgtcatcaggaatatgtcctatttgctttttctgtcagcagtccttcctttttttttggctgtgctctgtgatcacatgtctcattgtggtgataacgtggcttccagcagcaatcccagactcacagcccatcctcagcatttccagtggagagaagtgttctctcttcctaacactttccatacaaatcttagaaataaattttattggctcttaacatgtcacgtgcccatccttcaaccatttgctatgaacaaggggacaggatgctctgattagccaggacttagtcacctcccctcttctgaagacacagaagttgggacttcatctctacccagccacgtggacttagaatacaggatgggtgggtgcagtttccccgaggaaattggagggctgttcttggagcaaggacatgaataagcggcttacaaagagcaaataatcgttgcttatggcactcaaggtgttctgtcaccccatccaactcacctttcccacttggccttctgtccttgaatgcgaagaaccagagtcccctgctctaaatggctccttttctgtgtgtgctgcgtgtttgctctgctgctgagatccatgcttttcccttgcctgaaacaccctctgtggctgttgcagatgtgttcactctgtaaacgcagctcaaatgccttccaccccaaaaagcctccttaaacttgcccctgctcctctgtgtgaataattttcacagcacatgatctacacttccatcatggttcttgaaatacatgaaatacctaatcataggataggtttcatatgatcccacctcccctgctagacactgacagtgtgacagcagggcccctgtcttgttcgtctcagtgctccccagggcccacatgcagtaccttgtacacagtgcaggcaccataaatacctgttgattgattctggacttgccattcattaagagaagttaatggaggttttctgattcccatcagatgaacaattttggaatgttttatcagtcaaatttctaagaatcaataaaacttccatttggattattctttcccccactcaaattgtattttaaaaatagttttattgtaattgtccccctcaattctgacaatgtgtaagcattgcagaaaatttgtgaatataaaagtatgaagatgatcaaaagcttcttcctgactgatggccattgcatgtatgatttcctctgcctggaaccctgtggcccccagggttcagctccctggtgcctcatcaggcacagcttagtgtgagcttcacctttgtctctagatcttcctgtgcatttagatttttaaaaaatctggtgtatcccctcattggttggctatgaagtaagctccctgtgtgcagggacctttttttagcttggtgagggtgtatcctctccactgctggagctgtggtcagcacacagccagtgagtgctctacaaacacttacagcatcagttcatgaatgcttgcaaacatgcagaggttaccattgcttatacttttttttgttttgttccacttatataaaccacttatatattcagatatttgtgtatatatgcatatatatgtatttatgcacacataaacatactacacacactggatgtatactacacacacacacacacacacacacaatgttataaggtgtatgtaacacactcagggctgccccacagcctctcagtgccctacttatgttccgtccccccaccattccttctggcagcttctcactgtgaaccctgagatgttctgcctgagtgcttgttctagctgctggagcatggcaggccagaagttctggagaactcgtacccccaggatcagctctcaaccagggatgaatacagatggaggataaatttccccactcccttgcccctttggagatgtatttgacaccatttctcagagtctccagggagaatgagctccagtagcccacagtggtacctggactgataatgctttactggctttcttttcatatcactgcctcctggaaccacctcctaaataagctacttacattcgagaactaattccaataatacgctacttaagacaagggagaatggtagaaacaggtttctatacttcacaaaaatgagcttttgctcttcagaaatcacagccaatagattgtgccttctggctgccccctctgctaatgccccctctttgccccctgaacaagggcacccatgtacaacaatgtgtatatacttccttaggaagctggtcattcagagccccgtcagtgacacctgcactcagaatgtaatcctacccagcttcgggggctccaggaattcctgtggcatccgtgttatagactcctttgcattcagctttgcttttatctgtttccaatttgtgttttcaaggcttcggtttttctcctttctgcttcatctccagcccctcctttgcaacagtaccaaataaaaaaacccatgacactgccacagctgaaaaagcctttgaaaaaggcaggtggcgtggcttgaatgtttctaaactctaaaactgcaagccacagacaaataaagaaagaggtgggggtgggcatggggggttgtagtcttgtggaagcaatcctcagccttcagcaggctctaggggcacactgcctctagcatgttttgagcacgttgatttgggcatctgtcttgctgaatttgagtttgaattatggatgttacagaatgaatcattaaggctgtgtccacccggattgctctggctctctggcctgttcacagtgctgttcaattttatgtaagcattacttcaacatttttggtggatgttcttcatttattcattcattcagtatgcactgatggtgactctaagtcttgggactgcaaagatgtctgaggcccattctttactcctccacatctcaagacctaagggagatagacaggcaaatcaataaccacagtgccttgctattggtgctgtccaaggtgggtgctgtgaagaagtgcttaagggcaagtgctgcagaggcaggcacacctggggtccttttcctggcctggggggtccaggaaggtttcccagaggaagaagcagggctcagtcatcaagagctaaggatatgccgtcaaatagccctggcttattagaatctgctttgcactaagcctcctgaatacttaatttccccaagcctcagtttcctggtctgctaagtggccagaataatatttacatcgtggatttgtatgaaataaataggataatgcatgaaccatgcttagcgtgagccataacacgcaaaagcaacataatcagtatttgttaattgtaacaaatcaagcccgggatattgacagacacctaaggcagacttgggagacaatgtctcttgctgctgcctcatgaggaaggtgaatgaccatgcattgccactggacgggaaaataaacggtttcttctttttattcttgtagacaccagtgaggcctaccatatacctatgtcaaaacctgcaatttatcaaaaataaagcccgagatagtaacagtcttgctgaccacaaaggcaaaaggatccaggtaaacagattgcttccaggactattatttcatgatgagctttcaggtatatagcacatgagagggaggacaaggtgcggctgcacttcaagagaccacgttggacaggtgagatgtccaatatattcttacttaagatctgatttcttctccttctctccagcaagggatgcccagagatataacaattagaattcaatacgctaatacagtgtctcattagccaagccacacaatcgcctctagtggtccatatgcacgacaacccgggatcctagaaattagctcggcttcctgcatccgtccccatctgaatctttactcaactactttttgattgtgaagagccaagctcatttgagcagtaggaatttcatggggctggtgatcccaagactaattcaaaaattaataagtttcccattccttttcttatttatttttttggtagggacacatttcaccacacacgcctgcttctttcttgccagtatttcattcaaaactagtcctcaagttttgaaattttagagacttaaaaaaaatcaataatgctttaagaagattaagaggctgtgcttatgtcagccttagacaattctggagagaagatagacttgattgtgcttctcattttgtttatgatcctgcaatgtatcacgcattctctgccaagtgaattctgactgcatgaagaaggggtagatgcttttacaacaggtttagtcatctggcatattatttaatacaatcagtggtgttttccttcgtgagatgcagccttatatacaggctaggtgttaagtttatacccaggttatctacccttccccctcctgtcctctctcccaccctgtttttattctgtcttccctcccttcttcccttcttccttattctctctcttcctccctttcttcttcatcttcctgtcttcctcactcctcccttctctcctccccatcttctttccctttctttccgcctcccttctccctttttcgctccctctttcccttcacaaacatttattcaaaccctattatataccaggcacgatgcaaggcactggaaatacactgaacagggcagatgtggttcccgttacatgatgagtaacacaggtgataaataaacagttaacaagataagaaaaatggccagcgagtatttggaagaaatagacaagtgatagggaatggctttggggagaattatctgcatataaggataagggatgagacagactcagcagccgtttcatgccagggcagagtagaaggccgtggagctgctaggtggttggcctggagaaaaaacaaggagttttttctgcaaagtgctggtaggagtttacagttctctgtaatgttcagaaatgcagaggtcagcggaggtgggtggatcacctgagggtcaggagttggagaccagcctggccaacatggtgaaaccccgtctctactaaaactaaaaaaaaaaaaaacattagccaggtgtggtggtgggtgcctgtaatcccagctacttggaaggctaagaaaggagaattggttgaacccaggagacggaggttgcggtgagctgagatcatgccgctgtactccagcctgggtgacagagcgagactctgtctcaaaaaaaaaataaaataaaaaagaagtatagaggtcatttttaatgtgagaatgttctcagtgaattaggtatatgtgcctgccacattttccaaaccaatgtttttacgaatattctagtttagccctctcttctagagttataaaattattctgccttcagttctacatttagggagtcctcttttaaggaaaggaaaaggatagttaaatcaggggctgtcacagaagcctcagattggaggacaaggcgtggaccatcccctgtttggcgggaaaatagctttagtcacaggcaggttgttttgcttcctaaagcgtaaagttggaaatgtgataatttcgtcaagtagttgatttagttgtatcaagcttaactaattaacaccaattccatgcttgattcttttctccattaactgaacaaaagccattgctaatgaggctatgtatacaaagccagctgactcattttgttatggagatttcaaagagaagggagttgtaaacatttgtagggaagagataggggtagacatgatcttacacatatttaacaacaggtgcaatacaggcactggccaatgagaatgagcaggggtataatggtgccaccagcacatacagaaggagtaagaagtatcctcaaggcacggagagatgatagggtgcagggcctttgcactgggcttattcacaggcaaaatatttttccttattttaaagaaatggaaagaagtcttcctagaagccagggtctgtgatacatgacagagtgaccatagcactcaggggtgcagagggtgtgtggattctgatgacagattgcctgtctgattttgcagaattagctccaacatggttttggtaacacccgttgccctctttaagcttgatgtctctgttttcatgtaatttgcacaaagtaggcactcactaaatatttgtaggtgaagacgtgtatctcagcacaaagcagcctcttggactaccatctgtgtggtattcaaggttcttttggtttcagagaagaggaacacagtaaaatttacccaaagaaaggagcatatgtgtcggttagggaaagaccaagcttccataacaaagagactcccaaatccaatggcttgataagatgagcctttatgtcatgttttggtcccttggtgagaggcaccgactggcaggctggctttgccctgtgtaatcattccatctttttccttccagctgttgctcagacgtcaccttgggcatggtccttgtctgcatggttgaaggtggctcatgtgtatgtctgcttttcagtgcacgcatggaggcaaacatctgtcttttacattagagatgactccaatgttgcttacatcacactgttcgcatcccatttgctcaaatgtggtcatatgccacatacagctgtgagtgacgctgcgaaatctagctggctggctttgtggcatggcttgcattcttctgctgtgggagagaaggaggagagaatgggttttagtggacccacagggagttactataaaagtgcaaatagggcataaggggatgcaagaaacactgaacaaccaggcatcagagtgcaggagcctatggagttcagatgagagctctccttcgtgcttctctagctctcactctccatctctcacactttctctttttctgtgtgaagactccactgtctctgtctctccaccagcttcctctgatgtcctatcttggatctggccccagatagtatcctctactttcttgaccttgggttttccaaagccaactggtatcttcttacttgtctcttgattctaatttatctaaagggaagatctgattcgcccagctcaagatagtcagggtctaaaacaccatgaccactctaaaaagaggggactccgagtcagctgtctgcgcttatccaatcagatgacgctgggcaaatggagaagctgtcagttttctgagacacccctccccagactgacccaaacacaacttgcacagtgtgaatatcagagtactatgtgagaaagtactctgtggagctgaccagcatcagaaattctgctagggctctcttataaattgataacttgtttctcagtcttttatacatttggcaaccgtgaatctattctttagaaccagaagagtcctgagtgatgagttcatagattagagattctcatacttcacagttgagaagtggggacaggcccaagggtaagaatcagagtgagctgccagttacatcgctggtcagctcctctttcactgcagtagatacaatgaacataacaatggatataagctccaattctatccagttttccacgaatgaagatgagtctttgaatacgcccttagcagttctcaaaaaccaatcagcagaacaagtctggccagctcccactttacatggacattatcatcaaaagctattttaatcccaggaaccaagaaaaagaaaaaaattctgaacttgcaatttttttctgttttctgtttcatgccacaggaataatttttaagaaattctttaaaatagacccaattctatgtcttatttaaagcaacagatatgaagcagtctgtgtagcagacaaatttaatggttccaatcaggggcttggaattagactgcctaattttaaattctagctccatgcttgcaagggatgtaactctaggctggttactcagtctctctgatgtttctgttacttcatctgaaagtgtggataacactaataggtaccttgcgaggctgtggacaataaatgagataattcatgtcaagtatttggcccagcgactgcgacatagcaagtgttggctgaagataattattaggacttcacatgagcgttgttggaggagcttagcttgtttaacctggaatagaaaagatatggtaaagaggatgcaggagcttccatttagtatctacagggtgggccatcctgtttcctgtggcagagagagaagaggtagaaccaatagggaagaaatcataggcagacagatttcagatcaacaaagaaaggcaaaacagatagagctgtccaaagaaggaatgggtttgaaagaaataaagccccagaagggctctagatgaggatgtgaggttggataagctacataagggatgtcccaaagtcagaccatcttctgggcttgatagcatgggttaggatgggctgacaaagactgccttaaataaaagtatgcatacacacacacacactacacacacacatacacacaatacttatatgtaaatacatttaaatatattatatagatttaatatataatatatagttctatataaatatattttaaatttataaatttaatttataaattaaatttattatttatatattacattaatttatatttatattcataaatttatatataaatatatttatataaaatataaaatatattttatatgtttaattatatataataggtggaggcgggtggatcatgaggtcaggagatcgagaccatcgtggttaacatggtgaaaccccatctctactataaatacaaaaaattagctgcgcatggtggtgggtgctgtagtcccacctactcgggaggctgagacaggagaatggcgtgaacccaggagggcggagcttgcagtgagccgagatcgcgccactgcactccagcctgggtgacagagtgagactctgtctcaaaaaaaaaaaaaaaaaaaaatatatatatatatatatatatataaatatatttctatatttataaaatatataaagtatatatgatatacaaatatatttacatataatataatcattttatttgatttaaaaatatacagtatatttatatatttgtatatttataaatgtattttatatattgtatgtttataaaatattagaaaaatatatttgtatatttataaaatatataaaagtatatttatatacaaatataacctataagtatatatgtatgttttacatacacaaatacttttatacataaatgtgtacacatttcagaatcaaacagcccattataagcatatatgaaagaacagtttgatttggcatattttataaactgtcacctgattttttttttaccccaacattaaaaaaaaaagctagtgcataaacaaggtgcagaaagaagctagtcatccattcatctcttcttgtgccagtgttacaatatctagtagctgaaagtctgggccagtcatttgcccggaccgcattatgtctgaatacctcctggcagtttctacgtctttctcagggcttctaaataggaatgaacatgaaagggccgcgtggcagtgaccgcagtgtggaggttctaataatgactatgagggacacacagttttcaaggagatctaacagtgtttatgaaagattctgtttcatctcaccagtgaagagcccttcatcatctaccattctcttaaggatagagtcttagaatctccagtgatcctgcaggaccctcatcccgtggttttaaacctgtgttctccagaggtctagcattgagcggtggcacttgggattctggaatggggaggatgcaagaggaacacagtgaagtaaacagcttggactctggcccttcaagcatacttcatccactttcatctgttttaggcatgtgggttcaagaggtgatgccacttgaaaaaagattagagggttctgaaaaaatcaggtgtagaattaattccaacatagacctaccttcttattgcacagacaaagacactgagatccagagacattgaggggctctcttgggctcccccaccttgtccaggggaaagtcaggactgggatccagcgtatagtcacttgctacggctattcccattatgttttgctgctgctgaaacactggaacacattctaaagttcagacactcaggaaataccccacggtgataaggacaaccggtgatgccgatgagttcccaccaggtgtcagtgcctcgaggacttgtttaatcttcacaacggtgctctgagttaggtgctcatattagttccatttaacagttggagaaaatgaggctcagggaaattaaatcacttgctccacatcacacagctactaggcagtcaatgctggttttgaggctaggtgatctcagtccagaggcctcagccttaaccattctgctctctcgccttcctgcattttatactccatacttctcttgggagaaagatactatcatattatttcgtccaaacttaccatatcttaaaaaaaacttaccagcaaacaaatcatccaactgcctttcatctattgaatgttctacagacttaacgccattatctcgcatgaccttgatgaagatagtaaccctccctttatcaaaatggtcaatcttcattaatttattttactaattagttaaaggctggtgtaatttagagaaagtctaaattatagaatacattttattctgtcactttgaagcacaaacctccacaaagatttgtataaaaatgctcccttctgggactcacttcagtgatttgtagctaccattcatactgcctctatgtaaatgaaagggaggcataatatcagcaccttgcgtattcttctccatggtaataaatcgtgcctgataacctatgaaaatggcttcatttttctcttaccacgcctatcatggtggctttcaaactcactaccctgtgccccacctatcacacctgtcctttgtccctttctcacatggatgtctacaaaatgcagcagtaaagtgttccataatccacacttcagtctacataaatgtttaattcccctgccccttttgttttcgtcaggccccctgaagccgcagctgagatggctgactccctgaactcttcttatgttcttgactgttcgcatagcctttcctgggattacctcccagttccaagtttgcccattctgcaggcagtcttcttgggttccagcttttctccaccatcagcttctcccctagggctcttattaactctccgctctctgggggccactctcattttcagcttcatgtggatcagtgattacttgtcctatctcctctcctagaacgtgagcttcatcaaggaatttctctctattgaccctcaggcatgagcacaatgtcctactccctgggtgcttagttaatgcttatggagtgaatagaaccccggcgtgtgtgtgtgtggtgtgtgtgtgtgtgtgtgtttagggaaggcaaaggacgtttggcaaaaaaacaagttacctgagggaatagcaactcgaagtcattgtccctcaatttgggatcccggtaccacccgcataagaatcttttggatgctgaataaacctgcagtttctccagcctggccaagacctatcaaagcagggttcctgggtatgaggtccaaggatctgcaactggaacatgctctccaggcaattctatacacactggtatctaagaaccactgcgctcagaactaggatatccatcaagcctgatttgaagtacctgcatgagtcccagtgtcatgatgagatcaagagagcttctgtgtccttgaggggctggagtatgcgtccccctgaaaccctttccctgcctgcccccagcactgttgggtgtcccttctctgtgcttcctctgccaacactctgtgcggtgtttccgggagtcagaatggcagggtggtcaagagtacggactcagaggttgcagaaagataaaaagatgattgcattcatgattgttatgatgtcttgtacatagaatattgtcttatttgctctaagactccattaaaaagccagcaaaagcaaatgcataccagaaaaacagtggtgtgctctttgaatattaggtggcctagtgcatgtttcacctaggtctctgactaattctatgagcttgggcaaattatttagcttctttagggcttctgtatttgtgaaaaaaaaaacaaacaaaaaaaaaggaaaacaatagtttccctttaacagggctattgtaggaatccagtgagatcatatcttggaagtgctcagctgagggcctgggcgggataagtactcaaatcatacccttaatatcattattcttttttgagatcaagtttcactcttgtcgcctaggctggagtgcatgttggccaggctggtctcacactcctgacctcaggtgattcacctgtctcggccttccaaagtgctggaattacaggtgtgagccactgtacctgaacaagtgggtgttgttttaagccactacatttgtggtcatttctcccagcagccacaggacactcatacgtccataaaggcagcttctctgctctttgatgcctctgactccacttaagccctcttccccagggctgaaccaacatacccgcttccaagtctattaagtattgaattgtgttcccccaaaagatatgttgaagtccaaatccccaggatctgtaaatgtaacactatttggcaacagggtctttgcagataatcaaataaaaatgaggtcattttggggaagaagctaatctactgttactgatgtccctgtaagaagaaaagagggtcgggcatggtggctcaggcctgtaatctcagcactttgagaggccgaggctggcagatcacctgaggttaggagttcaagacaagcctggccaccatagggaagccctgtctctactaaaaatatataaattagctgggtgtgttggcatacacctgtagtttcagctactcaggagcctgaggcaggagaatggcttaaactgggcaggtgctggttgcagtgagccgagatcaatccactgcactccagcctaggcgacagagcaagactccatctaaaaaaaaaaaaaaaaaaaaaaaaaaagacacaacgacacacagagaacttgtgtgatgatggaggcaaaaactggggtgacgcagctacaattcaagggacaccaaaactgccagcaatgaccagaagctaagagaacagcatgaaacagactgccatctagagccttcagaaaggacatgacttttctgacactttgatttcagactttttgcctccagaactgtgagcgatcacatttctcttgttttacaccagccagtgtgtgatactttgttccagcatccgtaggaaactaatacaaagtcccaaactctttccactatgtctagatccaaagtcaccaagaggcctggcttggggcagcactgggaacttagacaggaccctagctaagttccattctgagttaataattgttattaactcactcagttcatgcccagttagcaagcatcatgaagcacattaagccaggatatggcctttctaaatgtcctgagtatcaggagaagctttttcacactgcaaaagccagtctaattctatgacttgcaggctgaaaatcaactatggctgcaaccaagtcacttagccatcatcagcgccaatcctgcagtgcttatagccaagtcagggcgtctgtttgttgagaggcaaaggcggccccgccccatgctctggtttctgcttgcaccttattaacgggtaatgaagagtaggttctgctttattgatcttgagaccagagctacgtgcgatgctgcctaagaaaagccgcaaaggattttatttgatttttgcacacaacaataatctccctcaccagattagctggtgaactggtgggcttttcaccttgaaattgttgatagggtagccaaacaggaatttctatatttgctaatccttcctcaaatacacatccccaccgtctgtgccctgtcaagtgggtacctgggaaatagcagagaccacactgtggaaggggagacactccagtgcaggaaagatcagaagaaagaggtgacaatgacatgcagcacgaagcagcgatgatggggttttttctttgcaaaattacaagccacagtctcacctcattcctacctgccttttttatttcccctgctctcaaaacatacctgactagaaaatccccagtccaactccaggaatgccctttcttctttagccacatcacagtgttaccagatgccttttatgagctctttggtagaaactaagccatgtgtcactactgggtgttgaaaactcaggagtcagcttccctgcagtctgctggcgctcagttctttggctctgcctaaagtcggataaggaaatgaccttccaggcatggtgagatgagtccttaggacacagaagggcaggctggcctggcctcaggagactgcaacagctgccagagagccatggcactcctcaatcccccgaggagcctggaaaagacttccctcttgggttcaggcatgtcctctgcttcctgcctttatggaaactggattttcgggaccttggaggacctcctatggggaatagaaactaacagcccatcccgagcctgcttttccatgggaaaggtggtgggaattctccatgtcacctttgcagagagagagagacaaacatggatccaaattagagatggcttcaggttctgacggattcatctctcccaattgcctttgtaacacatctgctaaatttagataagtcacaaatagagccaaaagaaaatccagaagggagccacaaaaaattattaaacagttgtaaaagttggggattatgagtggaggaatcggggttatttatcctggaaaagagaaggctgaggagggacatataaagacttcatactagattaattatgtaaataagcagacacccagctggcatggaatttcaaccatttggcagggagagtgggtattaaggggggtgactagttgttttaaaatcattagttgcctgcacaggtttctggaggggttcactgttgctgagtaatacaagttatgaatatgccaggtctgttttaatgagcccagacttcacccaccaaaaatcctttccagccaagcacgtgataactatagatcttctttgtcctttgcctcaagcagaagccttacacgggtccgtcgtaagatgcacctctagggctcattccttcttcaagtcccggtgtagagtttggtgttagaagggacaattagagacttagagattccttcgtccagacaggaagatgctggaaggagtgccttttggggaatgagctgagcttggccagatgctgcagttgtgtccccttgctgaagttagtcacacttggctgctggagaagtctgcccaggtgcacttcataaccacactgccatcttctgcctttcattcaacaggacatgaattgagcacaggctggtcctcctgagccctggcccaacaaggctcctgaacctgggcccagagatgcataagaggatgccaaatcacataaaaaataagggtatggtgaaatcccatctctactaaaaatacaaaaaattaataaggtgtggtggttcgcagctgtaatcctagctactccagaggctgaggcaggagaatcgcttgaaaccaggaggcggaggttgcagtggattgagatcacaccactgcactccagcctgggcgacagagtgagactttgcctaaaaaaaaaaaaaaaaaaaagagcccccccactcatccacacttactctcttacaatcctggaaggcaacttgtttcaatgggctagaggcaagttgttggctagaggagattccattgctggactcttttagatcctggtggttcccgacattccttagcttatagccacatcagtctagtccctggctccgtggtcccatgaccttttgtgtccaatattcctctgcccccctcttatgaaggaatttgggattctatttagtggctacccagataatccaaaataatctcttcatttggaaatcattaatttggccacatctgcaatgtctttaccacaaaagttaatatagatgagttctagggattaggatttggtacctttggggatcattattcagcctactgtagtaggggttcatcagttagtgggggggaagtagccagtttattcccaaaatgcatgtgtcatcacaaaccaagatgagtttcctaaaagaaaataagatactactgcgaatgtcacccaatgagacctgacccattctgtgtgtgcagggatgctgttttagttgggttcccacagaagcagaccctgcaacgatgatttgtgtgcaaggtgtttatttgagaggtgatctcaggaaaccggtaaggcagtgggggaagtgagacagggaagaaagggcagccagtgatgggagttgctttcaagcagttgcttgttcttatgggcagctggagctgaatcccactggggactctgggagacaatgaaaaccacatctcatagttatccccactgaggaatgagggacctggggtatttatctaccaactccccttctattattggttgagtccctcttctgacgagtcacaggtattcccagtaagcagcctctgtagggcacaggtgagtgatgatgggattcaccgctgacagctctgctgtagatttccccgggcaggtgacctctgaactgccacctgaagtagaagtaggaagtaaccagcaactggggtggggatggtgaagaagaaggagaaagtgttaaggaaggaaacagaaagtgccaagccctgaggtaggtggggcacagtgtagtgttgtattagtccattttcacgctgctgataaagatatatctaagactgggcaatttacaaaagaggtttaacagactcacagtgctggggaggcctggcaatcatggtggaaggtgaaaggcacatctcacatggcagcagacaagagaagagaactcgtgcagggaaactcccctttataaacatcatcagatctcgtgagacgatcacaagaacagcatgggaaagacccagccccatgaatgaattatctcccaccaggtccctcccaaaacacgtgggaattatgggagctacaattcaagatgaaatttggatggggacacagctaaatcatatcaagtgtccagagtgaaaggagttgagatggaacagcatctcaccagacctgagagccatttggtgcgtgttggatgcatgtggtccgtatctgttctggttgattgatgcctgtgccttgacatttgttcaatattttgaatatccttcacactgaggtcaatatctctttccctgggtggttatgagccttaaatcagctatgccatgtgaaagttatttgcagtttgtgaagtcctgtggaaaggttgttgctgtttttctgctggggctgttttaagatgaaacatggtatgggggaaagatgcaagctctgggtcccattctcaggagtttccacgagcaggaacctcacatcactgccattggcctgtaatataattttggcctgagtctatctgggacaggtggtgtggagatgcactgttactaaagacttaaagcttggaacttaaaagtctacattttctttggagtcaggtggtcctgtgtgcaagtcccagttccaggcccttccactggctgtccaatggcttggagtctgaggctcagttttcccacttgcagaaggaaggaatgatgccaacttcgtaagttacatgagatgtgaaggcagtgatggaagtggagctggggctccttccccctctgttttaagcatttgattaaaacaagttaggatgggcgcagtggcttgtgtctgtaatcccagcactttgacaagccaaggtgggtggatcacctgaggtcaggagtttgagaccagcctggccaaggtggtgaaaccccgtctctactgaaaatacaaaatttatctgggtgtggtggtgggtgtctataatcccggctactcgggaggctgaaacaggagaatcacttaaacctgggaggcagaggttgcagtgagccaagatcacgccactgcactccagcctgggcaacagagagagactctgtctcaaaaaaaaaaaaaaaaaaaaaaggtcttactgtaccatatgtcctcacttaacttcattgctaggttcttgaaaactgtgactttcagggaaatgaaatataatgaaagcaattttactgtatgctaaatggtataaacaagagttaaattcttacggcacgttcctggtcacaaaaacattaccaaacttcttaataaagacccaaaacacttctaatattaaacattgaaataaagatgagctatacatacatttaagaaagatgaataaaaacaagtaagataatcgtttgctcaatttttggtgaatcagtgagtgacggtggtcgtagtggtggtgggttaaatcaaggaataaaggtttgcaaagcgaaaattgtcaggggcacctcctgccaccgtgcagtttgaaaacaaacaattccaactaatggcagactgactgagtgctttcttactgcattgttttttattgtgcatttttatgattattatacacagtacttcatgagtttttgttttacaatacttcgtattaattaattcaccttccaaattgcttagtctataatagtttagggtcttgggtggccaaagcctctgctagcacagggtaggaactgaccctggacaggacatcattccatcgcagggcacacttacacccacgctcacactcactcatactggggcaatttagatgtgacagttcacttcacatgcacaactttgggatgtgggaggaaaccagaggacccggggaaaacccacacaaacatggggagaatgtacaaactccacacacagggtggtctgggccaagagttagtgtttttttttttctcatcaacattataataaaacaacattgaagaaaacagcattatatgatgtctggatgtatttattgttcatgatggccaggtcttcctgcattgttgtttgagtcagtcacagtgagttggcattgctacaagtcactgagcaaaaggccctcgcctggctcattcgccaatgagtctcctgtgcctgaaacaaagcttggtaaatagtagatgctcagtaaatactaactgaataaatgagtgagtgaggtttactggagaagggatcaagaacctgaattgatttagctctccccacatgattatgggatgaagccatgataattactggcacaaaacattcattttatacataatggaagtataaccagggatgcaaagtgatttgctccaagggtgctcagttaatttattcaatgaccagtcattcctctccttgatttaacaaacattcattgagcacctacagtgttgctgatgatattaaaacctcagtttctatcaaaaagcataagacattgcccccacccttgataagccatgacttggtagtgggttcacatacataaacaaaggatcatattgcaatgtaccatgatctagtatttacacacatgatgtgctgaaggaatacagatgaaggaacatcaattctgccttggggcccaaagaaaccagttgggaaagttatatttaggatgagtgagggacacggaggttcagaggtcctcaggcagttaaagagggagtagggtagaaggtgcaggataggtatgggcacatggaaggtcatggaactggccagtcacccagtgaggctagagtggaacactgctcacgtaggcaggaagaaaggtactccaggtagaagtaacagcaaagtcaaagaaagcagtcggcaaagagatttgtaagtttgaagaattaaaagatgaaccataggaatgaaggagagtgtggcaagaaatgtactttgacagagagaacttgtgccaggtcattctggtctttgtaggccatgatagagagttcagattttgttctaaatacaatcaaagccattaggaattgtaggcactgtacttccagtgagctaagttttggggtcagtctggtcactgtgatggagcagagagggcagggaggagagtcatcaggaggctgtaggtgcagaccaggggaaatgccagttagactacactatgctgtggcagtgggaatggaaggacctgatgtgctttcctgaaatgtagttggggcgtgtcacatgcttgagttctgtgtccctaccctctctcactgacccatagtcggacagaccacactgccactgggcccatcgggaggcagggatgggattcaaggaagacttgttggtttggatggaaacacaacagagtatagaataaactttttttcaaatgttgtttcaatttaattcagtaagcattggagatgtattttcatcagaaccctctcaattttaaggggttaatgtctaactcaaatgggaaatgtatagttcacttaactgaaaaggtccagggagttgagttttaggcaaaactgaatacaggggcttgaatcttgttaaatggtttctctccatctcttggctctacttttttctatggtgacttcactctcaggcagggtcttcccatgtgataccggctattggcagactcagatctgtagccttataatttcacaaccccagcagagagagagagggctgctattactgaacagtccttgcagagggctggcaatgatttgcccagtttgggtcccatgaacacggtacaggtactgtgccagatgaactgctggaattggctacgctagggtcacatggccagctctgcagctggggatggagtcacccttattttcatggaccaagtatggagagtgaggtgatttcccaaagacccactaggacactggtatgtggagaacatgagagatggcaggtagacagaaggacaggtacctactacgagcacctgccattgtatgcaagctctgcctagttctcctgcaggaagttcaggagtgaataattcagttcctatccccaagatgctcacagggtaccagggatgcagatacatacatataagcctttttcacgtgagcccacctgtgaagagtgccctgatttgatggcatgtccagcaccaggaagctctgactgcttttactcaaatggcacctggggccaaggcacatgttttctcacatttctattttaagagtcaataaatcatttctggtaccttaactggatattaaatcagggtgtttttcttgtcccctaatacagggccaagatgtctaaagttgaccttcagtctagtccaacatctggaaatgagtactaaagccaccagcacagacaaaaatggagaacaggtggacctggggaacagtctggggaaggaggggttccacatgagaagttacctgcagggagcagttgggtggcttgagttccagcctgagaatgattgtaatgtatctccttaaatccgtgtatgtaggtggcactctgttcctccttatccttgtatttcatctgctctcagggctgtgtttctttgcttcttgtgggcttttgcttttcagttcagcacatatttattgaacctttttgtggggactggctagttattcaccagctctcttccttctttgtcttgggaacatagctaggttatattccccagcctcccttaagttctctgtgactggattctggtctgtgggatgtgggatgatgtaaagtccaccttacttcagcaaaacctcctgtgaagttctccatgcaaatttgccctattcctctgtctgccacctggaagaagaggatctggtgggggacagtggagccacaagatggaaagaggagtctaggttcctaaatgacagcaaggagttgtcaatcatccaaactcctgtgcaaatacaaaactccacaccagattgcgacaggagtgaaagataaatctttacaatgttcacttgttgaaattttggagttattttctttttgtttttgctttagaatatagaatttagcctaccttgagtaatcagagttaaaaaaaatataagaaattgtgccatgtgctaggttctcagtgttgagcaaagcaggtgctgctctggccttgatggagttttcagtcttacctgttattttttctattcccactccgtcttccactccttgcaggcaataacagatgatgttgggggcaatagtcttgaaataactctggtaagtgcccagcagagccagatgctgggctgagttttgaaaatgaacaacttcattggtactctctgagcctttcttggagtggggcttgtctgtgggtcacagcctgatcctttaggccttgtgaagcttgaaagatcctacaattgtgcagggtaaagaggttttttgttatatacacaaattgtactttttcttatttctcatttttgttctcagacaagtccttctaattagttagaatttcattaatccagtcatccttccatccatctatccatctatgcatccttccgtccatccatctatccatccatccatccatatatttattctttagaggtagttttattaataatagttgtcttttgtcaaatgctcatttgccaggtgccatgctattgatatgactagtcctttttaattcaaatgacagtcctacaaggcaggtgccatgattatcacttaataaatgataaactgaggccttgagacatttcttcagagtatgatcccatatatgttttggtagagcctagattcatagtcatgatgctgtccttcattctacatttattgggatgccctcaaatgccatgtctgatggaggcatccccacctagagtagctgacttgaaggagttcacactgtatgtgtgtgcacatgtgtgaagatggatagtcaaaagagactgtcatgtaaacaagtaatgcaattggaaaggtgctgtgcaaagtagctgagagaatcacagggccctgtgagagactggaaggcacccagatgatccaaggtgatggccaaacctacaaacaggggagccagggacaagagcagggatgattgaatctagagtcagactgatcgtacaccctcagtcttccagttggatgtccttggctgggtcagccattctctctgtgactcagcttccccacctataaaatcaggataatttagctcatacttaaagggtagttttaaagattaaataagatggcttcttaaggattaactgagataatacattttaaatagggcttggcaatactaagttcttgataaatattagcttattttgtgataatgatggtcatggtgatggtgatgatggtgttgatggttgtgcggatggtgatggtgatgttgatggtcatggtgatggtgatgatgacagttgtgctaatggcgatgatgatgatttggaactagaatcaaaagaatgttttcctgctgtttccctcattgcaaataacgtacatatgtctctttccccatactcgttattgtctctcaagttctgaattgtcccagctctatcaccaaaccaggtttgtggccttgggcagagcataaaagatgtcttggcttattgttctctctatagtgagggagaatagtgggttctggagctggactgtctggcttacaagctagctccaccacttagcagcaggatacccttgaggaagtcatgcaactcctcagagccccagctttctcatctgaaaaatggggatgaaaatagtaactgccacatttaggtgttttaaggaatggtaaaatgatctgcataaaactataagcctcattcctggcacatggtgacctcttaatgaatgctagatatcctcattttgaaattaagaggtgccttcaactttacttggtggcttttctctatacattgtacctttatttttactttggaaagttgtatgcagtgccccgaatgctgacttgtaaactgatttgaacaccatcctcattccttttggctctctgagaaatgttcttttttaatgaatatgatagcaagacttacttattaccaggttatttcaggcaagagtgatttttaactcattaaccagataattattgcagttctccagttacctttctgttcatagacttaataaggcctgaggttatgtggcagagttttcttggctaagatgggagaattattaaagctctcaggtgaaggtgtgaaacctttggtgcacagagggtggccgtgccattcaagcagtccgtgatggtgagagggagctcagctgcttagggaactggtacagggtttcattaatcatgggacatttctggtgtacttgaaaatgttagttttacttatgggaaagatatccagacgtaaatgtgtgtgtgctgtgtgcatgtgcgcacggtaggttatacagcaccaaggggtcaaatagactggttgactgtatcctgtagtggtttggagcaggtgttggcaaacttttcctgtaaagtaaatattttagccttggcaagctataagatcttcatcacagctactcaattcagccaatatagtataaaagcagcaagaagatacatataagtgaggatgtgactgtgttccaacaaaactttattgtggacattgcagctggaatttcatataattttcatggaccacaaactgttactttcttttgacatttttctactgtttacaagataaaaaccattcttttctcatgagctgttcaaaaacaggtggtaggtgggatcttgctggtgggctgttgtttgctgacctctggattacagtctgcatctgttgcagcttatttcaagcaccgcttgtttcattatttactttatcgccttgggcacactccataagtagtcagtgcctcagtctcctcttctgcaaaagagaaatcagagacttcctatgttggtagagaaaatttgtaagagttagcagagattaagtgccttaaacagtatctggtgcgtagcacccccttgagaaatactagcttttattgttttcattgaattactgtctcatggaattcttacaactacatcatgaggaaaatagtattaatagtattatccccatttcccagatgaaaacactgaggcacagagctgtattctgtctgaggccagagttagaccatgacttacttatttacacaaagcagcagggacctgtctttgatgatgaacaagtccaaattactacaaaactgcttttgttcttcttctaatgaagtgcccaggattcccatccatcagaaattgcctgtgcctattagaaactgtcatttggcaaggggatgagggcggcggcggtggtggggttacaagatgcgcaggtggtatagggaaggagtggcaaatcaaatgacagcaacagagcagccgttactgcattttatttttttggcattttcttccattgttctcctttgtggacacactctggtgtttgcactgggggcatccctgttgtatttgtaaatccctggaggttgcagttgtaaaatgtgcctttatcctctcccattgcattttttttcctctctaatgcaccaaattagaagattgactgattttcgttttccctggaaggtaaaatttcagcttaaatcacaaatgtctgtgatgcacttagcagccaccgcagcttctaaccagtaaccattcctccttattccctctctacccaggagaatattcaggtctattgtgatttcgagatgcattagccgcacttagagttaaggatcaactttggcttctgtggaagctgctgagatttaaagggtaagagctcatcccatttagaacatggtgtattctttccctccttgctcatatcatttatgaaaggataaaagactggagaaagtgtcagagtagattctggaggtacttatattgctaggacaaaaaaaagaaatcacattaccagtagctggcttagttctgcatgttactatgtgatcagtttccaaagttcttcgtcttggaagacaggcagccccaacctatgggaatctgctcaccctacaatggtgagcagacccactccacccatctttgccattcaagtctacagcatttgaacagatcagcccgttctgtgtcaagaaactccttatgcatgttctggacacagccctgtgtctctgcaggttcaaattcccctgaatgagagaaaagttagaatcttcccttcgtatctcagcttctctactcattactcaaacccttgggaaagctgctctattacttattatgtctgcttcctctggaaaatggcagggtaatatgaataccttatttatagggctgctgtgagaatcaatatttgtaaaacacctggaagagagcttgacacatacaaagcactccaaaaatgttctctggcattaaaaacatttgataatatgggctgggagggatcacactgcttctcagatgcaatccttcaatggcaccccatttcttgtaaaaataaatactaatctcctcaacctggcttacaaggccttgttcagtttacccttatgggcttgttctatccatccacttttcctccccagcgacacggtacaggcacacctcagagatattgcaggtttggttctagaccacagcaataaagtgaatattacaataaagagaggcatacaattttttttttgtttcccagtgcatataaataataaactacagttacgctgtagtctattaagtttgaaatagtattatgtctaaaacgtgtgcataccttaatttaaaaatactttattgctacaaaatatgaatgatcatttgagccttcagggagtcataatctttttgctgattgagggtcttgccttgatgtgacattgatggtttctggctgatcagggtgggggttgctgaaggctaaggtgaattggcagtttctaaaaagaagaccacaatgaagttgtctgcatcaactgactgtttcttttacaaaaactttctgtaaaaattttgtatagcatgtgatgctgtttgatagcattttacccacagtagaacttctttcaaaattggagtctaccctctcaagccctgctactgctttgtcaactggtttaggtactgttttaaatcttttgttgtcatttcaacaatgttcacagtatcttcccaaggaatagaatccatctcaagaaaccactttcttggctcatctataagaagcaactcctcatctgttcaagttttatcatgagatttcagcaattcagtcacatcttcaggctctatttctaattatagttgtctttcagtttccaccacatctgccgttacttcctctactgaagtcataaagccctgaaagtcatctatgaaggctagaatcaacttcttccaaactccttttaatgttgacactttgacctccttccatgaatcatgaatatttttaatggcttctagaatggtgaatccttttcagaaggttttcagttcactttgccccgatccatcagaggaattactatctctagcagcaacagccttacaaaatgttatttctttaataataagacttgaaagttgaagtcacttctagatccatgggctgcgcaatagatgttacattaacaggcatgaaaaaactagtctcgtacatctctattagagctcttgggtgaccagctgcattgtcaataggcagtgatattttggaaggaatttttttttttttctgagcagtaggtctcaacaatgggattaaaatattcagtaaagcatgctgtaaacagatgtgctgttagacaggctttttaaaagtagcactgcaagagtaatttaggatgattatttagggccctaggattttcagaatggtcaatgagcattggcttcaactaaaagtcactggctgtttagcccctaacaagagagtcagcctgtcctttgaagctttgaagccaggcagtgacttctctctatctaggcaattcctagatggcatcttcttccagtataaagatgttttatctacacgaaaaatctgtttagtgtagccacctttgtcgatgatcttagctagatcttctggaaaacttgttgcaactctctacatcagctcttgctgcttcatcttacactcttatgttatgaagaaagctttctttaaacctcatgaaccaaactctgctagctttcaacctttcttctgtagttccttacctctctcagccttcagaaaattgaagagtgttagggctgtggattaggtgttggcttaagggaatgctgtggctggattgatcttctattcagaccacttagactttctccccatcagcaataggactgtcttacttttatatcatttgagttttcactggaatggcactttttatttcattcaagagctttcttttgcattcacaacttggttgattggcctaagaggcctagcttttggccggtcttggctttcaacatactttcctcactaagaagcttaatcattctagcttttgatttaaagtgagaggtatgcaactcttccttttccttgagcatttagagaccattgtagggttattcattggccaaatttcattattatgtgtctcaggtaatagaaaggcctgaggaaagggagagagagggagaggaaaggctggttggtggagcagtaaggccatacacatacaacatttacctattacgttagccttcttgtatgggcatggtttgtggcatcccaaaacagttacaatagtaacatcaaagatcactgatcacagatcaccatgacagatatcataataatttgaaagtttgaaatattgcaggaaagaccaaaatgtgacacagacaagaagtgagcacattctgttggaaaaatgacaccaatacacttgctcaatgcagggttgccagaaaccttcaatttgtaaaatatgcagtatctgcaaaatgaaataaagtgaagcacaatcaaacaaggtacacctgatgtctttcagttggcttaaggtaataattgctgcagccagctcagtccagcccagatttgttacattttcatgaatttttcaaatgttttgttaaatacagctatcattaaaaattaaattgcatcaacttataattaagttatattaaaagaagggtaatatgggcacaaaactgaccatttcctgattattttactacattttactattttctatgcttatttagtcctattatttatgtatggtgaaatctatataatggggaacagctgctcatagctgccagcacttcattcagtgaagtcacattggcagcttgaagctggccatgccgggagtatttatatgacaggaactggcaaacacctcagggctagatgtcttgtttttgaactagaatggcagtcagcaaacttttttctgtaaaaagctagaggagtatcctaggctttgtgggcaccgaaccctctgttgcaattactcaaccctgcagctgaagagtggaaaacagtcatagaatatacatatataaataaatgagtatggctgtgtttcaataaaactttatttaccaaaacaacaggctcacagtttgctgaactctagtctagacttacaaaagtgatagagaaaacataaagaatgcaaattaaattttaaaaatgtgttgattctggtagctgttacattgtatattgccccccagaacacaggacatattctttaaacatctgaaaagtattttgggattcagcaaagaagctgctcaagacattgacaaataagtgaaattctgacttaggtcattggtttattttcaatcttgcttgttcatttaaatggaaatggcaatcaacattgatatgggaaccacacttgctcatcagttctaactgtaagttggctacaagtgtaagagtttggaaaaaaatcaacaaaagcattctgtgagaatcaattggctgtgtgtacaatttacaatatagaaaattgtgtgttttattatttgtaaattatgtgttacttatctttgatatcagtgaaatacataatcaacatatatgtgcctggacatgcctatattggtttttgtgtagagccaattattaacattaccagaatatcactgcttgaatggggcatgttctctttagcttccaggcctttgagtggttcctccacctgaaacaatctcttcttccctttgcctacctaactcctccttctttgatctgcagcttaaatgtgacttcttcaaaaaagacttctttgatcccttcagtaccaaatgagttcttccctttatgcacatttttccttgtgacacttgacttaattatagttaaatgatgaattatgtgctggcttattacttcctttttaccaaaagactgcacgcttccccaggtagataggtccatcttctttatcatcgtgtctttggagtcttacgcagtttgttgaaatattatgtttgtagctgaactgaattgtgatttaaaaaaaaataggtctgtatttaaaagttttagtgtcagctccatccagcccaagttaagtactaattcagcaagttagttaagtaataaatggctgtcactcaactacaacatatttgaattcagttttgaggccccagtagttgctaaaaatcaatgcccactttctccaggtatagtaattatttctcatattgttattgactgtctctttaaagaccagccaggacaaatctatttctgaagctgttgtaaatgatttgaaacaggaagatgaatggaatggaatgagggttgtttaaaagagatttatccctcttattcttgctcaagaaatgagtggccagttgctaccagcctatcccaaaagccaagagataaaagccagcagcagttaattttctagtccgtgtgctagtgaccacagatatctaaccactgatttccaaaggcttactattattcatacatatttactatggtaaatagctcatgttttcaggaacactgaggatctgtttagtcactttggatttctggtttcatcaagagtttgtgtccgacatctggggatgagtgagggttccggatacccattacagaggaagagtctgatggggaaactagagggaattcctatctggaatttaaatttaagtttaggatctcagaaagacaaatggagttgaagctgtgtcaggcagaagagatatctccatttgtttttctgctttctcaacataaggcaaatgtcagtagtaaccaggtttattccacaggcatactctgcaatgtgtgggtaattgtgcctatcgattgtgacaaagtcttcaagcatgaggcagagaagtttgctatccaactggatgccctcaacaatgtttgcatctcaacaatgtgtcctcacattggctggctttacatatgcagacaagtgaggacatgcagaaaatcatttcactggtcctccccattgcattgtcgattgtgtggaggctaacatgtaaagttatcagcccagcagcagacacggagtgagttgtccataaatagtcattctaattgttctgtttttcttattataatttatttttgctatgtaaaaaaaaatcaaatgatctattgcgtgtatatgtgagtttttgtttaaaggcatatgacccaatttgtaaacatgatcattatcttctctgggaagaatactaaccaagggaaagagttcatgatttggctgtgtagagctctcattaagtgataggtgactggttctgtgctgagtgtttttcatcatcttgatcctatgagacattcaacattccatcttcatcttacaaatgagaaaactgaggcttagtgaggttctatagatgctcaaggtcacagacccaacaggtgactgagctggggtttaaatctccagggggtcttttagtaaggcttatgcttttaagcaccaaactctaccaggatataaatggcaaaaggaactgcttaagatatgaagagaaaagaaacacactacttaacacaaaacaaaaactggataaaatacccagttgcctgaatatgtatgcacttattcttgcattcagcaaataagtacatagcacctatcatgaaccagtgactttgcttaggaacacaaagcaagcaaaatccctgccttgatggcacttacttcttagggaaaagagaggatgacagaactgtagagaaaacagagtataccagatagcaatgagggctgtggagaaaataaggtgggaagagaactaatattggagctgggatttcagaaggaagaaagtgtttgagttgagacctgaaggaggtgcaggaaccacaggaccatctggggtcatggtcagcaacatggccaatgggccaactttggcccactacttgttttcatgaataaagttccattggatctcagccaggcccattagtttatgcactatctgtgtctgtttttgtgttcaaatggcagagttaagcagttgcaatcctgtggcccagaaaaacttaaatgtttactatttggccttttatagaaaaaaaaaatgtgtccacctacatctagaagaagagttttccagggagaggggacaggcagcacataggagtctcaggatgggaatatgcctagtgtgtttgaggaggcaggtgcgcctgcaacagaatgggcaaaggggtgagtggagggcagggcctgggcacgtgggggccactgtaggggagagagggaggattctgcagagtgttaacaggaggactctcgctctttgtgatacatccactgtcttaggttgaagaagcaactctgagatggagtttagcattcagggccaacacctatggaaagcaggggcaggaagcaggagtgagcagagggagaagtccagctatgatacagaccaatggcaaccttggccactctctaggagcttcagaattgaccctgtttggcccaagacagacaggcctttatactccagtgttgatcggtcattgaatataggtctttcaatggcaacaacagttacaaggaaggagcatcacctgggtgattgttgagaagctgagagccgagggctgcctgctgaccgcactcccagcagctggtgccatgggtcctgcattgaagtaggatcttgggggcacatcacaatgtccagcacatagaggatgtagggagtaacagctaaagcaagactaattaggaggctactccggaaatctaactgagagatgaaggtggcttgaaccaggaggtggccaagagttggcagactctctcttttgaaggtaaagctttcatatattctccatggcctaagatcaccttaaaggagcaaagtaaaaggaaacaagccaaggggaaaggcttcaaagattcagtctatgttattaaatctccccacccattgattatcatccatgacagtctttgcttagcttaggtttacctgtgctcatcattttccagggtgtacagaaggaacactatttaatcacaaacgttccaatcacaaatgcttcagtgacaggaatagaagctgtcacaccagacagggcagataagtccttgtcacatggctgggtctgtccctgcagtgactgtgctattcatagcaagaatgttgtgttgctaaacttggcatgaaacaatacagttatttatgcgacttcatgaactagagtatcgccttggatttgagattctgctaaagctacatgagtgggcaaatcaagaaattgtattccataatttgtttccaatctgacagagtactatgtgtaatagatgaataagcttatagattttagcacatttattgcagtgtgatgtggtttgacacagtgtctatgagctgtgtggggtgaaatggaaggtttaaatggattccagcttcattatcccactgtgatctgaggaaagcgagaccacaatgttgccatccagtaaagcactttatcacattccttcccaagttgaacagcagcgttctgccaaagaaaagctatttgctgggtagactctttagcaagtttcatttttaacttgggtgccaagccagccaatagaatctaatgggctttgcttacaatgtgcatggcttggctatttacatgagattgacagcacgagaaaaaccagacgctatactcactaggctgatttagaggtttctctgctcatttgaattcagccaagctagtcagtctagccctgggaaaacctgcaagagtaaaaagagaaccaataaaagcgattcatgaaaaacctgaagtgcataagaaattaattcccctgagtttccaaactagtcagtaagctgcgctgaggttttgctttctatgtttctcctttgcttagggactggtcaaaatctcgaagccacttgttgatttttctctctttaaactgctttgatggaagaacacccagggtgtaatgggcacctgggtgggtggatgcctaactaaatatatttatataatccttgaaacatgtttaactctggaggttaaggaaggcccaaagacaaagcggagttgttaagggaagaaaaaaacagaacttcttaaaggttgacacggtgccactcattaattctagaaaagtttgcaggggctgttacatgtcagacacaatgctagccttcccagatgcattgatgaacaagttgcaattcttgctgtggtgagctaatggtaaaaataaacagagcactgccacacacagacataagagccatggggcagcatcccattccaatgcctggtacatattaggaacccactaaatacttgttaaggttcattttgtgatggtatttttttcctctctccgctagcttaaatctgttcaagtctcccatggttaatacgataatttttctgatgtttatcaccaataaatttttagaaaaatcaggctacacagtcactctctccaccttcttaggatacactcactctcttaccctttcactccttcgggcaatttgatctgctatcttttcccaccactttaagagaaggactcttgatggggttcccacacctggtcagatggcctctcttggttgtcttcctcaatcctttcattgtgttgtagttgggcagttcctccacctttcacttctcagatgcagcataatcgtgtttcttcctcccctctgaatattccttttctgcctctctgcattccttttcctcttcccaacacctaagtgattcttaaaaatattctctgactttctatgccttctccatcagtgttagtttcaagttatcttgtcatagtttcatttaggagataatgcctgaatctttatcttaagccttgaaccctctagaacaatttcatttgtgtgctgggcacctggatgtcccaaaggcatgtgaactcatcatatcaggagtcaaactcattctgactaattttatttaatgctatttccattcacttggtcatccaggtggagacctgagggtcaagatggagccctctcccatgtctctctctttgctgctctcagatggacccaggggtcatgtgctgtcaactcatccatcactatatttttctcctttgcccttccatgttatttccatttcacccaccgttgtgtgataccacagcgtctgttttacctcccactgaacaaaagaaatataatccttgaaacgtgctccttagtgtggaagagaggggtggtctgatgacttgtttcaaaatgatctcaatatcaaccactgccccaacggtcttgcatttcatacttaagcaacatatttcaatgcagagaaggtttatagtgtggtggggatttgagggtagcttttcaattctgctctgtttgatttttgactgatgaccccagacacagagatttggcctggcagaacctgcccttagttctatagaggacaccttccccatacttttttctccttttcctcttcctctataaactctaggttctttcactgcatttcttttttgtaaacagctttactgaggtataattgacctacaaaaaattgctccggtttaatgtatacagtgtgatgagtttggatatatacaagcactggtgaaaccatcagcttcataatcaaggcttccaatatcattcacctccaaacgtttccttatgcccctccagtgtttgttgatttgtttgtggtaagaacacccaccatgcaatctaccctcttaataaaatgtttaagtgcacaatgcagtactgtcaattacaggcgctgtgttgtacagcagacctctagagcttactgatcttgctaaactagccacttgtcacacattcgttaggtttcatgacagtctgtcctctgagatgggctaagagttagtctgctctcaaagagtttcttgcaagaatatgatgggtgctttgtggtgaaaagtgaaatagcaataaaaaaaatcagtcacttccattgtaaaaataaacgtaactgcatggccaatatgttattctaaaacagaagttggcttcttacctggctttaccgtgcacggaggactttaatttgtgttcctgtcaaactctaggaatgtgaaaatgtggaaagcccatcccaaacaaaaataagcctcttgccggagtcctcacctgaaatctctctcattctcacccattcacctttcaaatctgtgcttttagcacatcacctttctgccctaaaacgtttagtggctcacaagctagtttccaaattccttagcttagtagttagccctccgctaccttttcttaatgcacttttacacttttctccatgctgtaactaaacagcactacctactaaaatagaaagatacctttcaggttcctgacctcatgccagtatctaccatttccttttcctagaattctctctttctccttatttaaatcctgtgcattctctagtgcatttgggggaaaatgtcatctctttctgtaggcattaactctctatgccctaaaatttcatataaccttggtggttccttttatctcacacatttcgcttatttctttgactaatgttattcatgaacatgtcttaccatttattctgctgcacctacaacccctggtggccagtggctgtcttactaacttttgtgttccctgtgcctcacacatcacagactttccagaaccttttagtggataaagttaatgcagaaatgagttaaatattcaaagaagcagtgagcaagatacgttttttattcttcctttcggaaatgaatccttgctcttccccacccctgggaactgtgccctggttatgattgagatctcatagtcactcatcattcattctttagttagaattgcataacattttattctttacaataaagataacttgttaattgcttaaccagatgtgattttactattatattttttagtaattacataaatcagaggaaaaatccttttcagatgatatgcccttatgtgtgatttagacaagctgaccacctacttttagataaagaaatcatcttctgccaagatggggctagatgtgagggaagagaagtttcctaccaagaatttccatttaaattcaaatttagaagctttcttagtccctgagtcttattccacttcagacttgttgaaattttcctcatgaaatatgctttagttgtcttggtaaattttaagagtgagagaagaccaagtaacagtttacaaaggtaagaatcatttaaacctacttactctccctgtttaagcaatgaggaggattctgtttatttatttttaaaaagtgttaagggaagaagtgctatttcaaattaaatgaagacacgggaatttgcctttaattatttaaaatagtttaaatcttgttgttcaaacaacaccttgtctctacaaaagaaaaaggaaaatacgatgacactcagactttgtcaactttttccaaatattagcaagttaaaaaaaactattggttctgaatggtgagataaatatatgccacctgtaatatttacctgaatagtatatattcagaatgcaatattgtgtaatctcttttaacttcaaaataacccttctttgccctgcaaagatacttgaactcttggtgttggctacctatgaaattatgtcaaacacatagattctacatctccagatattcaaaactaattatcccttaatttgcaagtgaaagcaaaataccacctaatagaccatttctctggtaaacctttctttatcttaatgagcagaatgtggacgcctattacaacctgattttaaaacctccgtgccactcaacagcttactcataagactgaccagaaggaggcaacaaagatgtaaatattcttatttacaatatggactgagctcatatctgtctatttagcattttattataatgcatgccatcccaacagaatcaatagttgattgatttcttatgtaagagacttgagtactttaattctggatggaaactcatcagcaacttccagttgatgagatgacgttctccatttggtgaaactgggctacatttaatcatcacaaacttcaaattgtattatcccactttccagataatgtacagcgtattagcccaacccgctttcttcagaagtgtctttaaacagagatgggctgtatctagataggggtggaatatgccagtgtatcggttagccgttcctataataatgctgcataacaagccatgctaaaattccatggcttacacattgctccataggctgaggggttggctgatctaggctgggctcagctgggcttgactccagactgtgggtttcattcaggtctgctccatggacgtctcattcttctgaggacagcgtgctccttcggaaacattcttttcctgatggagactgaaagtttccaggttagcatatagaaacacatgatgcttcttgaagtctaggtaggaactggtgctcagtcacttccacccactgggcaaagcaagtccaatatcaatgggggaacattctgtttggaagaacttcaaagcctcatagcaaaagcctccatatggggagtagtgaaaaattgggaaaaataatacattcgatcacagctgctttgttttagggtttatataaaagaaataactttaaaaggggttacctccttctcatgcctatatttttaaaagtaagtgtattactctacattgaataacccaagctaaaagtattttatagttaaccttgacctagtatacatactctctcactctcactctccccacacccccaaacccaacaatgaccacagatcttcctttccttccactttcacaacccaaaacttgtcctgttcattctctgctcaaaagcccatcagtgaatccctgttgccattgatatagctcaaaccctcggctagctttacaataaccttcacagtgtgtggtttgtctcttccatcattctgtgtgaatttacttgtctgtctttccacatgttatttcctttgctgggacactctcttttctctctcccacctgcctggtgaattgatgtttattcgtcagagcccagctcaaactttacaacgtctgcacatccttcactaatcccctgcaggcttttctgtttccttatctgtggtttacaagcattttatacatatggctataaagcacttataataatagactggaattagtcattcatgcgccttttgctgctagcctgtgaaatccttgaagatgggggtccatgcctcattcattttctatcgttagcattcatctccatgcctgtaacatggtaggcttcaaataaggtggttggattgaaaagaaggagattttaaaaataagcatttaagaaataaaaaggagaaacagccatggcacaaacagttatgttcaacctcgccattaattaaagacactataaacaaataaaaattatagatcaatttttatttttcaaatagggaattatgtttttagaaagacaagacatagtattgaaaaaaacatggatatctggcattgccaactggagtctaactgacaactttcagggatttttatcatttctctttctcaagtacttaaatatattcatatgtgttgacccagaaatttgattttaaataatttatcaagtggaaataaagatgtgaaaaaattacataggattgctgattatagcatcatttatagtaggaaaaaattgaaacactctaaatttcttacaatatcagcccggttatataaaatcatggtgtagatataacattgggccaaaacgtctgccattattagaggcacagttaataaaatgggaaaaggtttaccatgtatgttccaacataagaaattaagagcacaagaaatgagaatcttgtaaaatataagggctattgttagttacatcccatgtacgccaaaaactgaatttgaaagaaatacaggaaaatattaatagtgattacatttggatgtaataatcacaggatgatcttatttttatttttttctttttgcctttctctagtttccaaattttctacaatgaacatacatagcatttatagtaaatgaaaagatctaaaaatattttaaagatataattatgatacagtaacttgtactgttaactgggcttgtgtgagctctaagttattgattatgtatagctctttatgtgagtttctgctacttttgagccttgacttgtttatctttagattgggttccatttctcttttgtaattaactaagaactgaaatgaattttctaaatagaattgttcttaatttaaatatgaaattctgttttctctaatgtaattgtacctgagtgaaagtaactgcaatgaggactataaaggaagataaagtaggaatatgatgtataatttccctttgcataattgtaactctgaagaacgcatgctcccagcagaaaagtaatttaaattatatcacaacaaatgccatattttaaaatagaaactatccatcatgtactgagtaaagctggtggcaacctatacatctcaaaaatatactgaaaatccctccatgagtccattaaaaacaaattgattggtttaattccagcacatgctgaaggaaagtataagtgacattaatgtaattttaagtgcataaaattactaattacatatttagaaaaaaattatgtaagagaataaccatgagaaataatttttattataaaatattgaaatgtgtacaatgtgaacagaatagtataataaatcccatgtatgtagcgcccacaacaccttttatttctcagtacaatttttattttggaaatgatttttaaaaatgtagaacaatacttttgtctttatcttctgggcaaaaccagttttgaacaacagtgaacattttaataattgtagaccagtgctaatatgttttttgtttttgagacagggtctcgctctgctgcccaggctggagcgcggtggcactctctcagctcactgcagcctcagacttcccgggcttaggcgatcctcccacctcagccttttaggtagtggggcctacaggcgcagaccacggcacctggctaatttttgcatttttttgtagtgacagggtctcaccgtattgcccaggatagtctcaaacgatccactcacccacttcagcctcccaaaatggtgagattacaggcattagccactgcacccatctactaatacatattttgaaggcataatttgaaatctgttggaacaaatgctccagcaaagacattaaaatatatttttcacctagacagagaatagacatacctttcatgtacacaatttaaaatacagacccaacactcagcattcttttccttggtcagcataaagcgtgtgaatatggaaaacatgtcaagtgttgcttgtcccccactgttaatgttttctcacattcctgtccagagatagttctctgcatcttttacattaaaaatcttgccataagtgtatttttaatacaaatattttctattttataaatatgacatagaaaaatttcaagctattcaggtgtatgtaattaaatttgattttttacaggaaattttgaaattgttatagtgattaattgatttgttcatctggcatgtattaggcacctactatataccaggtgctcttttagactttggagaaaacagtgaacaagatggataagggatcccatttttaaagcacaaagttttctccagctatttcttaatggagagattaaagaaatcttcgcctccaagaagtctggatctaagtcatctccctttacttgatcaggcccatttccaccccctagttcagttgacagagataggatggcagcctctgccagcatgtttcaggatatacccaggaagcaaatacctggttggaataacaaagtccaaagcgaagcaagagggtgattgttaaatgagtaattagaataaacactgaaaaatggtatctgcctgggcctctatttttctcgcttttgtagtcgtttttcataggttggacttcttgcccttcagagataatgaaccacaatatgcatctatctgtgggtagcagtagcttgagtttgggattgttcctcgggttcctagggatttttttgaaaaccaggagaggattttctgaacccaattggtccagttaatgtatctatacgtcttacttctctcttttccaggcataaatctctgggctggcttctagaataccaggtccctttcccctcagttcctgtgtatcctgtgttatagctccaagaaggagctataacagggttagaacaaagatctcccctccctactactcctggataaaaatcacagctaagctgtgacttttgagtgcttagcacatgctaggcactgcagtgaatacttctatacacatgatcgcatttaagctccaccacctatttcgagggctggatgaatttatgtttcttgtgctacatatgaggaaactgaggcacaaatagcctcggccatttgtacaaggtgcagagcctgtaaaatggcagcttggcagtgatacccagttgtatcactctaatccccagagcctgtggccaccatacagggctgcctctcacaacacacataaatagccatatgtctcataggtagcattgacagagtcaattcttttccagtacggagagcggtgaattttgagaagtgactttttggcagaaatgcaatctagtgacaaatcagcaaaaggttagagttcagattaaaactcagaatctctgacttcagagtctacaagttaatctgtgacactttaaaggctctgggaaacaaaagaatactgttgaatctggttaccccctcagactcaggctgacttggagttgtgtgcgtggggcgatgccattccaatggtagccgctttgctttatggggttttaggaagaaatccaagcttcagtagcctttcccaaccgaatgcattattaaagatacaacgtgtaactcaggactgattttgacattttaaacatgatttttctccattaatagagtaccataaagtcagcagtaacaacattacagaaagctgagaaagaaaatacggtgaaaccccgtctctactaaaaatacaaaaaattagccgggcatggtggcgggcgcctgtaaccccagctactcaggaggctgaggcaggagaatcacttgaacacgggaggtggaggttgcagtgagccaagatcacgccactgaactccagcctgggtgacagagcgagactctgtctcaaaaaaaagtcttactgtaccatatgtatgtggttccatcatacatcatcgtaggtcatcgtcacctttttctcccttaggtataagccttttcttatgttattgtctcttttcataaataggatttttcatagtgacatacacatcattgaattaataaaccacaatttaagtaactatttccacattactgaatatttagcttgttcttttagtcccctccagtttgacactgcaaacaccaaatttggtcctctgttattttacttccagaaaataattttttagaactaagattaccaagtcactaatatttttgtggttcttaatggatatatattgccaactgcttttcaaaactattgttatatttaataccatcaaaatatatccattcacaagtttaattacactgtcttcatcattagtcataacgttttaaaaacataattgccagcataagagggaatctatctatgtctttctatttctctctctctatatatacatacattttatatacatataagcacacatcaaacatactatatactatatacatactatatattatatgcatggtgtgtgtgtgtttatatataaacacactgtttatatatatgtgtttatatataaacacactgtttatatatatgtgtttatatataaacacactgtatgtatgatgcatgtatatatacatattttaaacaatttctaagtcatactcaaatagagatgatagtactttgacatttctttaaaatctaggcaaacctgagatgcttttatcattgaaagtagaaggtgtccccattactggcagggaaatagattccagaatttcatattctctccaggtcagccactacaaatgagaactgaagaattaatctaagacttttttcatttttaaaaatcgggttattactttagcagaaatatgactttatgccttcataactaattgtactaatttatgaataaagtacatttttatttaaaaaaccaagaggcatactagaagaaattaatccacttattttcttctcaagtaagtggtttacttaagcatacatatatatacaatttcattttcctaagacctagaaaaaattcccaaactgatttcttaaaatttttacttgaaaaaaatttcagcttataaagaagttgcaagagtcgtaccatagttggaaatactctgaatcatttgctttgttttggtgtgatagagattttttgtaacgatcacttataatgtaactccctggaatattaaaacaattgttaaggacctgatgttgtgattagagcagccctgtttctttcgtttttatattcctgacagtgaaaattgctgtgcaaatagtagaaactcagaatgtgttgttgaattgaattgttagattgtcttagtcctcttctattcaggcattttctaagacaatgtgattgatacaaacaagtagaaaatatgctttctcaatacaatgagttttatttccagtgggactgtttaatcagaatgaaatgttgttgtaccatgatgactgccctgcccttagaagtcaattattttatgatggagaaaaaactgtggtccgtagatcagtagaatcagcatacctgggacctggttagaaattcataatctgtagccaaaacctatggaattggaatctacaattagaagaccctcaggagtatgcacgttaaagtttgaggtgtttaaagttaaagtatgcactttaaagtttgaggtgtgtttattcaggtagctttcctttcttctcatatagtttttaggtataaatgaaaggtctggattatttcacgtattggcagatgtgtatttattttttagtgcagtgcttctcaaagtatggtccctggaccagcagcatctgcattacctgagaacttatttgaaatgcaaattcttgggtccttcctcaggtccgaatcagaaactttggagaatggcactactgtttaacgagaccttcaagtaattctgatggctagagtttgaggaccactgctttaatgcttacgagagttgaattagttgtttaaacagaaatcttagaggctttgaatccacttacaaattagtcttttcaaaggtgtactttttaagtgtctgcataatgcgaatgttgtgaagtatgtcaactcttgggatttaggaatagcagagtattagtattccagaggcaaaattgtaattggccttttcacttgcattttccccacaagtgacaaaaggctaaaattaacaatagaaaggcatttgtttacatccaggcaaccttcttttttaaaaaccaaggcacaattttagatagttgataatacctggaaaagcttgggctcaacttgaggaagtagattccattttacttttcctttatttcccagatacagagaaatccatgttaaatgccttccgtgggtccagaacttcttgcttgttctctttgcccccagtctcctatttgacagagcagctgcactataataaatgactccctggcatttcagcatcatagctggggactctgccaaagccctggccacgtctctgtagtgggacgtacaacaacgaagaaaagaggctggatccacaaaccccacaggaaattagtctcattattgcaactcaattcatgttcccatccagaagagggcttcattgcacatggcaattaatttactatgcagagtgtgttttgcttggtatcagcttttattctgacttccaggacaaaatggttgcctgagttcttaatcgtgtgtgtgatttgacagtcaagatgggctatgggaatcatctcttggtagtgtcatcagcagaaagaaaattcttttctgaattgagctttggttgtatgggatagatatctgttctgttggtggtggtggttgtggtggttttgtgttttaatttttggattgtgacctcagtttgagtgagcaatgtgatgaagctgctaacaaaaaaatcaaagagaaaactctaaactctgttaataattgtacattgtaaggtagtaaggcatgttagcctcactgtgcttgtcacagatcagaatctacctagagagctggggtacacgtagaagcccaagagtactagatgatctcctataaagagccaggatggtagaagacctgtggattggccttctgctatgtttctgtttcccagcatcttttccctcctgccactgcctattttaagcaattttacttgaactttcaaatatgtgccttggtcatcccaacagatacctgcacctagttggccaatcagatcactaattgtccggtctcagcgattgatctagacacatttatgaccaatatatggcaaatgagagttctttgggggaaattaatttgaatgttgcagagtgttggccttctcactcccctgaaatatgagttccaaagacaaggtgaatctggaattgtggggtccaatttttttttcaaatggacacagtgagttggataaaaagcccgacagagccaagaaatgcagagagaaagagagagagagagacagagagagagaaggaggaaggtgggaagagagtgacagaccttacggtgttattcaaatccctggatccagctgtacctaaagcccataccttgagcttccccattacatgcaccaatatattatctgtttaatgagtttgtttgcattacattcaatgaggcttcacttacatagcccaggagtctcacttacgagtaatagtttgaagagagaggtaaccctgatggagaaaaaatgaagatttatcgtgacaggagtggggcaggaaaacccacttcccttcacatatctccaggttcggaactcatctattcctcctaacagtgctctgaagtattacctagcctgtgctacagatacaaaaactcaatgtaaggctctaacttgtttaaagtcacatacagagtgagagagctgggactggaacccatgttcatgcgattgttttaaataggtgtccctacttctgagtttccattgcattatgtatatattttccttgaacctccttaaacttaacgtattataaatgtttgtagagtctactaggctatgccttgacagtcattttttgcttccctcctttccttccttcctcacttgtttctttgcctccctcattttctcccttcttcctcctttcctttatgttcaccagcacctaacatacatttatgcctattggaggtgtcagtgatgttatttttgccaatgactgaatgaaagaaaaaaatgtataagttgaaggctcctgtctctagaaacatggaactaaaggcaagtcgatttttgtttaggcattatggggagggtattcctgggtggggccaaagatcagattaagaatcccccataaccctttaaagtcaacagtccatggaggagttgcaccaaaaagagactctccttctaaacatctgtgtgtgattcctggaggacataagttgagcggggtgcttttggaggttaactccaaaagcagcgatgcttcagagggcagcggttgtaaacagaaatcaggaagcagatggtgggggtatctgtggccagaaataagaatatctttattgctgagtaaataaacaagccacatcctgactaaatgggtggaaatttcctgaacatccaggaaggatgtctggtctttaatctgtttttggaaagtcaacctcagagcactaagcccaagtgtgtgcctctaccagcctcaatctttatcttgtgatttatcacccactctctccttctttagggagcttgttggttattctgcttatggactcacagaagagaacaattcttcctccctttgcccattcaattccaatctgaatgttagtaccagactaatgatctgacatagactgaagaaggttccaaggacttttctgaaagctgagcccatttttgttcaccattctcttaaagtctcaggtggagaaggaagaccttaaataatagcttttcttttataatgaaaggggaaaaatatctgaaagaatgcttccagctgatagaggttggacagaacagtaaggagaaattctctaagtccacctggagcttattaagattgaaaattgcaagagattggcttaagctgattttttttttcccaacagcctaggcaaagactctgatttccaattttctgttatggttgagtgcattcttccggcaaatatttagtaggcactcttaatgctaggactggtcacttaaaacaagtgtctttaaatattcttaatttagacacataatcttcaaaccacaacagtgatggaatgaaagctagtcatcagcagtttgcaaaaattatggcgctggtcctctccccagccaacttaactgggcttctaccatcctcctccttcctgatctttcttttctcttcctgagcatctatccagttccctatttaatcatatgtaatcttcagtatgtgcttttatgtggaaagccagatgtgtaccagttgatgtcaccatgatggacaagaaaaagggaagcttacagagaagggcagattcatgggcttgcaacatgtacaattgcatagggccctgtgcttaacaggagggcccatgcgtgcgagttaatgctctgtcatcactaccctgaaattcttaatagatttttttttgtgttttgtaaatgaagcccaaaggaacaatggagcatgagctggggcttggagcctcacttcacagacagccccacctcctcctgcctcctcacttccctgggagaggtctttagccacctgatccctgaccttgccctacacaaggcacacactgacctcctactacagcacctcattgcaactagcatggaccagagctctggggcagggaggtttttgtcaggtgcatgtaacccacatgcagaattataggacagagccccaggttcctggaaaggtcagacttatccttcatatattccatgcctgagagagcacaatattaaatagcaaataaaaaacaccatgacagattgagagaaagaccatggaaaacaggtaaaaaaaaaaaaaaaaagttttgtctgctttttagacaagagatcgcacgttttcgttttgtacctagctctgcaaattatgttgcaggctctggttacatacagcctttagtttatcagcacacagtgttggtgagcggatgagaaatgtggatcctcccgcaggtgagtataaggatgtctgaatgtacagaaagcagcctgatgtaggccagccccatacttaactgacgaatttatcggttgtatctgtcttccagaaacatacaggctaaacgccaacaaacaatgaccatgtctaagcatctgaatattcctctaagaaatcaactgacaaatttgggggaaacaagatgatagctgaaattaacagaatatcccccaaagcagcagcatgggaaacaagtgttatttataccataagctaacaaggcaggcctgggacaatcaatacatgagcctcctttccaccaaattctcttctcattatgtaaataggatggcctgaggtgcaagaacaatgaatagaataataatcggaaatgtaatggaactaatagtggatttctccggactgttaacttctgttcaaagagcccgccaatgatggatagagagcggcgtgcagaaaggaatctttccctggttcagcttgggtgcactgccttgtgctgactctgtcccctcccctacccaccacaccccatgtgtctagaacaatctcctctgcagtacttcatttcctaaatgaattagtccagagccctgttttgaacagatgcctgtacagttcttgattggttgaggcaagtctaaactgacataagccctaactctgaaacatgtgactttttactttgaaaatgtccaattctcagttgtgagctattcatgtgcaagtaacaaacacctactcaaacaagcttaagaaaagcagggaattcctgggaggatgcaggagcaggaaattgagccagtcgttccaaagggccagaaccagaaggcagaccactgggtcccagacagatgggtcatctctttccactgtgattcaagccctgatttgtggcctttgcctattttcatgatatcaatacctccaccgtggctgattgcaagctaccaatgacgtatcatagaatgtggcactggggagggatgtgcagccgcaccccattattgtaccccattatgtagtacttctgccatgcagatataatagataaataatcttaaaagcatagataacagtcaaatacatttgtaaaagagttaagaagtgatgcattttgagtattcattgcctttgcttttaagattattgaatcatgagtgcatgtaatgtctaataacatcaatgtttaactggcttagaaaaatcctgaaatttcaaaagtgacctcttacaaacagtacgtgtcagctcctacttattattcctcctcatgagtccatggaaacagcctctctgggaagaaggcagagagcaggagacaggtcgtggtacagaaggaagtgactggcagaagtacatggatggcatctcagttcaatctctctttattattttggcataattcaaagttcatatctcacttcatctcaaaaacaatatgcatatctgtccttggcttcattttcctcctacctcttcagacatctcttctctggctcttccccttaacccctaactgggggctttctaccctgtctttgcacaccatttatcctctctataatgacaactcctaaatctaagaaatgggcacatttcccctgctaagctacagacctgtgtatttacgtacttcctagatattgccccatgcatggcccaccatcaccttaaattcaagatatccaaaacaattctccatcaaaaaaaaattctttatagccaaatggaagtgtgctgtaatgagaggcatggactttgattctagtgccaaattgtaggtcttaatgagcttgctgactgtgagcacgtcactgattctccctcatctcagagttttgccatctcataaacaggcttgacctcgattaatgggttttactccacaatccatggggccctttattctgtgggtccacctcagaagctgtccaaacatcaagagagaagtggccttggtccagtcctgggcaccccatctcccatcaccaagggccatctgtctttcatcttttcatatgttaaagttccatgaactatttcttctctgaagtagtcatccactaattcattgattcactgtgaatcatgaataagatcatgatcactcaggaaccctctaggtctagcattccgtgattcttcggttagtgctcacgcttctggaatgaaaagtacaaaggtacaggggcagcagctggagatgacagcacagtctgttgccatgtgtagttcatggcgcagggtcagggcagaaactccttaatattaaacttagtgtacagtaactctaatgcctgatatttgatttgcattaagcactgacaagaacctttcatgtctatttctgccctggggtcctaaaacataaattttaacattccttgcttctccttgatgatcattcccacatagaaatggaactgcattaataatgattgttgaaaaaatgaataaatgattgttgaatgaataaccgaatgaatgccaccagggaaaattattgtctccatttcattttagggcctgaactttaggagaataaagttatcctaaagagagctgttggaacctgcctttctaaccagcttcctattttctagaaaaggggtcactgtttgtaggaattgtctaggattcctgagaactgccatcaaacattcattttgcttttcctattgctaagcattatcagacagagacacagcttctacacaaaggaagatggtagggcattgtctgttcagggctgctagatcaatattatagttttatttatctattaatttatttggatttctaagcagctctaccttttgttacgatgattatatggcaaaatgcaaaacaacttgacaggactttgctatctagacttttgataatgatctctaaaagccaactcatttcatttgcgtccttttatgaataatacaaaaaaatccaaaccttaactagtgtttgtcacagtcagtgggtacttcatgagccaagagtgcatagaaaggtatttttggttcattactaggtttctataattgacctgacattttgtgagagcaatcatgtttgttaaggagaaactcaagccaatgctgtagttgcaaagttctccttactattaccctgggaaacaaattcatcagaagtgtgcagatgtgttttatgtgtgcgtacacacatacatccctatgcatacacaagcatgtacacacattggcatgggtcgacctgataaaatatatgcagtgttctctttgtccaaatccagctggtcatctagggactgtatagaaaatttgccagtgcctgcagccctactccatgtttccctttttctctgcagcttgagcctcaccttaaggcctaagtgagatatgcattctgtcccaaatgatggctcatggggacagaacatttctgagtcttcctttctgaccctctagttatatggcagtgattgcactgagggaaaaccaggaaataacaaaggaaactgcttaagcaagttgtgtttgggaagattagaaaagggagtgcacaggaggatgaagctgaagtctctgaggaggtaatcttgttcaaataatagcttttcttgtaaccatattttgtcaaattggttatttctgatgatgtatccccaattttctgaaatgttttaaaacttacattgtagctttctctcatttccttattcctatgttctcattctggtccatcatctgttcatttattcagtccattctttgtgtattcattcaattattctttcaagtgacatttactgataattaaaactgttaaaatcactgacgtcaaggtctatgagcaaaactgaaccaaaccaaaacaagaactaaactagaatccgttgtggcgggattgaccactaggtggtatgtccattctttggccttactggggatttaggcatttgttttggttatgtgccttgttaaatattcatcatgtcaaaatggtggtagtaacatgaacacaatcaagaaaatatgaagagagtgatataaattatatttggagctcagagaggggccaggaagactttacatgttggattgcttctgccttaggcagaaaagaagttgcagagcgttctaggaggagtgaaatacttgagtaggggctgggaagcaataaagcaagtggtattttcaagtttatgcatccacaagatcagtgttcaatatttaaaatgttcaatgtgtaaactctatcatggaaagatttttgaggaagtagcttgtaaaaagttgcatatttctatttgttgctagggttacctaaccaacaggttcttggctaagcaaaaaactacagtctgtaaattagatattctggaataaaaaatttggggaaagaggaaaaggactcatgctcccaagaaggccaagtgaaaagtgatatccttctgatagggaaagaagtcatgagtcattagtctggactgctatagtaatgataataatagtaagaataataatagccaccatttgtggatcacttactgcaaaccaggaactgtgttaaatccttctcatgtgcaagctgctcctttaacctgcgtggcaacccggggtgactagctgttagtatagcagttccttgcccaagtttctcagtatctttcagcctcagtttcctgttgggcaaaatagagattacgggacagtgggaacattaaatgaggctatgcttgttatgtggttagcatggtgtcaagcagggagtaacaggtcagtgagaattatagtattagctactattagcatttctccttcctcgttagtatttttccttccctgaggaggaaacagagaattaggaggaccaagctgaatataagcagtacctgagagcattcttggaagattatgctttcgtgagctcctcttagaactgaaaattgatgatgagagagacagactgtcaccaatgcatgactatcaccttgtcattattaaagcactttccactagtttatattattttattctcataagctctgtgagggccaggatttgggtcttctcttgtcccttgctacatcctcatctatatcagtggctggcacattatctttgttgacgactgacctttccttttcctctttctttgcctggcaaactgttacttgcccatcaggatccatggggacattgacgctcctccatcactctcacctccagtcctctcttcccacacaactcttagttcatacagtggtcacagtacctccatgctgtattgtatcctatctactctcctgtttgtctcttgctgcagactcctctaaggcagggaccacttttcaccacctttccatgcccctggatccttgttcagatttggcttgatgtacgcactttgaagatacttgaatgagtgaccacaaatatcttcatttgcatctgaacaattttcttgatatttgaacttcttacccaaacccccaagtccaaaggcccttgtcttgagcttacaggttttcaaagaatgctttacctgggtatagggcagctctcacatgcctgggaggaagccttggagcaaaaacaaatcgatggctctgaaagaattatgtcaacatttaattgcaagagatagctgctctgcccagagggcttccggaacaccttagcttttggtttaaagctcaattttaggtaactgatcaggtagaagctagtttgactaccgcagcttgcaaatgcaagctttggtaataacgccatagctttttttttgttttttttttttttggggacagagtctctctctgtctccaggctggagcgcagtggtgcgatcttggttcactgcaacctctgcagcggattcaagcgattatcctggctcagctttcggagtagctgggactataggcgtgtgccaccacgcccagctaggccagctaatttttgtatttttagtagagacagagtttcaccacgttacacaagatggtctcgatttcttgacctcgtgatccgcccgcctcggcctcccaaagtgctgagattacaggcgtgagtcaccgcacctggccgccacagcttcttaaaatgtcactatcaatccattctgaggctagaaatctctctggcaagtgtgtgaatgcaaaggtaatggctttacctttcaggttagttgtagataatctcatctttgttcatgaccggtgagtgccaagcccccagcattgagtatgtagtctccaagggacattttccttggaccaattgggaaaagacctggtcaaaattgaggaatgggcaatactcacctggtattttgagctataatttggttctttgagctatgagaaaaaaaagggacacgggctatgttgaagtaacaggaatttgagaagtaagggtgatgagaatctcagaaaacttgcaacagctggacatccaggtctcctggaaatgggaagttgattgaggaactggagggaaagttaaggtcctaactttagtgattgggtttctgtgtcaccaccttggcccaggagactgttgatacccccccccctttgctttgtctccccatttcttttagtgtctctttccagctgagcagtcttctgactcccactagttcaagtttctgagggagaagctgattgagcggagctgtgcattagacagcttatagatgggtgctcttaggtcacatgttcccagtgagccaatcagcagcctctagaggagaggtcacgcggcacagaatatggccgcctatgcttaaggcattacagagggcatcttcctctggaggggtagtaaatgtaggcactttcttctaaatgggctatgggtgtaacaggcattaggctgcttctattttatcagaggatggggccatgattagcccaatgaacatttactaatcattgaaatttaagcatggcagcctggtgtgtaaccattgtttgagttagcatacttcagttttcccctgttgatttagtctcatgtaaatctctgaagcctcggccagtcttttcttaaatacacgtaacagctaccataattctctttctgctagtcctttggtccacctaagttcacctagtcaaggtagacagtctgcagccactatccttcttcactttctaagggctttctcagcattgggggcttattaagcagcaagcaagtcagtcctgtaaatgtggggaagctggctccctggggtctctcttaactgttgagagtcagtggataaatggcccggcttcctgtgagacaattgtgagtcaggttccacacagctccttagagtgtccccactgggagtgagcagaaacctgatttttaatataaactttatttgtgtatctcccttctctgcctcatttttcacacctcctcacttgtacttcccaaatatattctctgctccaaaatccttgcctcaggctttgcttttgggattattcaaactgagacaataaaatactacacccattttagggaagatcaggagctaacagtgtagggaccaatgcattatggtcttcatctaaatgaagtctgtttctaatatactgaatgtttctgtaaggcaaaaactcataggtaattggttaaataggggattgtatattaatatgtagtaatatatacatatatgtatatgtataatataacatgaatataatatacatatgtatacacatatataatatatatgtataatataacataaaaatgactttggtccatatgcagtattccatagaaaattgatattttgccttaacaagaagcggcaattaaaggaatgtatactaatatagctgaatgcagcacacctcaaaagaatagagaatggtctatagaattcaaataggttctgcctcttgactcacttgccaaatcctctgtcttagaagtgcttattgagtaattctcccctatcctgacgcactgcgcctctgttgccataattcagcagattcaccctttccttataacccgtctaccaagccccaatccacattttttaaagggaaagccttatatttactgtaagttttcatttatcaacaatttatgtcttctcaaacacaccaggtttaaaaattatgattataattattatttgcaataattatgtgattacaaagttgcaaagatctggagcattctactctaatcttgtcttttccaaaatccttatgattttattgcacaattttcctaagcatagagtttttctggaacacaaatattttccagaacacctatttcagggctgctccacacataggcatatctgtgccagttagacataagcacccggctcattgcgggtacttactgagggggtagaaggaacatagtaccgcccccgcaaaaatgcaattagcctgttatcaaaataacagggagagatgaattcttatctttttgctggaaggtcggaagaggcattgggcttaggaagtggccacatcatagtcatttgatacactgtcatttgcatctagtgtaaaattcaccattgtttatcttatgattttatgagtagagaccaactgaaaaattttgtacttttattaatattatggcattacaacaccttactttaggagattcatagtttggaccctgtttacaaaaatgtaccagttatatggtatttattgagtgtctttactgcatactaggaatcatacaagagggaaacagaagttatttctatatgactctgatagcacctgtatttgtcccttttgtgttgctataaaggaatacctgaggccgcgtaatatttacagaaacgaggtttatttggcttacggttctgcaggctgtacaagaagcatggtgccagcatctgtttctggtgagggcctcaggcagtttacaatcatggtgtaaggtgaagggggagcaggcatgtcacatggtgagagagagagcaagagagaggaggaagtgccaggcccttttcaacaatcagatcttgcagtaactaatagagggagaactcactcatgatcgcagggttggcaggaagccattcaggagggatctacccccataagccaaatatctcccaccagcctccacctccaactctggggttcacatttctttctttctttttttttttttttttttttttttttttggagtctcactctgtcacccagactggagtgcagtggcatgatcttagctcactgcaacctctgccttccaggttcaagtgaatctcctgcctcatcctcccaagtaactgggagtacaggcatgtgctaccacacctggccaatttttgtatttttgacggggtttcaccatattggccaggctggtcttgaactcctgacctcaggtgatctgccctcctcggcctcccaaagtgctgggattacagacgtgagccgccatgcccggcacatttcaacacatgagatttggaggtgacaaatatccaaatcatgtcacaaccagtaggataaatactacttatttttcattcctcagatgagaacatttagtcacagagtgtggggcagccagccaacttctgatgttcagagtcagtgctgtctaaacttagctttcatgttctttctacctcagaaggctacttctcaatcaattatttgggatcagttggtttcatcacatggcattgcatcatgaatatgctgaacaaggccaagggaaggcaacaattaactggcagtttgtaggcttgtgattagatataattaaaagtcacataaagttccaaaaaatatttttcacttgtttcatatctcaacaacttccacttgtttaagttagtgtttttccaagttgcattgtgatgaggagaatttgacatatttttgagggctaagagtgagaatgattcaaagctgtgagatttgaagtgatgtctaaaagatttttttatcatgacttatgattttttatacacacacacagacacatacacacacatcctagtaggaaaaatatcaaaatataataactttagataataagaaaaatggtttctgtttacactgagttttcacaggtgagatatgcattaaaggcacaaaagctaaaagacaaagagaaatggcaatttaagcacttgaaagccttgctgaattttttacagactgtgtcaagtggagctggaaagtgaaaccacaaatcggaagctagaaaggaagcagctaggcaagagagagtaccttggactgctggctgcagtccccttcttttcccccaagtgacctgcacatcggacttcaccctgctactctctcttcccaaagatgaaatgaagaggttgaatgtaatgattactaagattctctttctgctcccacgatgatctgatgctgaggatttttaagacttctgtgccgttagaattgattacttctaaattgttatctactattcataaaaagaaaattattcaagcttgtacttcttggcacaaaatatacctgtgattttctaaaatattatctcttaatgcacaaagttctcaagtgctgtagctaaagggagctaccacagagtattaatagaaaatgtatgtgagaggatgttatttaataaacccctaagtcagtaattctaatgattcaaaatgactttaactttctactaattagaagccagactctcagctttgcttcttgatctgcacttctccccatcttggtgttcttggtgatggtcatgttcctggctgggtcactgcttccatgactgtttattaaaatcccctggccaaacagtgggcgtactggacttcctggaggggttccctggaatgccttgagcaaaacttgggtgccaaaagcaaagacctgctgtgttggagaaagaggaagagaagagttctgctgtctttgcatgtgtttggaaatgtctttctcatcaacagattctcatgcttggggatgccaggggtggtttgggtgggcactctcttcattaatagccattattgtggagtccttaaagtggattaatgatgttttttaggaaagataattatctcctatgctttccgggaggtacatgaactgctctaagattgcaagtacaaaacaggacattcgtggtgctactgtgtgaaaaaataaccagcagtaccttgacatttatagattttatataagcatgtgagtatggaccttgggcctcaccagccccagaacaccccaggcgtccttgtaccgcagggcctttgtatgtgctgctcttgctgcttgacctgccccacccagtatctgtaagccttgctctttctttcaattagaatctttacttaaacatcctctttttgcacaggttaccctacataaatcaacgtgcctcctgtctcctatcactctctgtccctttatcctgctttgctttttcttcacagcacttatttcctgacacagtaaatcatttataagttgcttattttccacctcctcctctggaatacatgctctgtgaatacaggctctctgcttgtcttggtctctgtttaattcctaatcctggcagagcacctgtgacatagtgaacactcaacaactgtttgctgaatgaaagaaaaaatgaaaaggttcacatggagatgagagccactggccaacaatttcagtcaaaacatattatttacttaaaaatgcaatgtctgcatatatttgacaatgataatttattgaaaacaacaacagtgaatacatgagttgatatctgtcttttcaatagatatataatgagcctctggattttatttttatttttattactcacgtattttttgaaacagagtctcactattatcacccaggctggagcacagtgtgcgatcacagctcactgcagcctcctctgcccaggctcaggtgatcctcccacctcagcctccccagtagctgggactataggtgcacaccaccacgcccaggtaattttttgtagatagggttttgccatgttgtccaagctggtcttgaactcctgggctcaagcaatccatcttccttggcctccaaaagtgctgggattacgggtgtgagccactgtgcctggccatccctggatttgaaaaggaaaggggtagagtgacaaggactggttgcatctcacattccaaactgcttgttttagtatgcgctaatgcatcaaccttttattactgcccagaccgtagacctggcttgttccttttcacatgttattctcaccagaagctacaaagtaggtgttatttgtattattattgctgttgttgttgttagaatacatattcctcatttacagacaagtacacaggctaagcatgactgcaacttttgaattgtcatgcagctcagaactgggggatctagaaactgaattcagcagctgattatttggttcccaataccatggtcttgctacttacctactagaaaggattctcatttgtctatttaagttcttctcctctactctctgaggaggattctttcagctcttagtgaaataaaactagaaatggaaagggaagtctcaaatctatgttcagaagagggaagaggtttaacctgggggtgggagggaagcagatagatgtgctagcagagcaagcagtttgagatctaatatacagccttagtgggattaaaaatatgaggtataatttgtgttcatttattctacagatgtattttgagaacatagtgaaggcatgatgcctggcccacagtaggtgctcaataaacgtgtgttgaataatacatgaaggacacgaataaatgtgtgttgaataatgaatgaaagacacaaattcaggaggtaattttgtttgctggtttgtgtccctttatctctttatcttgtgatgtggaaccacactcacagagtcccttcatcttcattcatttcattcattcttttttttttttttttgagatggagtttcactcttgtcatccagtctggagtgcaatgttgtaatcttggctcactgaaacctctgcctcccaggttcaagcgattctcctgcctcagcctcccgagtagctgaaactacagacgtgtgccactatgcctggctaatttcttgtatttttagtagaaacagggtttcaccatgttggccaggcaggtctcaaactcctgacctcagatgatctgcctaccttggcctcccaaagtgcactgccttcattcattcttaaatcattcatttctttgtggaagccccttagctccatgtagtttatggatgtgtcagaacaaactgaatattgtttattcttttactttttaaagagatgagtatttgagtcctctgattcacagtgaatttcagaattctatcagctaaatacctcttgaagctccgattaccaagactataagcccttctacagcattaagggattgctcgtaaagatactgctattatgcatctggtgtaaagcctcctcatctttagctcaattcaacaagtttccattcagtgcccagctctaaaagtcttaaatggaaattgattccctactccttctattttaactgtcaaaatcatagactgcattgtttccaactgaaaatccgctgacagctccccaccaaccaccccgtgagccttcctagggctggcgttgatgatgctgctatcaatggggaatctacattgtgcacgggtatttatgatgagaaaatcatgtggcataaaagagaataattgccttcataagtgtataattttttatactataagcttctcaatgaaaaagcattctaagggaggcataattgctaattttcggtgttaaacatacctctgaagagtatttcacagtctaactctctgagtgtcatgtcttcctgtggcccggggaagagagtgggaaggaaataaaatttcattgagcatctacataggaccaggccctgtaagttcttggatattggtttcttcttataatgacttgagaattacatggaattatccccattatatgagaagacagagtctcacaggagttaaatcacttctcataaaatcatctctcatagttatgtgagttcagaatgcacgtctatgctaccccaaagtccaagcttaatagagaaatctacagcaactctttatattctggagaggttttattactaagcttaagaattgaggtgccctaagaacgggctgcccccaaaatattttcctcaccacctcacttctgtttccagaagcccaacatgaaaatcactcttctgaaataagtcctggagtcttctttaggcttctgctaaaaagtcttattcgtgagatgtctagcgtaacttctttttttaagtcaaggaaaatgtgtagaatttaggtcaagatgcactgagaataatttgcaaaacccgtaaatccgtagctgatatatttaacaccaggtccaaactgtttctgaaggattgaatctcttgcctgaatactgaagaaaatggaggcatgatctgaggttggggaatattctaccttgccaaggataactgtagagtattgtgacaaagtgcaaagatgccacatggattctggatcagtcagacctgggttggaatcctgattctgccagtacacctttctgcctggttagcttggaacaaagcagttaatctattgagcttcattatctctctcctgaggctcttgtgaggactaaatgagacaatacctaatgcttcatacagagacagtggtcactctatcataataataggagccctcattgtttatgtctttaccatatatcattatccaatatattcctttatatcattatccaaataaatacatctgatcaaatcccccaaattgctttcttctcagcattcctcggtgcaaaatatgagatgtcctttgactatataatataaaatatactataacatataatattgaccttatattgaagatgtatttgtacccgacatacaatatttttagaaataatgtttcattataaaattttttacacgtacagaaaagtttaattttgcagtgagcactcatgtacccaccacctagattctaccgttaccatttaatccacgcattttaccacctatctttccttctgtgtgtctcccgtccatccactaatctacctcatgttttcgattggacacatttcaaaataaattgtagatatgctctccctctaaatacttcagcatgcatatttttcagtagagttcaatatttgcttacatattgtttctcttttgatgtaaaatttacacacagtgaaatgcataaatcttaagtgtgtattctgagttctaacaaatacacacatctgtgtaacccaaagcattgccaaaatgcagaattactgcagaaagttccctcaagcctcttccgagtcaattctgactcctaccacagcaaaagtaaccattgctctgattgttttctatcttggattagttttatctgttctagaacttgatataaatagaatcatgcagcacatactcttttatgtaaggcttccttgactcaacatgttgtttttaggatccttgcatgttgttgcaccgatgtgctttctgaatcgggaaaaacaaatatttttgtgtttgtagaagtctagcttaccctgatgccagatttaaattccctgtgccaaacacattgtgtgctcctggtccctgccccctttaacttccccagcatagtgcctttgttcatgttctttctttccatcactccctggactctggctgttcatattctgcccttcctctggagatcagctccaatcccaaacttttccaaagtctgcattgactcccttgggtttctgcctgagctctctctcctttggacactggactgccatcccattaactgttgatgttgtcatcagtgatcagctcctggtcataaactaaggaagagttaggtgggagcactggcactgagggtccatgtgctcacttagctttccagggaggggctagaccacaggtactcttcaccccacgagccaaaaggagtggatctagagtgaccattgcaaggcctcaaagagaaacgaagagtgaggagtgatggggaaagagccaaggggaccatccctgagtcatgggcgtgccttgggttgaggctaaaggttcaagagggaggagtaaagaagggaaggaaactgtcaggagtgattgctgtcatgtggaagaagcctaaacatgaagtcatgagagacgcaccttgtggctggtgggaatgctacacaatcatgcaacatgtgcctaattttctcaactaaattgcaagctgatgtcttactattgacaggaataaagtttcataaggtgttccctgcagtggcctgactgtgcaaggtgctgatagatacctgctagttgataatgatgcctctcacatggccagtcattttagcaattagtttcattgatattgtgggactgggcttattggagatttgactgaattgaccatttcagccactacagcctttgcagaatttgtgtctgtcaacctggccttcccaaggaaatggaggttaggcaataaggaatgtgttcattttattgccattttactaccacagcatggtagattccagctattaatcctcatggtataaggtgctttttatatcttcaaaaatagggtatagccttgatctctcttcttgctgctctggaattaaaatagaaatctttatccctatctcaaaatctttggggcaggttaggagagctgggcttcaggatcatccagcctagtgcttaggtctgtttacagctcagcaacatttccattggttgagggatattgttcagcagccactgaacatcaggctctgacctcttgtttctttgctgtctaacccagcagaccatcctcggttaatacttactctgattcagcctagcaaagaagatcagaagcaattctgtgtccgcaggctccctttcacacctttaatattttgtattttgcaaacattttgagttagttagcaggtctcttgctttctcttgagggctgggcacaaatgttcaagaataatcattgtaatggcatctctctgattaaaaagacagctggcaagattgagatagaacatcaaattctgaaacatcattagcaggattctattttggttaggtataatcttctgtgaggtcatcatgttgtcttcgatgagtctaaccattttatatcatttagatctaaacagacccatcatgtcacaggcaaatggctttatcatatttaattaacccaacaccatgtaataatctccctggtaattatccctcactagtgcttgaaagcgtgctgcaacaaataaatcatcaaagttgcaggtatacttaaactgttatttggtgccgtggcagaagaatattgacaagtcacagtgcaatcctaattatactaagaaaatgtaaatggcttcatcaaaaaaagaaagagccagatggcaggttttatatactgtatcctcctgtgttagaaaatggggtattaaaaaggcttcatgccctcagcatcagggaagaagaagaaataaaggctgatacctctgtctttatggaggccacgttgaacctctaattctggagaatggtaacattgaagaggacattagtggccattgacgtttatgtctcctgatgccaccctacatataagtgaatgaatattaccaggatgaatgctacttttcttatgataggaattgattgaggaggataggagcaattccatgatgccctagattttactttatgtttgcaaatgacaaattattcacagaaagacatgtgcccaccaggtggtgaatcaatgtgtttccattgacctggcttttctaatgcatcagcaagaacacatttaccggaatgcattgcaattaaaaagcaaaattcagttggaaacaatggacttaaacctacgaaatgtgacaggataagtcagagaggaaatttgatttcaatggtgagattaacgagcccatgaatgcatggtgcatacggcacagacaaagataactgaattggattttcaataagcatagagttctagatttccctgttcttgaattgtgtaccgtaccacccagctgctgtccccagctaattttgccagagctggatgtcagccaaagcacaactgtctatggcttgggaagttctcctttgagtcagattatttagttagctcaggctggtaactgccacagaacctggctgtgatttggtcttattagaaaacaaatttggaaagtattagagaatagtgttcgaatagtaatgttttcccttgctttccttaatatttcctttgtgtgagtgtgtgtttttgtgcacattgcactgttgttacccaaccaatcagaaattctgtttattataaaagtaattctccttaattagagaaaatttggaacgtaaaaaaggaaaaggaagaaaattgctcaaagtttgcagtccaattataatggttcttgaccgtttagttatttagtctttttcctttatgcatacattttgaaattgttggtttagtttttttatagtttgactcatcaaaaatcatatattcactatcctgcttaaaaaatcatcataagtttaatctatatagttacatattcaatcattatgctttgagttatattgacattccatagacagatgtcatttcatgatttttaagcagtcaattttcaattactgcataatattcttccatttggagatacatattttagttcagtattattgtggcacacttattttctatatttcctttttttctggagacagagtctcagtctgttgcccaagctggagtgcagtggcgtgatctcggctcactgcaacctccgcctcccaagttcaagcaattcgcctgcctcagcctcccgagtagctgggactaaaagcgcacactgccatgcccggctaatgttttgtattttagtagagatggggtttcaccacattgcccaggctggtcttgaactactaagctctgagctcaggcaatccccccgcttcggcctcccaaagtgctaggattacagccgtgagccaacacacctggcccaatagttccaattttttatgtgtatatttttaaaaaattaagttgtgactttagcgtgaattgaaatttgtttgactatacttcataaacccttttatattgttttataattttttgcaaacataatttttaacaatgcataacttgtttatcacaagtcagacccagaatatttagctcttcctttgtgttcattcactgaaatcaaggtgctttccagttttttacaatgataaataatactttgacttatcaattaattaaaatgtgttatatgtcaattatatacagagcactgggctaaactggttatctgtgtacataaactttccaagtttgggattgtctgcttagaaaggatatattaaattggtaccattggacccaatatgactggtgtttgtaagggtctaggtagaggctgcttgatagcatttgtaaagggcaattaatctattctgccgtcagcattacagctcgcttcaccacacctgtgcactcaacgactcttcctccccgaaagtggagacagtgaggcaaaggacatggagaaacggaggctcggagagtttcagtaactttccccagtccaccagcttgtatcggaattgggatttgagctcaggtctgtccagctttagaatgcaaactcttaagtgctgccttaagtttgcttccccagaagaaggtcctgggatgagaatttgtgttaaagtgatgtatcggaaaggttgctaggaaaaacgtatagggaagtgggaactgagtttggcaagagggagactgagcaagggtgtcatctcaagcgaagttccattgagataactttggcctcatcttccagggagactgggaatgatgtgatttgcacttcagtgctggcccctttggggcaaggcaacttgagtatttataactcttgacccacaagtccttggttaaaggctgctgggatagtgggcaggcaggggcacaagttgtcagatgcttctgtacttcatgtgttacagacaaagcagatccactagatgcagccttttggaaaaagacacagatgcccttgatgtgctggtgtcggttagcaatggcttggaagagctggatgttaaattgttaggaattttgcaatctggttgaccccactgacagcttgaaatcagccatggtgagagtatctacaccatggaaattggccaacattacaaattagggctcccttccctccacccagaagtgttcagtaaatatttactggcatactaccggagctgctggcctttgggaatggaagcatactgggggtccgtgtgcactaaaatggcaaagaaaatctaggggatgtggatggtgcagggacagcatctactgcagcactcatgtataccagctgcaatatggtaggaaacctgcccctgcccacacaggctaggcagaggtgtgtgagaaaaagggaactggtgagagggaggggaacatgctggatttcagagcaaggtctctcaacctgaggtggcctgggtatgagacatgctacgcagaaaaaaacctagaaataactgagattaaaatagctaactaagctactgaatacttgcactgccaggcactgagctagatgctttactttggctaatcttcataggagccctaggaggtagatttcatcatcatcatcctcactctaactattattatcatctttgtcatccttcttctacagatgataaaattgagatttagagaagtaaagtaatatgtctaacatcatagtgggatggctgagctctgaacccattcaatctgactccaaatgcaaagattgaataactttgacagaataggtcccacttcctatggactgagtacacatggttgtgggggcataggttgcttcagtggccatcaggatgacctgggagtaacctaattttacgtgattataggcttaaccatctggttatcaggaaaaaaaaccatgtagagagcgcacgagagcccagaatcagtagctgggcctcctggtgtggaaaggatagaactcaaatctcatcgagggatggaagtctggatacactcctttcatctctcagaatcagctccaggctggcccaaaacaaatgatacagaggctgagaaaggcagagcaaacctgggacatggggctgagccagcagaatcattagcagtcaggctgtgtgaatttttttgtggtaagagagataaatgtccctcttgttctttgtggtttcctttgccataagagccactgctttgtgaaagttcttctttcctttctctggcttgcccatccctggattgatgtagtagccagcagcaaggacatatgaagggtctggaagtggaaggctgccacccctgccctgctcccacttctgggcccccagggatcccctgacataaacagtcctgcaggaggaaataataggtggacttgtccctgtgacacagtggaggtaggtctggaagtttcctttgaacattaggtaggtctcagctttgtatttcaggtgcttttatcatgtgttttatcctgtaacagtacattctagagctacctttcaagtgtcatcaatctccaattcattttatattttcctctatgtatgtacatttgtatgtatgtgtgttcagttaccattatgaagtaactgacctgaagcaaactgaaaataaatcttgccttatgttgccaacattgcatttttttttctttttcttaatttatctgtgaatattgtttttcttcttcttcttctttttttttttaaatggagtttcacactgtcacccaggctggagtgcaattgcgcgatctcagctcactgcaacctccgcctcccgggttcaagcaattctcctgcttcagcctcccaagtagctgggattacagccacccaccaccacccctggctgattttttgtgtttttgggagagacagggtttcactatgttggccaggctggtctcaatctcctgacctcgtgatccacctgccttggcctcccaaagtgctgggactacaggagtaagacaccgtgcccggccagtattgttcttctttatacctaattactcatcattggaattctctttaaaaaaaaaatgtgcttccctaattggttgccaacagagaggctacatcatagtggttaagaatataggctcttttcccttgactgaagcagtgattaaaacaaaaaaataagaaagaatataggctctggtgtcatactgcctgggttggagacccagctcttcaatttacatctgtatgacttcagttcatttttttttttttttcatttctacatggcttggtttccccatctgtaaattgtggatacttacactagctatctcataggttattgtgagaaataagtgagtctgtatgtatgaagcccatagaaatatacataacatagaggaagcactacctagtgtcagggtctaccactgtgtattctttaggaggtttcaatcttgaccttcagaaaaagaattatttcattcaacaagcatttattgaaaatttccttggtgctcatctctgtgccatgtcctttcatatagattttatctgacataacttaattcttaccatcaccctgtgttaaagttatggtgttcattttctagggtttaagttctggaaatgctgtgtgctcactgtatccaccaggataggtgaggctctgctgcattcatgaacagtcacagatctcagagcctgtgagcgggtttaattctccttcatgagaagccccctggtcagggtgtgttcctgcacctggtggggcagcatggtgggctatcccctcctatggctcctctgttaccaaacaagctcttcctatagctgcagctgaggaataaaaatgctggagaatcttggcggttaaatgctttgacttggaaataaaatggatcagttctacctgcagcccaggagcaagattgggttgcagactctacctaatggccctagagactgtaatcctcccacgtgctggaaggagagtagaatagggtatggtgaacaggagatgtctctaccactcacttgggactgtgagcacctgtctatacctcggctgtcttatctgtgaaatgaggatgacagctgtacctactgcatatagttgtgatagagtgaatagataaatgcatgtaaagctcttagcacactatatggcactcagaacatagtcaaaatggggtcactgtaatcatgatatacaagaaagtcagcggagcctcctaatacagtaaagtaaccattgttttgaatagtcacgtgtggatatcaagtccagttatattacttaccagctgtatgtatgagcatggggaagttatttaccttctctgacttttacttttctcttacgtaaaatggtgtgggatcacactcaccccataggctgcatcaagggttaaatcgctaacatttactgacaccttggaaagatgagctaagcgtttaaaacctgttggctcatttatgtctatgtcaatgctatgggaaaggtactctgttatcccccattttatagcagaggaaactaagcctcagagaggttaagtaatgtacccaggcctctctaactgctaagtggtagagcaaaaagtgaaacccaggcattttgtcttctcaattaatgatcttaatacgcattacagcctccctgagatcagttgggtaaagctctgagcacagggccaggcacagtgtacacccttgcaaaaatattaatttgcctgggtgcaaggtgagggacatatccttttcctattctgaaactctactctgcttaggatgcatactgatggctctttttttgtgaatggatggaagtatgaaaggagcagtaagaaagggcactatcaggctgcatgcagtggctcacatctggaatcccagcactttggaaagctgaggccagcagatcacttgaggccaggagttcaagaccagtctggccaatgtggcaaaacactctctctcctaaaaatacaaaaattagctgaggacagtggtgcatgcctataatcccagctacttgggtgggtgaggcatgagaatcgcttgaacccaggaggcagaggttgcagtgagccgtgattgtgccactgcattccagcttgggtaacagagcaagactgttgaagaaaggaaggaagggatgaaggaaggaaggaagggattaagggagggagggagggaggagagggaagaaaaagaaggaaggaaggaaagaaggagagaaaagagaaaagaaaagaaaaggcactatctatgccatatgcttttgtgagactatcaaggcctgcatgcaaaaaaacccagtgcagagttggtggtcaattagctggagtgctttattatttttaataatcagccatgcttagtgggagtctctgaatctgtagttatgactgtagtaaatgggacacaaagggagcagctggacataccggcaagtattataatgtgcagacaacctgcaaatatgaaccttcttttcaaataagaatctcagtgctgtcactatttgttttaggaagtgctggttttaactgaatgaggaagttaaacgcatgttctgttttttgttttcattgcgcccacatgggttgactgtgggttcggttttctctccagattgaacacttagtacttaatgggggaaccaccttggaaaagcagaactgatttgaggtggcttcatccctctcttctcccaccagaaagagatgggagcttccacttcaacctggggtgaagacagagaacaaggtgtcccagcattttgcacagaaccaaagccctggaaattctggtggaagctagacattcagagtcatcaagctaacagtcacttcctgctatgtgccagatactatgcttttcacagacatctcatttacatttcccagaacatcaggttggagtgcagtgacgtgatgcaatcatagtttcctgcagccttgaacttctgagttcaaatgatccttctgcctcagcctcccaggtagctaggactacagacatacactaccacacctggctgagtttgtttgtttgtttgtgtgtttgtttgtttattttgtagcaatagcatttcactgtgttacccagagtggtctccaactcctggcctcaagcaatcctctcgcctccactttccaaagtgctaggattacaggcacgagccactgtgcccaaaagttaagattcttgtagctgctttatagaagatgaactgaggatcaagaaggtgagacttgatgtgagtcagatagtgaatatgctatagaaaactaaacccagttcctttggggacttggaatttggcatcaatattgtcaccgggctttaattttgcttaactccacactgtggtctttgtgaatggtgcctccaagagttgtgcccctgggtgggcctgagctgaaacatcaggtagatgcaataggccttgtcttttgtgacagttctgtaccatcgtctataatatatctgtattagtaatctatggttatacaacaaatcaccccaaaacttagcagcttaaaaccatatttattattccacaatttctgtgcagcaagaatatgggtgcagcttagctgggtctttgggccataatcaaggctaaaatcaaggtgtcaactgaggcagcagtcatcctaagacttgactgggcatgggttggctcctgagctcattcatgggattgctggcaggattctgctttttcaggctgctggactgagggctttgcttccttgctggctattggatggaagaaccctttaattccttgccttttggacagctccagagggaagctcacaacaggacaacttgattcgtcagagaaaataggtgagaagagccagaaagccagagggccaagaaaacagaagccacagtttttgataacagtcatagaagagatgccctgacacttttgttgccttctatgctttagaagcgagtcagtaagtccaccccaccctcagtggaggggattacacaaggacatgcatatgaggaggcagggttcactgggagccagccactgcctactacaagaaccgtgattattttaacgcaaaatgatgggtcaaattccttttattgggtagaattgtccctccagaaaaatctcttttgtcttgaatattcatgcatgctctggtacctctctttctgtgataaggacgttccagtttgaaaaacctgagtttattagtcaaattgtgctggtgtagaaatattccctctctttcaaataactttgcatccacctgctttgactcatgatgttgaatctaattttattacagagttttggatggtgggggcatttccacgttgctgctatgtactttctatacaaataagtgttgacctttgaagtagtctccctggaatagaaggttttaaactcattgatgatgcaaactttgcttaagaccttgttgtagcttctctttgggaatggcctttggaatcacgaccagaaaaaaaaaaaaaaaaaaaaaaaggtctgctttatctattctcactacacagcatttattagatatggctgccagggagatatctccttcctcactgattgttattctatgcattttcttcctaaaactagtagatttgaactcatacctatctagagccctcattatgaacaacagctttaaagcacgcaaggcactaggaacccctatttaatcatttacagaaaaaacatggcaaagaccaccacctccttccttaattccatggtggatttaaaatgcttagattagctgagtcttaggaactgaagtatccttggtgtttcatttgtgataattttaaatacaagtgttggtctgaagaaaggaaatgatcaggaattagccctggagcctgctgtgtatattaaatcaatctcagatggaagaattgagatcccggaaagcaaagaaatggctggacttagagaggaaagataatctagaagtgtaaagttagggtgggagggagaagggtaaagcttgagtaatgagtccactgaaaactattttttaaatgtaataaatacgtaagtagcagttactgtatgctagatatccttctaagtgcttgacaaatttactccttagaagctaagtactattttccccattttctagatgagaaaaccgaggtgtagggaagttgagggacatgtccaagatcacacagatagtaggcagtccagcttcagaatctgtggtctctaccagtgcactttgccacttcacagaactatccagccagaaagagcagaggccgctttgagaatttctgtgcaggtccaagcgtccacttaaatcagggctcctaacacagcagttctccaatgtcctgtagaaaacattcttgttcccttgggacaagagaaatctgaactcagttgtgcaaaaaagagggtctgggaatgaaccaagagggatggtcagtggctccaaggggcggagcgggagaaggcaaaggagaggggccaggagagaatgccaggaaaaaccagaagaaagatttaaacaaacctcataatttacctgtaaccgacagctctccttggatagtttatctgggcactctattccaccagaaccagattgttggagttgtttcaacagaggaatgcagagcttaagtgtgtctgtgctgtgtgaatatacctttgtgtatctgtgtagcaggtagtggtagaaagattttggaagtcgagggagatgactgaagtagagggaaaggtgggaggtcatggctctcatagtattttgtcacgaggtaactttgacaacccctgagaatcgatcagtcccccaagaagtcaaatacatctgcacatgtgtatcatgttactgcatcttaccttgacaggcgcactttaggggatgcagtctctgcccttttgtgccaggagcaaatccattttgcccatgatttcaggtacacaggtgatttcgccaaacaaaacaagcacagctgaaatctgtgacttaaatcaagcaacggtgtctgcaatagtctcattgcagagacttctgctcccttgttgcttgtaggaatgggggtggggaaaggtcaggactatatatttaagaaaaaaaccccacatatgtcgacccacaagtggttacaacaacattggtttacttgaaagctctgtctccactctccctacaaaaattcaagtaagaacctggaatgcaaggaggtggaagagttttctctccttgccaatctctcccttgctctctgataaaaggtgcggcaaacagggtagaaatgactgcacgggaccagaggatgtaaatattcagtcatgacagtccccataggataaatgacagcagcccatgcaatgtgccttctgcacattttcaactgactcttcccctctgcagccaagttgacatattagtaaattgattccaggtgatgctgacattttgtaattatcactatctataattttcatcttatcccatttaatattttgatcatttaaaatagagtagcatacctaatagtggtcattagtttagctcaagggaagattcatggtttaataaacttacattagaaataacttactaaaattacaattggcatgattagctacttttttaaataaaacataacagagtgactttacccatgctgacagcttttttctttcacgctggttcattgttctattgttgtcttggaggaagaaaagacatgtataacacagaagttgtaataaaaactgtaataacccgatacacaaaaacaagggttatatttcattctacatttgacagtagctgagtagtgtactttttcttgttttctgactggactggagggaggaaatcactgtgactttgaatcagggtcacatttggggtagctgtcctcttctcctgctgtctggagagactgtgaggttgcctgaaaggcagtgggatttaggcttgacttccttatttccctaggcattgattttttttaagtgtatcttctgaagtttgcctctaggttcacttgaggtatcatttctgaagaataaaagtggcagttttaatatgcaggcaattttttaaaacaatgaaatagagatgtgattattgccagggcaaggctgtttagttgccacagggaaacattataccaattggcctatagcttgaaattacagcattctctatattcgtccagctttagggaaatgcagaccacaagggtcctgcctaccgttctgcttgctggtggttcaggttttgtgaacttatacaagggcttggtatttgaatgctatcttaatgagaataagcttttttgttgtgtacattggcaacttgatggctaaggtcattctccatccatttgtctagctacccacacacctatacatccatctacccatctgtccacccactcacccatctattcacctatccatccacccagctatttatctatcatccatccatccacccacctacccacttattcaccaatccacctattaatctatccatctacccatccattcagctattcatctacctatcagtccatctatctattcaacctttcacatatccacccacttacctcccctctcatccatcaatatagccttgtatccatccacgtaaccactcatccttaaacaaaaatcagttggcaaaactgtaagcattggtaataaagagacatataagtcgcagttctgtccttaaagagcttaggatctagtacgggagtatatgtaaaccaaaaattacacaacagtgtgctcagtgcacctacagagaactgtgccgtgttgctgtgggaactctaaagaaagaatggtttactgtgtctgaaggattcaaagaaggaggcacacatgtgaacctaaatgtcatatgtggtaaaagaggaagtaaccagccaggggtgaggaacacaacagcaggaaattaagtagctgatgaatattcagacttgaagttcctcctaaagtgcccatttgttgtttggtagaaatatggatatgtaggagggggcctctaccagggtgcagaacatatggtggtattattagggcaccaggcaggagctgaagtaggggctcagaaagccaatcacaagaaccaggattcagggtgggcctgtggttttgaatggaagaaaggagaaaagagtaaacaaatgggctgggcacaatggctcacgcctgtaatcccagcactttgggaggctgaggtgggtggatcacgaggtcaggagttggagaccagcctggccaacatggtgaaactctgtctttactaaaaatacaaacattagccaggcaagtgcctgtaatcctagctactggggaggctgaggcaggagagtcacttgaactcgggaggcggaggttgcagtgagccaagatcgtaccactgcactccagcctgggcgacagtgccagactccatctcaaaaaaaaaaaaaaataataataaacaaatggatgcatgaacaagtgcataataggtagataaatacaccttaggagacagatcaaaatgcagacttgaatttaattggcacagacacttaattatgcatcttgacatctttgaccaaaaacaaaatgccaagaacaaaagcagcttcacgaccaagcacatgctggaatccggccttctgtctgccttactcccgctgctggtgaagctgcaggaatcctgacaggagcaggctgcctttcagctccaagttcctggcactaagttctgcgcaggggcctgggcgaggtctttatgactttccagaggcttccaggtctctattgaaatgcaacagctgttactaggggcaactctacttcccaaacaagaacatagactttgtggagctttcccaggtgctgtgaacccagcattgccaaacaatgcctgggacccacagcgtctccttcccccatggagtttaaatagattggaagcaaatgcttgttgacaacaggtgtggctcaatgtgagcaaacgttccattccgttattgcagggttggcaccgagggacatttcctgtgaaagaaacaggcttccaggagcatgggcaatccatactcatagccagacctgctcagctcctccccttcagggccaaagaccgcaaagctccgtgaacaggtgctcctaataaatgcagagttttccatagcccaagcaaggctagcagggaggggaggggtccctggccacaaagctccaaccagccaactgatcaggctttctgcgatgatggaagtggctgcatcatcattaactcagctagattaacctgttcagcagaagcttgcagagctgcgtgagcctgccttccactcagcttgaattaaagagattgggctgcaaggacacagagaggtgagccccaggaggtggggtcccagtcctgagattagtgacagcagccctgaggatgtagagaaaaacttcttactcctttgaaaaatgtgtgcagtgattcttttcctccctgagctgtcttggagccaaagtaagttcttcacggaactaaatggagttgcttgttcaatgagattctaatttcagtgagaggacttctcggctacatatgtattgctttgggaagtcctcccttccgaggcaagggcttctccacacctaggatttgatgtagaattactagggcagtatgtaaggacagagaaagaacagaggcagcggcaggcttctgacaagggaatactggtaatcaggctctctgcataatttttggagatttggagatggagttagtggagggaaagaaagaaacggatataattagaaaaagaaaaaaatactaatgtcttcacaatacttaatgttagaaattcaatttgtttttttcttctacctccgcaggctctacatgttcctggaggtgtgtgtggctgggcaattatcctttttcactcttgcccagtgcttgttttgaatgcaaatgtattagttcagatgggccaagttgcagtaaaagaaatccacccccaaatttcggtggtttaacagaacagatgttcttatcctgcttacccaacagctctagtgggtgtttcttctatgaagctgctcagaaactcaggctgatgggtgaccctgccattttcaacatctggtcttcaaagtgaccttagacgttgacatccctgtcggccagaatgcagaagtatcacggcgcagcatgtgggagaggttcttatggactgtgcctggaagtggcagacattgtccccatcacttggtcaaatgaccacacctaccagcaagggcaatgaggaaatgtggtccagctgtgtgtgtacaggaagaagggacagcgaatgctctcccccacaccctgctttcagggtttatccttgtcatttattgagggcctgctatgtgccctacattgtcctaggagctgaggatacagctgtccacagaatacccacggtccttgcccacacatggttagaacctagtgagggaagaagaagaattaatacctctttataaaattaattaattacactttggataagggtcataggggaaaacttcagggcaccatgagagctggtaactctctctatggtgaggtgaaggggaagtagaggaggtttctgggaaacagtgacattcaaactggcaaaaagaaagcaaaacagacttaaccaggcagatgcacagcagggtggcattttaggaagtgggaccagcagctgaaaagtccttaggcagaaaataatttcaaacattttagacccttcctccaaagggcagcgaggctgatgcacattgaagaggccagagagcgccttgaaatgagacagaagagctgctccgggctgagatggaagtcatcttcctggactcagacagttagggctactccttagcagtagtgggggcccgctcatgggtgtaagaaagaatgtagcatgatcagctgtgcttgtcaaaaatctgctctgcctgatgaagtctgaaggagggagggtactgcagtctttcaggggagagacgggggcttgcgttcggggctggcagttgaaacggagagacataagatagattgttgaaataggaaggggaagacatgagactctcttatgtctaaatgtctaacatgggttggaaaggctgcccaccagtcccaggtatgcaggcttggcacttggctcatttgaaagagagacaactaagccataactggtttatccttttcctctgcagttttatggccttcttgacttcaggcctatttaataaaatgcagctctttaaaatggatgttcagtggagctcaaattcaccctcaatgtgcacttctgcggactttgattagtatgcataatagagcagcacacctgatgtccgcagcaggcagttctaatgccggtggagagaggtacaagataaatcactccaagtaaatgactaattaatcatgcacttgattttaataacatataccatctggctcaagatttgtctgtctacaatcttgtattccattctagagatttgataatcagtaaaaccacccatggattcctaattgaggacaatttctttcctttcttttagaaaacttaggaatcaaagtgtattccagtaactgcatggaaggggctggagggagaaggttattgttatatataaagtcgcggtaccgcaaaagaaatagcagtcgaatataaaattttatttttaattctcagcaaggcaagttacttctatatagaagggtgcacccttacagatggaactatggtgagcccacatttggacaagagaggggaaggggttcttatccctgatgcacgtggcccctgctactgtgtggttcccctgttggctagggttagaccacacaggctaaactaattccgactggcaaatttaaagagaatgatggagtgagtgctttggcaggagtcaaggcagagcaggtagcaagtaatctgaatgagttagggtgagcaagtgatcagaatgagttagggtggagcaggtgatcagaatgagtcagggtggagtaggtaatggaaaacggttgctttacgaggaagttaagtttagaagtagaaggcaaagaattgcacatactgacatattctttgaaaagaaatttagaagtcatatcttacagttaaggtttgattttttttttaaatcttaaaaccatcatagatatttcaggataatttatgggacaaaatggacactatcccaatgaaaacgtgtaaaatcacttccaaaagtgtctatgccagagggcttacttgcaatgatcctttgatcctccaaatcagaaaacagttttttttttttttttttttccatagtctcatctatgcctttttggtttttcttcttcttttgtgtgtgtgtgtgtgtgttttattatactttaagttctagggtacatgtgcacaatgtgcaggttttttatgtatgtatacatgtgccatgttggtgtgctgcacccgttacctcatcatttacattaggtatatctcctaatgctatccctccccctccccccaccccacaacagggcccagtgtgtgatgttccccaccctgtgtccaagcgttctcattgttcaattcccacctatgagtgagaacatgcggtgtttggttttctgtccttgcaatcgtttgctcagaatgatggtttccagcttcattcatgtccctacaaaggtcatgaactcatccttttctatggctgcatagtattccatggtgtgtatgtgccacatagaaaacagttgtttttaagggtattggacaagggtcatgactgcttagcaaggaagcatcctctacttgtgcatggcttcaaacgcttctaaattaacaggagtatgaaccatctgaggattcacaatttccagtgagtcttggctctacttatttgaaatggatagcttcctaaagtaacatataattcacctataaaatactattttatctcataagacaaaatgagtccatggtcttattatgtaagactgttttccattggggctggtctcaggctaggcaaggtgagtatctgtaggtggaattctcctgagaacagatgctctaaactttttaaataattgatttgacttcttcaccatgtccatgtatacagctgagcatggccaatctactggtttgtattatactgtcaaaaaacaaacaactttccctaacaaaataaacagtatctcaaacagcagcacatatgtcctggggggtaaacagaaaacttgtcccatttgactcatttcattatttggaagaaatttccgtcacagaaggcagatgtcggtggactgataccagatagtagagaaattctgagtgtttactgtgtgcaaaaaaatgctgcattggggggctttaatcagaaatccatgaaaaatagtgtaagtacaatttatcgagcatttattgtatgctagacatatgcatcacctcacttcagaattagcctatgaagtagaattattattgtcctaaatggacaggtgggacctaggttgcccagagaggtgaatgggctttcacagggtttcacaaccagtgggaaaaggctggactcaatcccaaattaggctcattaatcatgctcttgattttaataacaattttgtttgttttttctctagaaaagttacgaattaagttgtattccacggactgtatggaggggggtgaagggaggaagtgtgtgtgtgatctcaaaagccatcatacatctttccggagagtttgaaaataataatctgaaaatccaaaggctgactcacaactcctgggctgtacctacgatacagtaagtaagaggatggtgtcactgtgtcctcccttctgtcctgaagcattccatgctacacaccattcataagatttaaaatcatcttcaagaagtgccctgttggaataataagtcagtgctctctggaggctataaccaaatataatttgccacataaacatgaaatgtgtgtccaagaaactagtaggaatgcatctaggaaccaaagtgtctccttcctagagagagaggaaaaaaacaaagtgaggatggtcctctgcacaggcgttgtatattttgttctcaaatccagcagccttgacttgacatgggatggttgggatggttctccacgtagccacataagctcgttactacccattacatctgcctgtacctccagcaggtgcccaggagatggctgagtcccaagagccatgcaggcctcctggacgaccgccctgatgtggtccacgtgactcttaacaggtatcatggccttggcacatgttgggcattttccagcgtcactctcagaagaccctccctccatgagttcaccactgctggtctttaactctcagcttagggaatcagactgaattagttctttgtgttattaaccggaggaacacttacattttctgacaactctaatcttggagctcagggaatagcacagagcatttgtatgaaattacccctcgttctatctataggcctaacagccagcatttgtgaatttggcagaagccagcagatctcacagttaatgtcttcctctcctgccaggatctttggaacaaggtgcttagagtgccacatgacaaagagccggacagatcctgggatgtggagcccaggtgatgttatttgcatccaattaaagaagcaggaatgggtagcataattgacatgcatgactcttaatgccttttggttcattaagcctttggatcaacttttgtaggaagacatttaaaagaaactgagcaggacttgggcacaggtagaggtgagcttccgggctgaatcccctactaggccgttagtcaattgtatgtttcctttttggactcacctctgggttgcaaaggaggttgctctgattgtttcttgttataccataaagataaggagcttgagttactttccagctgataaggcaattttcacctttttccatttgtcttggaatttcacaccccaccccatcctacccttaaggtgccctggaggggttgaagggccattcttggtcatccagtctctgtgtggttgggttgatcacagaaactagagaagtcacgaagagtaggtgttcctcaggttaattacacaaagaactaattcagtctgattccttaagctcggagttaaaaacagtgattgtgaactcatgaagggagggtcttctgagagatataaagaggctgatatatgctctttatatctcacctttgatgatacacagctcacctttgatggtcactctgaatcacatcaaggcgatgacaagaacaactgtctagacttagtggtgtggctttgaaacgacacttcgccattcagggattcaattgttttccagttttataatgagggagctgagcaagagaaatattttcaaaggccattctgggctgcacaaggatagaaacaaatgggaggtccattgggcaggacacacctgtttctacaagagcaacctacttttttgttttgttttaatcaagggagtgtcaagcaattgcttatttcataaacagggctgtgctgctatttttacacagtgtgaagtccacaggtctgaataatttcttcttgctccaagagttcctaggtcctgtgttcagattttgagagccttcatgtctcaggtcccaatagcagtttctatgactgaccagcctgtccacagagcatctcctcactggacaggcattgtgggcacgctcctgcggaggaagaatcagggtggtgaggcaattagtaggtgttctacaatcctgacatctttctcagaccagcccccatctctgtctattggcgagatttcttctttagcttctgctcactatgacatgaaggacttcttcttacctagatattctggtgctataggggggtgctgatcagtggagcttagaattactttacacacacatgcctacaccccccctcgcaacacacacacgtaccttacaaaatttctaattataggccaggcgcggtatctcatacctataatcccagccctttgggaggccgaggcaggcagatcatgaggttaggagttcaagaccagcctgatcagcagggtgaaaccccatctctactaaaaacacaaaaattagctgggcatggtggtgtgcacctgtaatcctaactactcaggaggttgaggcaggagaattgcgtgaacccgggaggcagaggttgcagtgagccaagatcgcaccactgcactccagcctgggtgacagagtgagactctgtctcaaaaaagaaaaacagaaaaattgctaattatgctgattactttagataaacatttctcaatttgggcttcaaggcatattaatagacatacaaaaaaattatttggtcaagtgaaaataaagcatatcctgcgtcccatagtagggtagtgtattagtcccttctcacgttgctttaaggaaataccggagactaggtaatttataaaggaaagaggtttaattgactcacagttcaccatggctgggaaggcctcaggaaacttacaatcatagcagtggcagaaggcagccatgattgtttaccaggcagcaggaaggagagtgccaagggaagagggaggagtcccttataaaaccatcagatcttgtgagaactcactcactaccatgagaacagcatggggaaaactgcccccatgattcaattaactccacctggtctctcccttgacatatgtggattgtgggtgagagacaggactagctggatttcctaggccaactaagaattcctaagccagctgtgcctggtggctcacgcctgtaatcccagcactttgggaggccgaggcgggcagatcacgaggtcaggagatcgagaccatcctggctaacacagtgaaattccgtctttactaaaaatactaaatattagctgggcgtggtggcaggtgcctgcagttccagctactcgggaggctgaggcaggagaatggcatgaacccgggaggcggagcttgccgtgagcagagatcacgccactgcactccagcctgggcgacaaagcgagactccgtctccaaaaaaaaaaaaaaaaaaaaaattcctaagcctagctggggaaggtgaccacacccacttttaaacacggggcttgtaactcagctcacacccaacaaatcaggttgtaaagagggttcactaaaatacaaattaggctaaagcaggaggtaaagaagtagtcaaatcatatatcgcctgagaacacagggggagcgacaatgatcgggatataaacccaggcattcgagcagggtgtggtaaccccctttgggtcccctcccattgtatgggagctctgttttcactctgttaaatcttgcaagtgaacactcttctggtctgtgcttgttagggcttgagctgagctttcgctcaccatccaccactgttgtttgctgccgtcgcagacccgtggctgacttccacccctctggatccagcagggtgtccactgtgctcctgatccagcgaggctcccattgccactcccgactgggctaaaggcttgccattgttcccgcaaggctaagtgcctgggttcgtcctaactgggctgaacactagttgctgggctccgtggttttcttctgtgacccacggcttctaatagagctataacactcactgcatgtgccaaggttccattccctggaattcatgaggccaagatccccaggtcagagaacaaaaggcttgctgccatcttgggagcggcccgccccatcttgggagctctaagaacaaagacccgcccgtatcatggggattacaattcaagatgagatttgggtggggacacaaaggctttcatggtttttggcacccgctgctgtcccctccttttgagtgtgggacggatctgtgactggcttctagcccatagaatatggcaccttccttcacataaaccatccatctctgagccatccccggttccttgacttcatagactcacaattccagataagagatgattctaccaccttgctgtcctggcatcccgggattcctgccgcgtgggctgaactgtctgcctttcccagtatggaagtcatcacttactcattcaatcatttagcaccctttctcgcttgcttggaaaatacaaggtaaaaaacacactagcctactatttgatatttgtgcgtgggtgtgtgtgtggggcgtcatatatccctcttagcatctgataaaaaaaagatcaattcattacccagaaatatgtatctgcatgtgtgcaagtcccaatacacaattcagtacaattctgggggttctggactccctgaggaccatttataagttctctccaagtcattgaccccaggtttagttgcccctctagactataaggccccctagatagaaggcaagtgtcatatgccactgcatccccaactctgaggacaaagcctggtggcaggtggaccttcattcagggtgaattgagctgaattcggtacatggctctgtactcagaaggcctttatttatttcttgtgttcctcttatcttgtcacactccaaaatagaaatgtatacctctgctagttgaatgactgtttatttggaaatcatcacccaatgcccaactgcatccaggctgcgtgacatcattccagactacaaagtgccaagcgctaattgatttgtaagaaagtccacatgaaatgcctggcactctcccaaaggcacccatgggcttggagggacgacagcattggactgttatgcgaggaaataattcttgcttgcccgcctgggatggggtgacgttctggccaggaagcagaagcagacttgactttgggcagcagtctgcccctgatggagttattcacagatggctaagttaaatgcagccctcatagcactaaggcatttcaggggcgactaaacaagtggcccatgaaatggaggcaccagaagcctctggaagcggcatcagtgcatcacccagtgaagccattgtgtcgcctgttagtaatgagcatttgcaagggcagcatggggaatttcaatcaacctgtgagaagacaaggtgtgcagacattgtggatctgagcgagatggggagaaaaggcaataaaaagcagtagcaaaggggaaaagaaaagttcgggccaggagccaagaagatactttctgtggaaaagggagggaaaaaaaaaatcactccacccctcctgtccaaatgaaaaagcatttaattgaatgttctttatagaggtgaaaaaataccctgtggagttcccagtgtttcattatccgattgagttcggtacctcaagtttcaaagaccgttctcctgaatggttattctcatttccatgtcagtctgccgtgtgcttggtgaacccctgctgggccgcatcatttaaaactcaaaaccctgaaagtatttttatgcccgatatagtaacagagcaaaccctggtatcactcattttattctccgcagcctccttcctcttgtctgtgatgtagatgactgtgctgctcgagatgcttgcaatcaacagggcgctccccaagctctgaatgaggtgaatggcctcagaggaaaacagattagaaggcttagagatgactgcatctcaggtgcaacacttgaagcaggaagatgggagtctcagaattttccccttgcagttagaaaaatatgggacaggctggggcagtaggagtggatttaagtaagtgagacagtggatcaggaaaggccaggcttttactgggtggaaatagcctggatgcaattatctgctacaagccccaccaagaagagcctccctgctggaggaaagcagaaagggaactggggtataaccaagcttgtccaatccgaggcccgtgggtcacatgctgctgagggaggatgactttgaatgaggcccaacacaagttcgtaaagtttcttaaaaggttatgaaatttttttgcaattttttttcttttcttttctttttttttttagttcatcagctgtcgttagtgttattttatgtgttgccaaagatcattcttcttcttccactgtggcccagggaagccaaaaatttgaaaacccctggtttaaatcctctctacaaactcgccagctctgcaaaataatcatctttgttggtcttaagaacactttaaatcaggtttaaatcatctgaacatcagaaaggaatttttttttcttttcttttcttttgttttttttctcccttgagagggaaatctaggggtggagtagagaatcatttaaaatatttcccttcagagaccaacggctaggaatagctgataaataacataaaagagcggtttaatagtttcatgtttgacccatgtaataccccgcacatttggttaatttagaaaatatttgacgacaacggaatccaatctcattttctcaaacagaagcttaatttctctttgactgaaatgaatagttatgttgccatgccttagccaaacaccctataaatataataccccttcagccttaatatttcaaaaactatggttttcagtttgagctgttataatgttttatctcagaagttgtagaataatttaaaccagtttttcctactttggttccttggaggctgattcttctgcctgaattcctctcacagaacatataaaccccttttacctccctcactggcacaaaagcaacttgtttccaagattcaggacttaaagaaatggctgtgggttggtctacgaaaaccattatgctgcatcctcccagtcctgagagattctgaagagaagcaggccctggcttcagagttgaagaaatgataccttccctcctttgcctcatagtctcattcatgatgtttgcttcccatactcatctccaactggctcacacattccttcaccagatagtgtgggaaggagtccatctttctgcagttggctaatccaggtgttggcatggaagttttagctctggtctgagagttctagtcatggacaattgtccatgtctattggaatgaataattttccaatggacatggacagttgtcccaggggactggaaatcaagggtgctgagtaaactcagcctcagtggaccacctgtgtgagttaatacagagaccacattctgcatcttagcaacctaaacaaaggagaggcacagcaaggtgagaagcttcaaaaggcagtcagccaatgcatcaacctgggcccggaggggtcggggaacctcaaattgtcatccttatgtaacagtgacaactaacatttttcaaggctcgttaccatgccctggccacctgtcccacattattttatggaatgctcagtcaaccctatgaattacatactatattatccccattttacagactacaaaatgaaggtttaaggagaagcttacacacctcacccaaggtcctacagttgttaagtagggggacagagacctgcatttatctgtagaccctccactcttaaccaccctattgacccagttcctaatccagctcacttctgagctctggacgtccaccaggaagaaaacaatggctgtagtggtgcagtgacccttctttgccagtttgtcttgggtcctgatgagctgccaggctcagtctggaaaagtgccctcaatccctgcatctccatctctcataggcattgtgggaccccacaaagactctgtctctattcgcttaacacagtggaaaaaaaggccacccttcattctttttttttttttttttcattcaacaaacatttattgatcttctaatgttttttcaagaatgcttttgggcctgggatacaaactaatggacccaacagatgagtcccttgccctattggcacttactggttcatgtcaggttcctgtgcctctcctggagaagcaggtgataaggtctctgtgttaaaggaggaaaccaaggttctaggcagcctcgtgggtaatacagccagtaaattgcaaagctgggtgaactcaattgacaggactctagccagaaactggttctttgccattagtctctactgacccctatggatgtatggagggagtatggggtacctgggaaacatcaagccttacctagaatcatctttccaatctcgctcttctcttccatttagaaccaccttcaacatctccccagggtacattccctaaatagccccgattattcattattttatggaactaccagatactgaattcctgttctgggccatgcactctaggagctgtgatttcaacagtgaaggaggacagggtggaccccaccatcgtggaatttacattctaaagggcacagtttttctgttgagtcttcccaggaggtgtctttttatttcatacctttgaccttcagatccattcatgatactttggcttatgggtgttccacacttgattccaagggtgatattccatatgtgtaatgcctcgctcaatcagaatggacactggccctagtggccacccaagatggattcttggagcttctttgctgtgacaaataatgaccttttagttgacgaattataaggaagttatgggagatcccagaggaaggctttaagacaggggaattcagagagcttggagcagcagctctttacgtagggccacagtgtatttcagtgtttctccaacggctgcacctgtggacctatgtgtactgggagactattgactctgctcagattacatgggtaagtttgctccttacaactagactgaatgcccattggaggcaggatcctatcaactttttcttctgccaaaccagcctgacacagtatacattgcatacgattcttccatgactatgtacttgtcatgagttattcctcatcattctaaaatttgacctcaaagctgagcaaagtctagatgaaatgaggttctagtttttataataatgttcaatagtttttcctatacgtcactctttcagtgtggggaggaatggtgacttttcagttgcttctgaatacggtttgctgtacactgtgtgttaccagtgtgatttgctataacccagctcttggagcctcatatggtatgtggttcaacagtacagtggtcagtcaagaataaatacagagcaagtactacggtagctgcagaaagagcatcgccaccatgcatcattagtgcagagccctggaccaaaggactcgagctgccgccagacctttacccattccaagtgcagactttgctaattcatcactgccttcctcaagaccccagcaagcttctcatcacatcacttttggcacttatctgatctttcaatgatctgagttagctcaagaaattacatctagttaccataccatgtcaagactgctatttaactagaaaacaaagagacttcctccactccatgcaaacacatgttgattctcatttacctgtttaggaaaaaaaaatttagattcaggctcatatactaattttattcagtgcttaaggtatgtctgttatttgggatagaattcagtgaacaatgctaaggtttacaagggcccatgtatgactttagggccgtgtgtgtgtgtgtgtgtgtgtgtgtgtgtgtgtatacatgtgtatgtgtacatacttttccccctgtaataggatttctttagatctgatgcttaataagacagaaagacaccacagccttctcagaagacctttgcaatatgtccttactactggtttgtgctttcaaagttcatgtgtgtagtggtctctcctgtcaccacgatggatccagatttaagatgtcattgagccatcacaaagtaaagagacactttctaccccaggttgctctggggtgagaaaactttgatgactaaactaaaggtaaaatcaattgcagatgcagtgtctgaattggatatgaaagaaaagaggctggcatttattagctgtctaccggaaaccaggttgctcttgaaacaccgtctcatttaatcagaaaaatgaccgcttgcagtggatatcatcctctccagtttacaaatctagaaaacaagtacatcaaagcagttaagcattttcgtaggagccgcacactcagtaagctaatattagaactcaggtctgtctgatttcagagctctttccacactacctaaaatattcatgcaccagatgaaagctttcttttttcccctagactgtttcttaaatttgtagttctgctttcaatacagggtttcttgaaatgtgatggtgtgattagacttctggttattactctccaaccatcatttctaagagaattggtgtgtgaggctgaagggatgatagtagggtgagccgtaaatacaggttaactgtcttaatgtggcctgggcaatgtctaattactcagggctgtttttggaagacacttccccattctaggataggggttacaagcacaaatgtccataggagctgggtagttactgtgaataagtgccataggctagcctgtttgggtttggggagctgagtgaggctgtactgggaaacacatgccccaggtagagctgggggttggtgtctttgctccgttaagacgattgcaagatcccagcaagggatcttgaatatttgcaggttctgggttctgtgttgagtgcttaaatggatatcttatttaataataacaggaacccttggaagtgagcacaggtttgattctcactttgcagataaagaaactgaggcccagaaaggtgcccaaggaagcagagttatttaggacctgacagaggtaggattccaacctgggcagtctatcaccagagtccttgtttaatcactaaattttgtacctcttaggactattcaaacccagcaatttgtctctgagaatgatagataaacatgaagatactggagaagtcaattatatatccccctaaaatgccttcagcgtgttcaaaagcaccgagctctccgccatgatgtttgtaagggggtgacgttagatagtgatcaaagaaaagtctaatacatgttattttttgttgtacagttcagttccttgtacataattcatgtgtcaattgatactcatgaaagttggtcttgaaatattgtatacagcccaaattaagagcttggcacccaatccccacttggactacaaatcacttcctcttgccaaattagagtctagagtaatttaccgtaagatgggcttttaaccctaatttctagacatactcagcagtctgctttgaaagctcatcagcttctagaagcagctcatcgttaaggagataccatcagggtaaacacatcagtttagtcttttttgcaacattgctaattccacgttgtaatcaaggagaaataaatggaaaactcttacttagtattagtttatttagacccatttatttccatcagtgaccttgggagatagttggttcagcacattttctcatattcggcctctaattcagtgtgggattttgtgtttttataattaacagagacatttacaaatagaaaaaaatatatttgtgcttttgggaaaagtgccaacaatgtggctatggaatttgattttctaaatggagactacacaaagtgtagattttttatttctaatgtatgtctctgcctatctactgatgatggattttggctttatggcaacccactaccaggcttttagctgtcagaattggacaacgtattgactcctaggtaggaaccgtggaaccactgcgttatcatgataagctggtacaagcagagaggatctattttctaagcagatgtttactaagggactactacactcgaatgacatcacatctttgttagcagttgtggttggtgccatgtttattaaaagacaggaagaccctttggttggctgttaactattgcatatttgtctgtcttgtcaataagcatttttttaaaggttacttttcctttatgtgtttacttggggttaaaattttgggattatgacaaaggccatattttgagattatgacaaaaaataattcaaaaatgaattattgaatgaggaagttgggtctcattcagtaggttaggtctcctttaaaattgtatttttctcgtatgaagacccagttcaatgggtttcatagccagtctgaggcaaaagctggctatttacttccaaaaggacttctcctcaaggaagagaccccctagtgatacccaaatcataaatcagagttcttaacttgggatctatggaacagagatcagggagtgagtcttagaaggcccgttaacctcccagtatgtggaaaaatgcttcagatgttgacacatttcacagaagtgtcatcacattaacaaagggctcataacccataaaagttaagaaccattaattttcaggtaattcttctaaataatgggtcctggccagctctacatgatttggagcatatttacatacatttgcatactgcttgtccttggtcatgccattcaactgccacacacctcattatagaaaagagaaagaacaggatttacctaaagctcaaaggaatagtgatcctgtgctaattaaaatttgttctggtatttgggagtctcagatgagaaatctggagtcatgttgagtttggttattttactcatttgtagtcagtattcaattattttaatttagcttgtgcattttcatgcaccttatttcctttttcctcctttcgactccatttggtacatttcatctcactaaacaaggagaaaaaaagggaataggagttcttgaaactcaaaagcagcattaagttcttgtctgtgacccttattgagcaaagattaggaccagtgtttacaaatttttcaagtactctcaggagctcttgatgcttagactctagaaaatgttgggtttgttcttaagaaacagaaagtgtccaaatcccacttggcttcctaacctctcagactcactctctgccctacagagccttagaaggatggccaccaacacctatgagatttactcctgaatcatttgtctcaagccatttcccactctgctatcagcctgtttctgttaacctggctggtgattccacgaatcattgtcccctttgaagatctatctaacctcctggcttgatgctcctcgagggacctctagcttctgtggattcaaatgctttaaggaaaaatactcagtctaatccacactgtctctagaaccagctagctttgtgcaatcattcaggaacatctctggccctccccacccacacactttccatcaatccagaaatgatcagattcagcccttgctcacagatgtgaagccacaaacggcagctagggtcaagaacagcaaggttactactggatgctgactcaaggcaagaagaggagtcaggcacaaaattctgaaattagtcattgagggaagtacaaagcttaaccgtagacaggaacctggaaatgctgggtcagcctcttcgtctacccgtacatgacatacaaaattattccatgttacttcaatacttttacccagagccttgtaacaatcttcttgaactgttgaatctatacaggtgtagattgggtcaggagatagctttaaaagtttgttgttcacgttcgtgccaactcctggtgtcttagattttgttcccaaacactcattatgacaaaaggatttaagtgcattctatttatttgtgaagtgatgcaggaaactacagtaaggagtgcggatgtgaataagtggaaggcaatacagtgtgtgtgaatggtaatgtcacctccatgggcgggtggggctcagttccgttgaggatctctggaagactacatataggctggctcagagctgtgccccactggggcagctcactgggttatttatctatcatctccctctcattggttggagcctgcttctaaggggcataatattcaggtgctttccacctgccaagagaggaggccaagcatgctccagtggccgcagaaagtcctcagcagaatcccagggtcttctaagaagaagacgtggagatcgtgagaatagtgagtgctcacagtatgtagcggggacaacaacagtgtctcccacaaccagcattacagataaccaggagtcgaccctgatgaagctggtggctttctcagctttacagaatgctcttttctgcttcgcctggcaaaacaggaggatatctgtctcaaagttttcaaagaaaggacattcagtgatctgttgagagattcagaggttctccttttctctggtggtgctctatcagggacagataggtccctaagacttagcagcaaaagggactctccctgcagaagcatgtgcatgatgtgagtaggtgtgcccacagcccagggttcatactctggggcttcatgcccttttcctattctttgtctccaaccgcatcttataagaagtgcatgttaggaaagagtacactaaagacaggaacagttactggattaatataactttaaaggtgagcatactggggaaaagtgaacagcaacccttaccagaatgtttaggtacatttctgcctccctcttcaagctgccaggaaagtgcactgtaagttaccaaggagcaaacttcagcgcttttccaacagtcacaaaggactctctgccaccatctgtgttgcatgtgtgctttacctttgctgtcctccttactttgaaataaatcccacccactacggtgtcccatttcagaaactctaaaatacttacttgaatccctggaatggattcatccaaccctgttcggttttcttccttccagtgtgctattctatagtagaaacagtgccaggccatgggatttagacatcagaggcatttccaggtttataaaaaggcgaagactgtattaaagtatttgcttttaagtttgttggccagttcttctcactgaccctggataggtctaggctactctcagcttacctaccatgtctttgtaagatgtgtagtccatggtgcttgaatagcaccacaaagacgtggagaggtaaaagacataagatgatctcaattttgaataattctccttgaggggcaattatatatttttggaaagttcattcttatttattgggccttctttatctcagaattcaggaaggggcagagtgttttcttcccaagttactgactttcttagcatgcgaggctcaaatgacaatgattatttagaatctctgagcagctcagactcagttttttttgtaatgccagcatataggtcaaatgtgaattccttacaattttttctgaatgggaagtttagggaacgactccaatgttcctgtagtcgctctaagtcgtttaggtgtgctataggatgaaaagaagaataatgaaactgtggtatatgcatgccgtgggatatcattcagtcatacaaaagaagaaagtcctaccatttgtgacaatatggatgaacctgcaggatattatgctaagtgaaataagacagtcacagaaggacagaaactgcaggattccacttatatgaggtatctaaaatagtcagactaatagaagcagagtagaatggtgatttgggggagcagaaaggggaaatttattgctcagtgggtataaagcatcaattatatgggaagaaaaagttctagagatgttttgtacaacttagtgcttttaggtaacaaaactgtaatgtgcacttaaaaatgtgttcagaggctgggcgccatggctgatgcctgtaatcccagcactttgggaggctgaggtgggcagatcacgaggtcaagagatcgagaccagcctgaccaacatggtaaaaccttgtctctactaaaaatataaaaattagctgggcgtggtggtgcgcgcctgtagtcccagctactcaggaggctgaggcaagagaatcgcttgaacccaggaggtggaggttgcagtgagctgagatcacgctactgcactccagcctggtgacagagtgagacttcatctcaaaaaaaaaaatgtgtttagagtttagatctcaggttaggggatcttgctacacacacacacacacacacacacacacacacacacgcacacacatacaaatacaaagaaatacaatgaagcttttagaggtgatggatatatttactaccttgattgtggtgatggtatcacaggtatatgcatatataaaacatatcaaattgtatacatttaacatgtgcagttttattgcacgttaaagatactttaataaagctattaagaaaaagaaataaaaacgtttgctttcatatcctcaggtcatcatggattcggatcctagttctcttgtgtgaacatcttcctcattttccccatatgaaaaatagtggatttaatatatgccttatcacatcagtttgtggattaggagacactgtatgtatgaaacaccacagtcaataattggtaggaatctccttacccttcttcccttggtatgtagcaacttcatgaatgaaaacactttccccaaataggtatctcacagagaagaaaacactatgaattcatgacccatttgcatagttttaggggttaaaagagctgtatataaattgtaaaacatattaagaaatttagagaaataatctaagggttatcaaagaatgttcaaattccctcagattttgtttttcaccttatctaaattcatattttcatccctattttaagcagaattattcatagttatctacttagcagatgttcaaggatgatattctctttgtatccatctttccttatccagaggcgtaaaggaaaagcatgaagataagggacacggcatcgttaagtatcccgggtttgttaacagtagaagagagtgtggacttgcttttcactttcattgtgtgtgtttctaggagatcctctatcttcatgctcagcccccaggtccatgtgtccttctctctaataggactgtgctatgatagctgttggtgggagagaggtcttgcaacctaaaaggaaggagagccatatgcagaagagagaagtgattagatgataaagctgaatggtgactctgaaaaacaaagtaactgtaaatttgtggaacttttggtctttcttctcatttgatgattagaaattttttagctgtccaaatccagtccttgtcttatctcagctatgcagagtggcatggctggttcaagctttcagtgaagaaacagatgtatgaggccaaatcttgcaaaatgccagaagagtgtatttgggcagaataccaaaatgagttcgggggcctatatggaactgcgggcagggccaatgacagatagttgaggactgcaatgagagatgcccaaatataagtatgacaagcaggaatgtcattctgtgagtcagagtcaaagtcaaaaagactttgtaaaaatctactttggagactaggtgtgggtgtctgatttagaacccttctcatagtctggtgatttctaatggtgcttttgccgaaggaattcttaggagcatccaagttccatcttaaagacatggctttgccagtctgttgtgggtgtgctataccatatcagacagagaaataaggatgtgtgtgaaggtatgaatctccggttgacgaactctagtgtgcaaataagacaactgtctgtcttttaacatggtacgcacatttctgttttgatcaccctttctaccagttggtgaaaactttagcaaagtccattcattgtctccataatcccctaggtttctatctaattttcattgagcttacaaggcacatggcaggtgggaggcactctggcatccactgagatgttagtgaacccatctggtcttcatttgtttccttccaagctcaagggtgattgagtttgccagccttctctccactgttttagtcttttcccaaagcatataaggactcttctcttgcttccttgctgaactgggcttggagatgcagctcagagagaagacatgcccttgtcccttcataataaaccatcaacatgtccctttttacatgtctgctatttgtctcctcttctttccagcccagggagtctttatctagataataggtcgagtaacctggaccacagtccattcttccctgtctaccattgaaggtacaaaacgtataccagacacctttaagatttagaatttgaaatacaagaatgtgggttcttacaaaacaaaacttggaattttaaagttaatttttgttattcttgagctctctgttttttgttttgttttgttttgtttttgtaacattatctctctcctgaggcaattaaacagaaaaggagtaatgagcagagtgaaagttaaggaaaggtcttatttaattcctgcccaaactttcagactgcctgatgggaaccccagttgaataatggtgggatttttgttgttgttgttgttgttaagcaaagatgatttccaagctctgcagggcagggagagctggagagttcacatgtttgtatttgaactcacatgaaacaatgaagagtgaaatacagtcctgtttctctagcagtgaaatttcagatccacagagaaacaaggctttcattctaccataaagaaggacaaaacataactgagaaatacagtgtaaaaggaggaatttgcaaagaataatatgctctagcatattccagcaaggagtgatcagatgtgggcatagcagtcatcattggggtgaaatccaagacaactatgggtagcaaaggaagcagctatctttgagaaagtaagactgataaggttttcagtccaaatgacaagtaacttctagtttctaagtataagcttttgcagttgggatcatgcctttttttttttttttcttaagaaaaaacttaaattgcttttactgacaacagacattgccagatttatccacacaaccagtgttccaaatgtcatataaaaatgcaatgcagcaattggccagattgttaagtaacgtgctataattgtttttatttgttttaatccctgtgaacaaacattttattttttgtccaaaagacaaaaaggagttgaaattttatcgttgtttttccaggcaaaagaaaatagggtatttgttgactgaagaaatgagatatttctctttggcagtttgggcggcctaattgataggaagaggtctggtagctgagaatagcagggttagaacaatagaggattccaagatcaaggggaagggtcagaggttcacaattcccaactggagtgggtgagtgggagagaactttacaaaagaaataagagcaaaaccatctgggtaaaaatgacaccatgtcttgatctctgggctaaggacccctggaagtgcaaccatttacactcgctcttgaaaatgcctcattgtgggttcagggataataacccttaagctaaagcctttatgagttggaagaagagaaaatgtgcttcctgtttcttacagaggatgaaagaagcagttaattcccaaatccagcctccaaacaccacaatggagcattttatatgtggaggaaaattgctaaaggttatttacaattagatccataaaaataattactggggacttttaacaaactttatttaggctcttccatacttaagacacaattctcaagaatatcttgggtaattttcaaactgttcttttccttaaaacgatcaaagggaattggttattatccaaggtcaacttattaacgagagacagaatattccccaattacagtatttctccagcgcagttcttactgagctctaggcaaggggcaaaatggggaggagagagtgtagtcagaagtcccagggtcttacttgggtctccagctaactagctcagtgagcctgggcaacacccctgacctgtctgcatatgtttccttgtttgcaaaatgaaatgagaggggataattctaaaaatcctttctttgtgctcttcctaattttttttagaactgctaaatcattgcacgcatgaaatgatttgcttttgttctctttgaaataatggagctcattgtctaggatctccagcttctatttctgtgaagcaagatctaacagcctttgatacctctctgtctactttctagggaattacagatataatttgtggagacacttagtcaaaaattgtcactgaatgccttatgcttttccacaatgctttcagagctgaatccttataggaggcaagtcagagatgaaataagaaggactgacaggaaggagaggtgtaaacagagctcgtgaacacacatgaaaaggcaagtgataggtacacaaggacatcaccaagaagaaggctctttttctgcccttgcagtataaaaatagttatttattttttcataagatgatgttggaaaagtttcaaaggaaaggcttctagtgtttgatgagcacctgctgtgtaacgggcacaggttaggcaattttatacaagataaagatgtttgtacccacttaatggataagaaaattgaggcacaaaggggttaagcagtcttcccaaacttacccagttattcattttaactgctgtgtcatgttcctggtgtgagtctgccaaaaattaattcatttaacctttttactattgtttttcatgattacaagcgtttctgtagtgagcatccttatacctgccctcatgtttacacataagagtatattttttaggtaggtgcaataaactaagcatgtatctgtagatatgtgtatatgtatgggtatatatacacgttatatatatgattgtgaacatgcatatacatatgtatgaatacatatgtgtttgtatatcagtgtatgtatctacatatatgtatttttctaagatcctgccaaattatcattgcaaagtggctctgtaaaatttcactcctccccaacattgaatgaaaatatctgtttcctcatactgtcaccagtgtttcgtgtcaccatattttaaacatttgccaagctattattacattattttttcatgttcatttcttcaatcacaagtgagtttgaccacctctcaagttatttacgtccaaaaaaaaaaaatcactgtaaatgaaaaatgagtagtttagccttgccctgtgctgtgcagaaagccggtgagtttcttcctgaagaggatgctgcagggtcatttgacttggagaggagggagtggtaagatcacattatcattaagaattcgctcagggcatgtaaagatggctgagcagcttctttaagcgtgtaagtgatgacgctcaaatctatcagaatactaaccctgaaatcaggtctgagtttacagccattatatctttctttggatttggttttatgtttttacccttgatttatgtacgtacttcccttagcatcccatatctcaagcaacataaaggtattaaagtgatgggatttagcaaatatgttatggttaccatctttgttcccaagagggaatttggaaatctgacaagtattatacctttcattttcaagacccgttttctgagccgtttcgctaacaagtcccctgatttaccatgccattaacaaaaataattctttctggacagcagtaaaagaagtggattagaacaatttacagccttctcaagatacatataaggtgcctgttaagaaaaaaaaagggacagatttttgattaactgatacgtagacttgcttttaaaacatgtcagttcattctctgtatgcccatctattaagggcaatgtccctcatggaggaagcctgccatcgcccggtgccttagcacgctctcatgtttgccaacagtgattaggaattacttagttgctgacaaccctccatcattgatcgaagtaagaaaccttttctgcttcaaggtaaggacatggtgcctactttctaaatgagatgttatccagagacaacattttgaatctgtaggcaaaaacgtatccagttcaacaaaagaataacctgcaataagcagagatagaatgggtgaggacctaggacagcggctcattaggcagaacccgtcctttctctttgctaaagttagggaggaaacaaatgcctgccgaacagaaggaggagatgagaggatctgtcagccagggagaggtacagctaccagaaaagcactggacagtttcctctaatccttgggaactttaatcgtctcctcaataattctcattttgagaggatctcaaagtggagggatccattagtaagttccactttggcctggaatgagagatgccgaaaatgacaagggtgcttttctgtggtggtgtaagtagcgtggccgtggatgtgggcaattggcttactccagtctgtggcattagttagcatctctgaaaccctgagacatgattctcagcccccatggctggtcaagggattaccagagaagattttcaagtacatgggattggggggtgctcccaacccttcagtcagctgtgggttttgcgtgtgaagagcataagaggggagagagaggaaatgagagaagctggaccatgcagagccttgtaggtgatgggaaggattttgctttcatcctaagaagagtgagaagccattaataggattcggggtgattgtgagtcagggggaaatggggggaggtatcaggacatggaggtctttgcaattattagttggagaacagcaatggttcttagctgcttcgtgtgccctggacccttctctcagtctgctgaagcctgggcagtccatctcagatcctgttcaggtgcatagattaaaatattttaaattacgatataagctacttatgctataccatatttatactatatcattgtggtaataaagaatttgtcatagattaatagacaggcataggtgtcctggaactggttctgtcttaccagcttgtcaaagctgattacgcgaatttctttccaaattcttactcagtgatgccaaattggtagcttgaaatcaagccacggtgagagaatttatatcatagaatatggaaaacattacagatcaggacttttcttctcaaaagtcagctgttaaacattgaccatcatagcactgtgtatatacttatgtatttaataataggctttggtggcaggtttagtaactattgcaattttgaagtagtgatgagtatgaatcccatttcaggatatttcccacaattgaaatgtgatataataacttttttcctataactggtgacaaacacaggttctgctaatactattgtgatttgttatctacattcatagttgaagaacctgcttaattttcgttagagggtaatgaaaataagggtgcatttttccattgaaagagcctctgaactacagtgtccagaaaatgagaaaaaagagggaccatagagaccaactagaaggtgatagcagtattccaaatgagttgccatggtgtcttgtattccagtgaggagatggaaaggtgtatatggaattggaaatggttagtagataaactctatgacaattgggtatgtatagacattggggtgaaggaagtgtcaggagtgacttatagggttatggcttacaccactcaacttaataaggatgagaatgccagaagggcccaggtttagggaagatgaccatgagtttggttagggcctgttgagtttgaagtgccttttgagtatcatggaaatattaaaaagatattgggacacatgcatttggaatagagacatgagtaggttctaccttcagccttggggtgggaccaggttacgaagggatgttattctttgatggatgagcagactacaaaaagctgtgccaccctttgtctctatgtattcacactgcttcccctagcacctcttctttatctcctaacaatcattgtgccaacagactgcctttagaaactggcagatggcccctcttcgaaggatcctgtgcatacagagtaactactttcccagtagctgcatggctatcttgctggatctgcaggtccagaggaggggctgggacagtagaggagcactaggaagtcattaggatatttgcaataattgaagcttgcatcctatttgaaacttccccaaagaaaaaaatgagcgagaagagtggtcagcaggaagccttgaggagttccaaaatcagtggccagcagaggtggaggagcctaaaaatgagactttggagggagcagccacaaagataggagaaaagccaggtgaggtggtggaggtgcagggaagacaagcagagagggtgcttcagtgagaagagaggagaggagtgaaactcaaagtcgcaagagaacactggaagttcttccctgcatctagtgacacggagggtgttaattttacacaggctgtgttggtggaggaaaccagatgggaggggaagaaatggagataacagttatagacacatcttttaagaagtttggcggctaaaaaggagacagatagtgaagtagttggaggtggatgtagagaaaacaaagttttttttttctttcttttttatttcctttccttctcttccttcctttttccttccttccttcctcccttccttcctcccttctttcctcccttctttcctgtaggagatactttctcataaggattcatttgagacagagagggtaggagagaagggatttatgatggcataaagcttctgagaaggtgggaaaggctagacttcaaaacataagagggacctgttaactttttaaacctgggagttgaatcaatgaaaaactgagtcaatgatgtaacacttttaaaggtagttgtttattgccccccatcttagagaagagccttttctggttacagaagacaaagtgatttaatgtgtgctgaagtaagctggaaattcaggtgttcagttgatgtttttggagtagactgtgaaattgaaattggagagacattatccaggcaggaaaactatgagttaagggctctggacaataaaaaaaataagggtgtcatccttggggaaggagatgggagatgctgatgcgtttagggcttcagagctgcacctgtgctcctcttgggatcagaactgcagtatctctgcagctgctgcaccttgtttttaacccctgcatccaagagctgagtgttgcatgactctcaagatgcagatattaaaaccttattgactgatgtagactcttctgtgcatcaaagggctcagaagtggtattagctggctgtctccttttaagtgcagagagtgcttttctgtagatagtgctatgagctacctggggttaagataaaaggcttcaaaaaggtagtgtcttcccggaggctgcttgtggccactcgctgtgtgtctgtggctatacagaccccagattgctggggctggactttgcatgtctctctctattaccttctagagcctgtgaggcccaggcttttaaagattcggcactgaaagaaactaaaaccaaacttttgagtttacaactgcctgaggctgcctccatctacaggacctttactaactgtgccattttggcgaaaagatagattttgaagttcaatcagtcttggtttcaagtattagctattcctcagatgattgtgggaccttgaacaagtctcttgccctctctgagtcagttttatcatccatgcaatagggataatattacctacctcataaaaccattgtcgagacccatctattcagcacatacttgagttcctattcaaataccggctgctgtgcttggctgtggagtctaactgcacaaaatggtcttgaccctgagggttttatagtttgagagtggatataccaaagtgcctggctgtgattattatattgtgatataataataaatacatatttggtctctgcccccagttctaatatttagtctgtgaacccagttcctggcagacagcatctaagagctttgtaatttcctgagtgacgggaacatctgacacagagctccgaaatcccttggtatttcctggctgataggagcatcttttgctctaatgagttgacttgtgctgggctcctggatacccccaggatgggtgctggtttccaggggaatcaaccatgtatttttagaaggttggggctttcatcatccaccccacctccagggaggaaagggaggctgaagactgagttgatcaccaacggtcagtgagatactcaatcgtgcctatgtaacaaagcctccatgataaccccaaaggacaggggttaaagggcttccaggttgctgaacccatggaggtttctggagggtggtgtgcccacagagggcatggaagctctgcatacctttccacatacctttccctatgcatctcttggtgtgactgttcatctatactctttgtaatattctttataataaatgcgtaaatataagtaaagtgttttcctgagcacttctgtgagtcactgtagcaaattaatagaagtcaaagagggggttgtgggaactccaatttatagtgggtcagtcagaagcacaggccacaacctgggccttgtgactggcatctgaagtaggggacagtcttggaggacctgtgggatgtggctttatctccaggtagatattactgaattgaattgaatcagaggattacccgctggtgtccactgaagaatggcttgatgtattggggaaaaacccactcatacttggtgtcaaaactgttgagtggtgtgtgacagtaggtaaaacattttgtttttttttctatccttcatattggcccagagagcttatttaataaatatctcattcatttcttttttcttatccattataccgtaggctcagctgaaaacatcgttcatgacccacctgaatgcacagtagggtacttagaaagtactgcatggttagcagacagctctgtagggagtcggaacagccacgcagtagagtcttggaagcagaagagagtaaggcacagagaccccgaatgagggccgagtgtggacatccacatcacagctccacccatgactagtcacaggaacagagacagtcgacttgcctctcactctctgcctcagtttcctcacctgcatgatggagacgataatggtacacaattctaaggtggttgtgaggattacacgagctggtggtgttgcgattctgaggtggttgtgaggattacacgagctggtagtgtgtgtcaggtgctcagaacaatgcgtggaacatggaaaacactccctacatgggagatattatttccatgttcagaaacaagctggtttcattaaagcccactgctctcaaaaggcaattcccatgggaatagtgatgacttgaaattctgtatcaaaatgctggtggatgctgcttcgtttgtagtttcttttcttttccagtctccacagggctctgttatttggatcctctaccatgaagaacagtgcccctaatcgtagactatcactttgttggccactgtgtgttgtccacccattatactgtgaggtctcaacagctttaatttcaataatttgaggtttgttcaatgcattatattccagatagttcacggatgcttttaatttaattataggcactttaacaccacagatgactgttggggaaacggaaaatgtcattctttctgaatgcaagacacgtgtttaggactgataaaatacataactgtgttttatttcagaataaaaagaaatgtattaccaagtatgtgacagtaggtagactgctgggaagcctgggtctgatacattgttgtcagaaacaggctcaattttggtgaagcgaagggtgtacggaggatgagccttgcaaacaagctaaggtgcccaaaggacagctcccccagtgacctcagggtcagcctctctcttacgtacatacaaggagcccctcctggaagcaaaccccactgcagccttccaacaggcacatccttgttcttcccactatcttattatttgtagcagcaattattcattgccatctgaattcactcagtaaatatttattgagtaccctgtatgtgtaggtagtggtgatacagcagtggacacacagacaaaaatccctactctgaaggagcttatattccggggggaaaaagagaggaaaataagtaaaatgtgtgctggttttgtgcatgaagatggcaaaggctatggagaaatcaaggaggatagagttggggaggaacagttgtaacttccatagtgtgggtggagaaggcctcactgaggcatcaacatttgagctaagtcttgaaagaggcaaaggaatgaaagaggtgccaggccaaggtaatagttcctataaaaatcctgagaatggagagtgcctggtgtgtctgaggaagcccaaggaggtcatcatggagtgagggggagataatagaagatgaacttcaaaaacgaagatgtgaaaaattgcattgatccttgtagtccatttggaagggtttagatgttttatcatcaccgtcgtcaccatcatcactaccacctgctagaaacttcggggggcggggggtgggggggaatgactcatcatctcatctctgcactcctgaagctccaactcagcacaggatacaacgaaaggataatgtgatgcttggtaccaagactttaaggacattcaggagcggacagaaaacatgacctaaaagagagggaaaaacagagactttttacagggtctcccttaggaaagggagctatcccttaggaggagatatctaagccactatgcagttgtgaggtctttagaaatcaaccaagtgcattggtcagattgaggctaagttttccaacacagagaaccctgaagtcccattctgtactttgtcttgactctcctttcatttctctttatcactcttcgccccccactgcaggtacctgttcctttttctgaccatgtctctggacttggagaaggttttctctcataagcttctatccagccctacacccagtggccatacaggtccacccctctgtatggctctgtgcattaatgagcagctcttcttagctcagcgtgctcactgtctttaggaatggtttctgctgaatccattgactgcacaataagcccagtggaatgtgtactctaggccccagttacctccaaggagaagggatgataaatataacagtgacaaaatactctcatacacacagaaatatatagttacacttaaatgcacacacatatatacatacaaatatagagtgggtgcagtggctcacacctgtaactccagcactttgggaggccgaggtgggtggatcacctgaggtcaggagttcaagaccagcctggccaaaatgatgaaaccctgtctttgctaaaaatacaaaaaaacagccaggtgtggtggtgcacacctgtagtcccagctactcaggaggctgaggtgggagaatcacttgaactcaggaggcagaggttgctgtaagccacagtcacaccactgcacttcagcctgggccacagagtgagactccatctcaaaaaatcaaatgaaaaaccacatatagttatatataaaagcatgcacgcatgcatgaatatacctatacatatacatctatgtttacatacaaatgcatgcatacatgcacatatgcacacacctataattataaatgcatgtatatatatatatgtatgtatacacacatacatttttatagaaatgcataggtatacacatgtatagagttgtagatgtatgcacatatttgcatgcatacatacatgactatacgcacaatgcacacatgtttatatatgaatgtattcactcatacatgtatggttgtgtgtgtgtgtgtgtgtgtgtgttttgggaagactaattactccaggagatttacatgtagtttcccttcttaagtagatcacaaccctgctctgcatttgctgccattgtttctgttacgtagatgaggaatttgagtctctaaaacttgaagttgcccggccaaggtcacgtagctagtaagttgtgaagctgatattcaaactaaggactaaaagataaaaaagaccactttcttccaatgcttaaaagatgttaacagaaagagagcaaagcaacaacaagaaagaaggaaccctaagtatgttcatcgagctactcacagaaaacagaaaatatgattacaacataaagtgataatttccataaaagaaaaagttacatgagcacatacaagagggaataacatttgaggaatctcttgaaggatgggtaggagttttttagaaaggggtggggaagcaaaaagattttgcttttcatttaaagttatgatagccaacatttaccttttagaggtgctcaaaaggcccactgtacctttggcttcatagctgtagaaatcgggcattttccaaaaaaaaggcagtgacggtgcctcacatctggccacaggcatctctcggcagcatgcaggtcatctagggcaagtctctgtaaaggcctttctctctggtgttgcatttgcgtattcatatgtctgcatacaaacaccaagtctgctgttagtggtgtcataactttgcaaaaggaagaaaacatggctaacggtaaaatgagttatgcctttataaaacattttcaatgacagaacttgctcccctctgagtgctttttgaggatcagtaatcataaactgtggctttgccaggaggtgctgtcgaagattgtgtggacattctttcagcaaaatcatctggcatgtgtgattgcttctatttattcaatactaaagaacagaagattgagttttatgagagagagaaaaatgcacattccacatagagattggataaatttcattgtttagagtgtttttattgccacaaagtaatcttctgattgctaggtgagtaatcctgtagttacaaaaacaatcaattaattgatctaaattaatcggataacatattttagcctgctaagcatgaaggcatatttcaagtaactttccagataaaggaggtattgaaccttttcagccaccagccagggacagtgacacagattctagtatcaaatgctgattctcaaattaacaaatgctggaattactatgagaaaggcatggactagggagtcatgaagtcctcccccttttgttatacaggaagcttctaagctgcctgtcccactgttcctccagctcttttgtcccaggcttggccctactgggaaggagacttccctaacttctgggctacccctccctttccctacctctagccacactgtgtttcagggagggcaacatgggagacagaggaaattaagacacctgcatgaaagttgacagagttacccaagaggagatgccactgggcagggactggagagcactcaagggaagggaggcaagtccgtcctttctcctcctttcttcttcaaaatgtattgaatgcctatgcttttccaggcagtttttaggcacttggaatacatcaatgaataaatacggcaaagatccctatgcttgtagaactgacattctagcagaagagacaactaatatataaataagtcacatagtattttagaaggtgatatatgcaatgggaatagaaaaagcagagccgaatgagggctagatggatgctgggatcctaggtggagcaactggctactgttaaaatttatctgagaagtggttccgagagacagcggcagcagtagaggagaacacagcagtcagacgagccaggagggttcctggctgttccctgcacatgtcattaatgtgaacactcaccagcatctcttagctccttcatctttaaaacagggataaggatatctgcaatgtggggaagtgggaatgattaaatatcattgatttgtttttactgctcctctttaaaatgacagcatcaccacaaaggagatgaaatagtcaatagtgaatggaaagcaccaagcacagagactggcacacaatgggtactgagtacacgtttacgttggtactcataaaagaccaggaagagcttatatgtggtgccctggtaatgcctcagatactgttctaaatgcttcatggatattagcacatttaatccttacaaccctttggggtaggaactaatttatgtccattttacaggtaatgaaactgaggcacagagaatttaagtaacctccccacagttttataattggttagtggtggaggcaggatttgaacacaggcatcctgcttctggaactgcactgcagttatttttagagcccaggctatggaaagaaaccattcatttattcacggaacacatttttattgattatctgctacatgacaggtctgtgatcagcactaaggctatagaaatgaaagacatagacagggttcctcccccaaaacattcttgatgtaaatgtgagactcacactataaccaccctaaggattttggtctgaaaagacattctttattaaggattatacatttatgtcctggatttcctagatctggccctgaaggtaaatattccattttcttattggagtataacaaccaacgtttgactgcaaaaaatgtggtagattattttcattcatatgaatatgcctgcccttttctctggtggagtctggcccggtaagtctgtgggacctgcctctaccaatgaggggtagagcttggtgacttttaacaatgatctcctcattagatgaggccatcagttacagcggaaatgatcattattggaaagctggagaccagctgctgtcagagagggatgggctcctgtggaagcttgcaaactgatgactacttaatccttgaacttcagcagcaacaacattagctgaaggtctgtaatgcattcacagttctcatctgacattttccccacatcattatttttctggttttacttttaaattccctataggaccattgacatgaaattctgagggggaatttggaacattaatgactgtttaaggcaaatgagtaagtgttctttccaagaggaaattgtctttataatattggcataaggctatttttaaaatttatactaatgagacgattcgaggcagataactgaatttcccaggcttgaagttggcctatgccccttggtgaattcagccttagggtgagctctgtggggccttgcaagtctggctctagatgcaagagatctgccctatccacattccttctttccataattggttagagccttgaccattcaaacctgggcttggatgttgggcttacaagtggcacagacagtcatggagcttgctgactacaagggaagaaagactttatcaaataacactacttatggatgtctcaactacaaacatgaatcaatgacttgaaagaaggagagtaatattccctgaccttaaacaataaaggactatgaccctgtttggggactggggatggtcattgagggctcccctaaaaataaatacttgctctgaacctcaaatgaagtgtaggatttagaaaggcaaggggccaggtgaaagaaaatggtttcaggaggagggaagaacaagggcttgaaggaatgtatggtccccttggaccatctatgcttcctaatcctggggattgcacctccagtgatataagaatgtgtggcaaagggaaccaggttcctcactgactttgttcccatccatagaaccaaaagggtcttccttagtaatgcctatggctattgggtattgagttcttactacaggatagaccctgctccaaggactttgtgtgaattaacttatttgacctcgacagacatttgcctcaccccactgaaacaagtgacattaacagcaatcaaaagattacccggggacacaaggctatgtaatacagcaatatatgcaatataaaaaaataaataaaacttgaatgcttccaaatgtctatcaaaagaacacaggttgaataaacaatggaatgtctacacaaatgagtactgtggagctctaaaagggaatgaggaatagggctataggctatttgggataatgttcggatatatttttaaggtagaaaaagtaagatggagaaaattgtgtgttatattactgcctgtctttgaggggatgcacattcacatacaaatttacttttttaaaaaataaaagttaggttaaatcatttttttaaaaaaatagttactgttccagttatcttttttctttgtataaacagggtctcattctgtcactcaggctggagtgcagtggtgcgatcaaagctcactgtagccttcaccttctgctcaagagatcctcctgccttagccttctgaatagctgagactacaggtgtgcaccgccacacctggctaatttttaatttttctgtagaaattgggtctccctgtgttacccaggttagtcttgaacttctgggctcaagccatcctcccaccttggcctcccaaagtgctgagattataggcataagccaccatgcccagtctatctacttattttgaagcaaattagtgccttaaaatgtcaacaccattttattatcgtctctcacagtgtagggattgtctgggctccgctaggtggatctcagggtttctgatgggcttgcagtcagtggccgaggctggagtcatctggaagtgcgctcgctcatagacctgggtgtggaacagagagacaaacctctgagggttgaggctggaactgctaaggctgccttgacatctctctatggtctctgcagcaccaaggcttacaggtagctgtatgttttacaagttggcctgaggctccaaagatgcctattccaagagagaggctggacaagctgtactaccttttatgacttagtgtcagaaggcacacagtgtcacctttgccacatttctttttttcttggcagataataaggcccacccaggttcaagaaaagtggggcagcaggggaaggggatggactttacctcctagtgagaagatgataaggtctggaagaggaggtatggcaaaaaatattgctgtggccgttactagaatatataatctgacgcagttacctaaagtgaaaagcgtgaaataaaggctgaagagatagggaaaaaaagtacatttaaaaaaaaagttgtttcatgaatttgaaaacaaaatgaaataaaaagcctattctaaaattcaaaagtcagagaaacaattgaacctaagtgtgtactcaagatgctggcataaccacttgataggaactacccctagttattttaaaacgcagttatttgactctgtccattaaagacaattgaaaaccaaaaaccaaaacaactgcaaagggaaatcttaaagtattttcaataatactgcttttggaggtagtgttggtatatttattgttatataaaatatagtataatattgtgtgtattgaaagataaatgtatatgttaatttggagaactagaatattgaagtatgggaggaagaagatgcagatataagaccagcgagattaatttaaaatgctagagaattggaagtgggattatacatatgaatttattaggtgttttatcttagaaattcatgtattctctttctactaaaaagccctagaaacagtgaccaacccaatagcaataaacttccttagcaaatagattatggtcactagtgatcattttctagcaaaagaaaccaagctgtcttgagaaaatgattgagtttatatttgaggcaggaaataaacaagaagaatctgtaaaatcttgtcataccaagaagcagagaggctatgagatgtcattagggtcatgtcatttaaagaagccagtatgagtagctcaaagatgagataatttgagcctcaaaacaaaataagtgatttcaatggatttaaatacactaaatctgtttaaatacataagttcataatgataggggaaaacaaaattatttataggttaccttacaaagatgatagaaaccatctcattattttagaaacggaaaggaaaaaaaaacataaacaactatcctgcctttgttttcagaattccttgtagaaataattaactagtggatgaagagagtttctctttctaggtaataagcaacgaaaaaatggcagaattagaatataatgaatttgcagttcttactaaattaatatatctaggcagtaaccatcaataaaaagaaagaccatatgacatttgtatgtcctgaagtaagttcacaacgccatctagtcttgagccaaaaatactgcacctgaatctgatccagcctccaggatgtatctatttataggaaacacagtggacaggcgaacatgttaaatgacaccacagagatgcaatctgcgaacttccactgtggaaacaatccaaatgattcaacacgatgttgcaaagacaaaagaattatacatgaacaggaggctggatgaattaaaaaacataagagatgtatcaatcataatctttggttctaatttggattctgatttaaaaatagactgcaaaaaaatttgttagaataatatgaacaaagactagatgtttgctgccatttagaaattctcattagtatttgttcagttatgataatgcatgctgcttctgttaaaaaaatacttttaatcttttacagataccttctaaatatttatagatgaaatcatatgatatctagaattttctttaagacaatctgtggaaggggtgagtggatgtgtgctcaggtgagctaatggtagccatgagtttaatattgaggttgagcgatggatacagagaagttcatcatacgaatctctccactttgatgttttcttgaactctccaatactaaaaatttagccaaaaaaattaacaggggcaacgaactttcttctttttccaagggctttttatcgatgattttaagaaaatggtcagacagcgcaggcgtgttttaccttagtccttccaaagcagtaaggtgcacccacttctcagccaccctccctgactttgttttcacaacccgaattcaccaggaaaataccaggagtctgctttgtattgtgccatcttttaaataatgcctcactttctagtagcaaagtacctcattctttttcttgatacttcaaaaaaacaaaatgaaacaagaacttctcattagctgaaagtgtttttatctagtgagaactgaaatcttcttggcttatttcctcttagatctaaacaatattaacttttttttttttttttttcccaaacagagtctccctctgttgccccggctggagtgactgcagtggcacgatcttggctcactgcaacctccacctcctgggttcagggaattctcctgcctcagcctcccaaatagctgggattacaagcatgcaccaccatgcccggctaattttttgtgttattagtagagatggggtttcaccatgttggccaggatggtctcaatttcctgagctcaggtgatccacctgcctcagcctcccacagtgcgaggattacaggcgcaagccactgtgcccagccttaacaatttttttttgtttgtttttgaggcaaactctgactctgacaccaggctggagtgcagtggtgcgatcttggctcactgcaacctctgcctcctgggttcaagtgattcccctgcctcaccctcccaagtagctgggactacacacgcaccccaccacaccgagctaattttttgtatttttttagtagagtcggggtttcaccatgttggccaggatggtcttgatctcctgacctcatgatctgcccacctcagcctcccaaagtgctggaattacaggcttgagccaccgcgtctggcccaacaaatatttttaagatgcattgtctactaacaggagatgcctctgattctgaagtactttgcgataaacagccacacaatagccaaatgaaatcttgaaatcagagggttgctttctcatgaagttagactgcttgagaattgcagtggcttctatatggcaggtgcttaaattgtccaagttgaaattctaatttttataatgagtagggatgagtgcatgaaatggttgtgtgtttttttatttcctacatacaatatcgaattcaatcccaaacttgaagcattgatgtaattgaaacatgttggtaattttaaatcgtgcagttctgtacatgatcagaatcctaatcattattaaaataggtgtttctattatatgcatatgtataaaaagtcctccaaaatgttaaattacctttctcatctcaggaatagagtcccaatcacttccagattgaagcacttacggggggaaaaggcgaagggctccagtaattttaaattgcttcgtacaatgaagagtgcctgtaaattactgaatgtggtaatttgttccataagcttttttgatttgtaagtaacttagtggatttgctggtgaaacagtttggcaggttcctcagataatttagagatattgagcatagacatctaaatgtgattaaaatgtggtattagcagacattgaccacaggaagggtgaggcaggttttcaagttacagcagctagagaagctgagaaagactacagtcgactctcaggggacttgggaaaggtactaagaatgcacaattgagctaattacaggaaaatgccacacggctggctttggaagaattcatccagcccctggcatgttttgcttatcctctgcctgatgataaaataggggttatttctatcagtggacacatttggcccatatcttaattcaggcaacacagccttagccttgttctgctagtgctaattatttttttgaaaaataatactgttaatatagtaaaatgtagttgttggactcttagaaatggataaagtttaggtttgtaatttcccagacagagagagagtggcataagcatcgtgtgaattcccttctaataggatgtcttcatctttactattttgcataataatgtattgtttggccataagagggatttaggtactggatctagaggcattgggtgtctttaaggtatgaaggggtcaagcaaatgtctgccactcacagagtgagggaggtggagccagaggttctgaacaaagaacctcaccaaatgatggggagaggctgtgatgcatttcatgaggcagtgatgatgtgagtcttgggctctgtaagtgagggtgcatagaagagtaggtcccgccctttttaggagtatactgtggactagagtcaatctgtagacaaagctaggctaacttcctactgggcaacgtctgacccctttcatctttgacctcaagaaagtcactattgttggtaaagtgaggaaggacatggaacctctggggagaatctgacctaaaatggcttcataaagattctcagcatgaatgcccttttttacttgatgaaaatagacctgatagtggttgggttatttgagcagaacaataatggtaaagggaaaatagtagtgagatttatggtgtaggatggtcagatgtggtatgagtatgacacggagccagaagtgcctggtcattcactgatttgtcacactaatggagttagaatactctaccttgcaaggcagagtaggagtagagtatccagtcatcctggtttgcccaattctgtcccacttttgacacagagagtctcacactccgggaaacctctcagttctagacaaacagagacagttggtcatcctattatgagaggttagagaggaagcactttctggatgggttgagtctgataggctctgttgtatttgattagacagctttctatgagatcaaggttttcaataccatcacagaaccatttctggagctgtgttgaggaagagagggcaagggttagagaaaagcttgggccgcagcattgcctctgccatgaagactctttacgtctgtttcacacacagtcagcccttcgtatccacaggctccacatctgcggattcaatgaactatggatcaaaagtatcctctggccgagtgtggtggctcacgcctgtaatcccaagactttgggaggccaaggcaaacagatgacttgaggccaggagttcaatactagcctggccaacatagtgaaaccccaattcactaaaaatagaaacctcagctaggagtgttggcgggcacctgtaatcccacctaatcccagctactcaggtggctgaggcatgagaattgcttgatcccgggaggcagaggttgcagtgagatcacaccactgcactccagcctgggcaacagaatgagggcctgtctaaaataaaaataaaaatagatgtgtttgtgtgtgtgtgtgtgtgtatatatatatatgtatacacaaacatatatatatacatatatacacacacacattcaaagaaaaaataatacaaataaaaatacagtacaactattttcatagcatttacattctattaggtattatataagtaatctagaaataatttaaagtatacaggaggatatgtatagattatatgcgaatactatgccattttacatagggtattttggtatttgagaaaaatcctggaatcagtccctcacagataccaagggacaattgtgctaaccttttagataaagtttcatagaccagagacttccacagtgaacacaagattagataccttaggctagagcgatgggttttagaaaaaaggtggacacatggaattcatggatatgaaacaatacattgtccagaagtaagggtggtccatggagactggttggagtggggtgggagaaccttttcttcatcagagtcaagtcattctgggttggcaatatatatacatgagtggactggagagactgaggaggcacaagtcgaggaggaacacatcttttattttgacttaattttctttttatcccctctccttctaccccagggttcttctccgtgtggatcacattaagggagcgtataacctttcataccgcctgactaggatgatggatgtggaaatacacagtttgggagccctgtctgcttgcctgttaagccattgactgttatatactcttgggcttgaaacaccttccaggctggaggggccagtattgcatttacttttatcccatttctgttttcacggctacccaagaggaaataatttgatttggggctgcagggggtagggtggaaaagtgcagtcggaagacagagaaaatcagcaagaagattactgaaagggaaagagggggaaaccaaccagctatatatttcctgcaacatgagttaatgaaattccgttccttcttacacagctgtattcggtttgttttacattgtttggtatgtgaaaggatttggctttgcgttacagaactaattgcttactagatattacatggatatcaaaatactttataaatattaattaatcttcacctaattccctggcaagcacaaataaccagtggcatatttattgaatgtgtaagcaataatctgattcttaaagatttgttttctctgctgaagctttctcatcatttccatttgtcaaaatgcctcatctcctttgaggaccatatcagatggtacttccataacaattgttaggaaaatagtaataaagacgatgtttagagtaaccaacattattatttgctgaactttcttcctttgccaagctcttgagtaaacatttcatagatatatctcatttaatcctacagcagtcctacaataaaaatgttattgttactacttttttttcccccagatgagggagcaaagtttttgaaagctgaatggtggcagggctgggatccatagcccattctgtccacgtgtgaaacttataataaaagccactatcttgccccttttctgattcacactacagggaggacacttggtacttatcaataactccattcatttatctattcaaaaatatgtgtttgaatgcaagtactattagaggtactgtgctaggctctgttatgacatacctggtgttgactcttgagtagggattacagagttgagcatcttttctctcctgagattcatcatggtccccatgggcagtgaacagtgttgttgtcacactatgaaatgggtatagtgcctggcacaatgaccatttcttgaacaaatggggagtgatacagtgaaagtaaaaagaggatctacagtgtcgtttgcttgtgaatggtgaggggtgggagcgcttagaagatgtaaggatgtgctctcttctttcctcacactcatcttatttgtaatgacattaatttgtgttcttacctgctcagtgtcttctcagtttgacatgccatgatggcatggactatgtctgtttcttctagcgcttcatagctgtattgacacatgtttgttgaatagaccaataccttgttttatgcataaaagaaggccagtaaaaatagtcttacatgcatattaccatgaccgtgaaaataatcccaccctgggcatagcctggctcttgtttgaaatgtgtggtacttctatgtgacaagatatagaataagtcattggaagaaaaactgtcctattactatattttatataaaagtgtatcttgtgttataatgggcctggtatacagagggtgcttagcaaatcttccgcagagctgaaactgagctgaagctacggcccccttctctgcttgctctcctttattctctagagtgctgcttcccaatgcgtggtccatggaccaagcagcttcagcatcacctgagcacttgtcagaaatgcagcacctaggcgccgcaccagacctgttgaataggaatctacattttcacaagattccagatgatttgcatacacagtggcatttgagaagcattaatccaggggcttctttgcagtcagtgatggtgatttgccaatcattagcatttcagaaaccccaggccgaaaccatacatttatccttagctaggtcggtatcaagtttctctgctttcatccagaatcctaacaattcagcttggttgattatctaagaagcttctatttgataattatatatctttcattttttttaaagtgctgggggttgggagatcctgggaaatggcataactattgcttaataaatgcagtttgcttggaagaccaaaatctttcaagtaatgagaagcagcaaaggaaacaactccaacaatgacacaaagatttcctgacaataaaggggctgaggtgaggaccccagctgtggaccacactacccgaagagaaccaacaaccaaatcaatatccaaaaaataacaataacgtccaggtcatttcacttatgagacagaagaggtaaaacaaattctcagatacaaatatttctgctgctccacattgttccatggggccaggattgtgaagtcaatcttcctaatgattaatggaatttctcaccttttgttcaaatgacttggcccctttggtttttaaatgacatctaagggcaaaacagacccaagactttgtggaatgactttccaggaaacaaccatatctaggtaaacccatgctcacaggttccctctgttaatggtgaaattacatcaaggatgaccttttgaaagaataaaactcattatcacatggaatatgatagctgtaaaagagcaacgcttggaagccaaagcaaagtcccgcatatgataaattaattagaatagaagttacataaaacctcgaccttctgtgtgacccttatcttataattacctcttctttaaaagcagaatgaaatattttatgtatgaagatgttactgttgaccctaaatgcattaagagtcaaggagacatttttcacgtattgaaaataagatttgattgagtgcttgcaagtggcctagtgaaatctcattaaaccactgtttaatactttataaatggcagaatattaaccattaattatgaacatgaaaccagtttgaaaataagttttgcaatatctaagcttgattttcaacccttattaatgcattgtctttttcatagttttcagtgttttacagcaagtaggtacttacgacttaggtgtgacttttcatctcttcttcctcctcctccttctctccttcctccttctcatcctccttattgtgttgctctaccaacatggttgtaaaaatctggatgaaaataagaaaatacagtctattaaacatagttataggctgtcactatccacagttataattagatttataaatcatgtgcaagattcccagcaaaaaaaaaaaaatgaatcttaaacattcttttcaactattatcaccccaaaatgaaacaaaacaaaatatagcaacgatatgaaattgtttcagtaacattgccatgttacagtaagcttttgcatctggatcagtcagcctggtacaaataactgtatattctgaaatgtaaatagataaaaagataatgaccttcttgagcatctactgggtgacaatcgttgaaatagtatctgaatttaactgcaccaaggaacataggcagattttgattcagatgacagcttccattatttggcagcagatgcttaagaggctgctttgggaggattctgatgttggatccagcctacatcatagaactgcagccatggattagcaatatgtgttatgtgagtgagctgcaaaaatatgccacaaaattcccatcttacagttatacctttttaccctgaaatgagtcagtgtgttatggtaacattcccagatggcagacagaaggagagccaatgtgagagaccagtgaactcagacccgtctcccaagagccttgtgtaagtcatctaaaaaacaaatgtttcggatattcagggttttctgatttcaaatgtgttcataccatgaataattgtgtagcactatcttactgtgtgctgaggacattaatgtgcttcttctttcatccttcgaatgatcctgcaaaataattctcactgacattttcgtggaggtatccaacttcagctcttatggaaaagaaagtgcctctgtggaagttgcatagatagtaaattgtggcgtggggactcaaagccaggtttgcttgacttcacagtctaaattcaacccaggaacccaacagcctgttgctgtgtgattctgatccccatgaattcactatgttgtcaaatgctgagtttgcaaagcatggtctgagtgcttcccttctggacctcccttaaccattccagggctttccattgcttgtgcagttaatgaagatggaaaatgattcccttccctcccgctctgttcttccatctgtccaggtaatagcctaatgtcaacctagtgacttcatggcatctgttttcaatctactgcctccttgtctggaattctcaggggacacttaagccagaactggggttgaaggaagccctggctctgtgcaagtccacagtacagcagctactggggagggaaaacggtgtgtggctacgctgagggtttcttcctggttgatgcgattataatgtgaaaagatcgacatgtgagcccagagcagatgcataataatgctactgcattttgtatttaacaaaacccctttctcgagaaatgtattacttaccttgtgggtggggaattgtctctgaacccaatcaggttagtcactggcccatgactatctcatttttaataaataataattttctcaattcagcgctagccagctcatctgctttcaaaagataagatatgattgctttgtattttttatattaataaccctcagcatgagaggattaactcttgatgcactaaaggcaaactaccggaccctgggagatccatttcttctcaccagataggctgacacatctttcagatgaatttaaaggtcaacgccttgtgcatgaaaagcaggggcctgcattagatggctgagctctagtcaattcttggtcatttgtactgaaacagaggcaagagagagatttcaaaaccaccacgaggaggcccctaaacatgcaggcatttctttcctttatctgtcgattcaaagagcatctattcagggccaagaaggagatcaggtttatctgacttagtcatacagccataagaaagtttccccctctaaaaaaaagaaaagagaaaaaataaagaggtgccttccattggtgaagcgtagtcattcagaacacaagctttgcagccacccacagcccacagcccacagcccacagccactgtgggtcgagttatactttgcctcttagcagctgaccagctttgggtctgagcctgtttcttcacagtggtcagcccccttgtctgcctgataaatgtctgtctgctcacgcacttggctccgcagaagtgagcttgctgggtccatggggatattcactggagattttgcacaatattatgctctggaaaggggtctgcaaactctgatctgagggccaaatccagcctgccacttgtgtgtggacaactagcaagctaaaatggtttttacatttttaagtggttgcatcttaaatgcttatataatggctacataaaatccttaattttgcctcttggcccacaaaacctaacatatttactactggctctttaagaaaatgtttgctcaggcctgctctggagtcctcaaagccacatatataattttaaattttctgatagctctgctaaaagaagtaaaaagaaacaggtgacgttaattgtagtgtgttttctttaacccaatatattcaagtagtatccctgcaacgtgtaggtaatatagaaattgcgaatgaaatattttacattcttttttcataccacgtctttaaaatccagtgtgcattttgcacttaacagcacctcttaatttggactcaccacatttcaggggtttaacaggcacatgtgaccggtggctgccgcattggacagtggcagctctagagagctggaaccaatttatgctccttctgacattcacagggaatgctccgtataaatcttggtctcttcttcctttttaaggtcacatagcacctggatttaaactccaaagctaccccaattttagctggagggaccatattccaagctgcaaatattgtacccacccagcaaatttcctgggatgtgcttcctggggaaagtgaattcagttgctgtagcccttgatttgataaaatgctcctctttctggccttacccttgctcaatcatttccaattccgctgctggttatttaacacgccaggggcagtaggtgcatacagtcctatgctcccagcttatgaggaaatgctctgtccctccacaggcttgatcagcggcctccctgctcctgttctctagatagaagtttccctagttttgctggtctcaactcatgcacaggaggaagccagaagtgccctgctgtgatgatcaatccatatgcatgtttgcctccagcaaaccaaggacatttaattcttggccagagtctcatcagctccatcagtctatgacaataaaatgaatgtatgtcttgatcacaccaggaagtctctgctaccaacacccccaggagaaaacagctccaggctcttgaggctcctcaagtagcaaagtctcatcgctcaggtctcgcatgtcagaatttgccatgattcactcacagcatgtgtcatgtgtatctggtagaatgtctgaaatgcattcttcccatatggcttttcagggccctaagtgtgaatatgaactttgcatgtgaaagatgcttcattttgcattttgtttgcttgtttttgtttttttgagatggagtttcactcttgttgcccagactggagtgcattggcgcccaggctggagtgcagtggcgcgatctcggctcactgcaacctccacctcctgggttcaagcgattctcctcccttagcttcccaagtagctgggattacaggtgcccaccaccacgcccagttatttttctgtatttttagtagagactgggtttcgccatgttaagcaggctggtcttgaactcctgacctcaggtgatccacccgccttggcctcccaaagtgctaggattacaggcatgagccgctgtgcctggccaagacgtaattattaaaattaacaatgttcatctcagtatactgcctaaaattacgtgatatgccaaagtgggtgtatgtatcccactttgaggaatactgatgagaaaggatgttaggcctacagagatcttcatcttcagaagagcacagataagttctggtataatggaaatgacagcgtcttggcattttttactgctgccttcaaacagcagacatcacagcccacgatgatgagcctgctgatgccgacttcctgcattctgtggtacacctgggctcagcttagaaaggctctaccccaactcatacttcttcatggcaagatgaggtgaattcatttctacccatagtcattctaatctgcattttcataacccacctttccattctccaagtgtgactttcatttttaggacagagttattcagtcggtgaatatgcagtccctttaaagggatatttatcacccttgaagaatcttattgccaaatcttaatagtctttcttataacaaaggctcaaattcactatcaagattaagaggtggagcttgaatgagctttgctggagcatctcatgataaaatagattaaagtcttaaaatgggcaacccatcgaggtggaagtcaaacaaatatgcaaaagcgtccctgtattttcctcaggcagtttgggcactgtgggtgagcccagagggtgaatggtgggaagtgggagttaggccacgtggattttccctcaggctcagcggggtgacctcccatgagaagctgaaactatcttaattactttgtctgtaaaatagtggtggtgagcatggggagagcttgcctacctcagaggcttgtggtgaggattacggggaaaagtccatgtaaagtgctcccccctggtttctggcacagaacaaatgaatgaaattcagatccatcatttatgtcagaggtccccaagaccacccccaggttccttgatccccaagtcctaggaagtcctagagtccccaaggccacccccagtttccttgatccccaaggaggactcatggttaagatttattacggtgaaaatatacaaaatgaaatcagcaaagggcaaaggcctgtgagcgaagtccggaggaaatcagttacaagatttccacaatcccctcccaatgcagtcacacaggatgtgcttaactcccccaagcaacatatggtgacaccgtgtgtgaaatggtttctacgagggaagctcactggaggctcagtgcccgagtttttactgggagctcatcgagctggtcacgtagacagcctctgcctgatacatagcaacattcctgactcccggaagaaaagcaagagttcagcataaaccgaatagttcatacaaacatgaggcacttggagccactcttaccagttatgggcatgggaatactctccaaacccaagttcccagatgccagccaagggccagcctttcaggcaggcctttccaacattgcagtctgcaatctgcttcgtaactcttttctgcccaggactagaggtcataaggcccctactaactctctggcttcatccccagtactacctgttaaccaacctgacattcctcccatcaccccgcagatcctggccccaaagccttaccttggtgctagcagctgcctctgttttgaaagctcttcccctgagttctccatgaccaagtcctcacccttttcattgcagatgcttgcgtgttcccatcactgagttctaatttctctaatggaagtatcattctaaagttatcctttgtccttcttttattcttgttcatgggtatctccactagaaggaggatatatttttctggcagaagaacatgcccgtcctatttattgtgttatcactagtgtccactatagggatggacaggtggtaggtgttcaatatttgcctcatggatattgggaattactatatttattgttctgtgtcccaaagaacaaatgaagcccccacacccttcctgtttattgacttaaagtattgtctttgaatgttgaaaaaagtttttagaaaatgctgaacttacagggaaattcaccaaagtaatagtaatatcatgaagatgctcattgcttctgggctttccaaatctcatctttcctcaattgtgccttctctgcatgagcctaatttgaaaaaaacctggttcacagagggctgcttaagaagttgatggttttgtttatactcaaagtcattgtggggacctctattttcaccttttttggcctaggttgtcccagtacttctctcattctgtgattgatgtcatacgtgacaagtgtgatgggtcacttcactggcctctccaggcggtttattctttagctgacttcaccttgctctggccttatgtaaaggtccctgccctctggcttttagtgggttcaacccacaagtctgcaaactttctcaaagagccagataataaattttcagacattgcaggccatccagtctctgggcagctacactactctactctgccattgtagcatgaaagcagacatacacaataggtaaaccaatgagcatggttgtgttccaataaaactttatttacaaaaactgacaataggctaagatgtggcccgtgggctttggtttgccaatcaatggtttagccagtggaggattgggacaagaactcagagggagagaggagaataaatctttgcaggctgctctgtccttccattgggggttacagttcttctcagggagccccctccatgtggccgcgtcttttgggtctggaaattgtttcctcccctggccctctaggcttagatgtgggaaaggtgccccattattactggcatgttgctttatgctgtgggccccttttccttgactctgactgtacttttgctggttcctgcgtccatctcttgtcacatagctcaatttgcgtgtgccatcaatttcctgctgggattaagatacctggcagtgcagggtttcctgggatatgggacctctaaaaccgaaacctagacagtcccagtaaatcaggaggattaatctccctaactggaacccagccctgtctcctcccttggccctgctccaattaccttcattctggccctcagtacccccaacttggataacggctttgctggccagtgactaaatacagtggccagatggggtctgtggccatcgccatgtgcacctctctgctagggcttatttgcccttggaacaaagtctgtagctgatgtttgacaagccaaggagactctagtgtagtcccccagcctactgtagaggctcttcacattatcatattttatactgcataatttttgaagatgatcccttttcttccaaattgtagtacaggagaggtatgctatttttccataagaaaaatcagacttactttgaaagagcagtaggattagcagacactttgaaatattacattaatccagcttgggttgaaaatatccaaaggactgactcatgaaatttcaagtaattgaacttctggactcaaacagacatgagaagaaaaagttatgttccttcaaactatttcagctcagatgattttttcctttttagttcaaaacctgacaaaggtttgcttgatgaggagaagagaccaccttccccacaatgaaagttaacgctataatgataataggagggcttatgactgaatctgtattcagatacaccgattttgtttgcttttagtggcaagcaggtttagcaggttagagaagagggtaatgttttgatactgtggtgaagctgaggagggcgatgtccttagtctgaggagaccagcatgaagccacctttattgccctaaaatgtctctgccttcaaacaagtgggctaaagagggagggcctgatgctctgaaaaggaaaaaaaaaaaaaaacttggccgggtgcagtggctcacacctgtaatcccagcactttgggaggcccaggtggacagatcatttgaggtcaggactttgagaccagcctgaccaacatggtgaaacctcgtctctactaaaaacacgaaagaaacagccaggtatggtggcacgtgcctgtaaccccagctacttgggtggctgaggcaggagaatcgcttaaactagggaggcggaggttgcagtgagctgagaccaccccactgcactgcagcctgggtgatggagtgagaatccatctcaaaaaaaaaaaaaaaaaagaaaaaaacttgcataatggagcaggctaattcaggttcccaggatctagatgacagtaaatatggaagctgctttaaggagatactggagacattttaatggtgttggccgtttcattgtaacacaaatgacttctctgcagctgttcaaggaagactcttttcctatgagtgttggtagatgaagagtggaaactcaggtgcttggcaaggtcagaaagttagtgtcaatgagtgaggaggcttgggtagaagaaaagtctgtatgaagacataagtacaaaccaaaaatcacttttagttgactatgaggcaaacagcagtgcaactgtgatgacagaaggcaaatggtacttgctggggacacatgggatgcatggcctgtggacatctagaaatgaggcctgtccatcaggaggtcaaccttaccatccacggagtgttgccctgtttgactccaagctcaaagctgtcccaaatccagatgctcggtgaaaatccctgatatttgaatggcagcctctgcaagctaaaggccatctagcagatacagtggccatatgggacgtgccagccatgattttttgcagcctctctgttagtgcttgcttgcccttggaacaaagcctgtggctggtgtttaactatcatgggagatactagtgtggctgaaaagtctgtgttctgaacagtactatggcactatagacaaactttcaaggtcaaattgattatcctgtagtttagcaaagcagcagctccctaattatgtcaggaggcaggattatctctgatcatttgagctaggactccagataaaacatcaaaagcaatatttaaataacacacagccatggttaaggattcattgcattttctcttactataaaaccaaaattgtggtggcccattttgttccattactggaagggttttccaggctgttttaactcatacatagtgtaaccctttcccttattacaaaatttcactctgggaaagagcaaagctgtactttgtggtacagtgttatgatggtttatgttcatgaaggtcctacaaaaattcagaaacattcttaatccaaatgatctagaaataggaactggaatacctactgtgctggagctgcttaacccatgaaagacagttgtacacagctcttcacaactccgtattcagtgatttcacattagtagcttgaaattagccatgatgggagcatttatgccctggacattgtcaaaactcagaaatcaagtcatttatttcttggggagctggtcattaaacactcactaggatgcccttgggtacccctcactgctagaagaattccctccctccctgtatttctcccttgaaatctgagccagtcttgcattctacatatatatatatatatatatgtatatatatatatatatatatatatacacatatatatatatatatatatatacacacacacacatatatatacacatatatgtatacacacacattcctatcttctcaaaaattcttgccttttaaaaagttgttatcaaagacaaggaattttttaatcatcagggtagctcagtcttgagacatctgagtccttctgagtagtaaccagtagctgcaccgaagagacagttcaaggactacaaatgatggtagtccttgaatttcaagtccttgggagttcaaggcctatcctcatttgtagttcttcacactgtaccactctttatttgtttaaaatataagagtgcacaggcaaaaatcagctaaatgggagttgtccagaacagtgctttctccagtgaccttactcacccctccatgaggactcagttaattctaatctctattttgctgtttctatgaggtcagaagtccccaactttttggcactaggactggtttcatggaagacaattttcccatgtaccagggacatgggggaggggaggatttggggatgattcaagcacattacatttatcgtacacttaatttctattattattaccttatataatgaaatagttatacaactcaccagagtgtagaatcagtgggagccctgaacttgttttcctgcaactagacagtctcatctagggtgatgggagacagtgacagatcatcaggcattagattttctgaaggagcatgcaacctagatccgttacatgtgtggttcacaaagcacctataagactctaatgttattgctggtctaacagaggtggagctcaggtggtaatgcaagtgctggggagcagctataaatacagacgcagctccactcatgggcccgccactcacctcttgctatgtggtccggttcctaaaaggctgcagatggatacccatccatggcctggggattgggcatccttgtattagattactaactccacccttaaactttttaagttgtgttttcaaagaaggtatcagcatgtcagtctttcctataatgttctgtgtttcttgaagatagggaccttgcctttttgtgtatattgacaattagtgtatattgtcttggcactgacacacagtaggcagtcagtagatgttacttgcatcaatgcatgagtccttcagaatacatccaattggcattcagtgagcagttgttcaaattccttttaattcaggatggtcaaatgtttgtatgaacatttggggaaacatcttaactgtctaccaggcagttagattttaaagaaaagacatgtattcatatactccgacccaggggaagatatgtggcattctgcttaacataatcagttccttgctttccacaccaatttgtgcttgatttgtttcttttcttctagaacttttcagagtgagaacctttagcagaaaaaaaaagcttaacaagatagacattttagttcaatagaagaatttttctggtgtgaaaaagtaaattacaaaaaggactttggttctgaaagataattaataaaaaccttcccatgtgatgacaaatctgacatcttgtctaatgtctggcagagaagaaagtgttgagagctgcacagttggaataaaatgttccactttacagcaaggccgggtaggatctgataattatttctaggcaacaaaagttcatagtctaattgttcaattgacacaacaccaggcctggctctgtgactatgcaccatcagtgaggtcttcgtttaggctttcctgatttcacaggtaaatattgccaggaatgtgggtgatcatggaatgactccctcgtggatattttggactacagctgtacttatagaactttcctttccctcttgtaagcttctcatgggctgtggtaggctgagtaatggtcccgtaataagtctacatcctcattttcagaatgtgtcaaggttacctgtatgacccagatgagtatgatgtaatcacaagcttacagaagggaagtaggaggagccagagttagaaacagaagacgatgtgatgaaggaagagagacagagaaaaacaggtgagaagaggccatgctgctggcttgaatgaagaaggaggctgtgaactaaaggatgtagatgacctagctggagaaaacacattctcctgaaggagttcagccctgtggcttcagactttagaactataaggtaataaaactctgggaggctgaggcaggcggatcacaaggtcaggaggtcaagaccatcctggctaacatggttaaaccgcctctctactaaaaatacaaaaaattagccgggcgtggtggcgggcgcctgtagtcccagctactcgggaggctgaggcaggagaatggcgtgaacccgggaggcggagtttgcagtgagccgagatcgcgccactgcactccagcctgggcgacagtgtgacactctgtctcggaaaaagaaaaaaaaaagaactataaggtaataaagtattttttttttttttttttgagacagagtctcgctctgtcacccaggctggagtgcggtgatgctatctcggctcactgtaagctccgcctcccgggttcacgctattctcctgcctcagcctcctgagtatctgggactacaggcgcccgccaccaagccctgctaatttttatttttattttttttttgtatctttagtggagatggaatttcaccgcgttagccagaatggtcttgatctcctgactttgtgatccgcctgcctcagtcccccaaagtgctgggattacaggcgtgaggcaccgcacctggccaataaagtatttttaagcctctcagattttagaactttgttacagcagcattatgaaattgatacacgcgggcatgttttcctgaaatcagagcctgagaggagaaccaggtacaggtagttttctttgggaggtgatccaggaagcaggagtaaggaaggatgagaaggcaggaaaggagagagaaccaatatattaaggaatccttgagctcactgctgtagacagccaggggccagtgcacagggacctcgagaggcacagggaatgactctcagacgtgtctgtctgcaagaaggcaggtgggagcattcagccagctgtcatttccaatgcactgagggctgtccataggagcattaactccccctcctttcccatctctgctttccctcacattagccaagctcctgcagtgtaggagaaagagccaaagcagaatgcaaagagactgagggcactctaaggggcaagcctgacttctttagaaactcatcgcagcagcaactgagatcagaggttggctgaggtattggctgcagccaccagcatcatcctctattgggctgacccctcagatgacagacctattcatttactgtttcccatcttttgtctctgtggattcaaggtttcttggtgtagaccagacaaggttcccagtgcctgccacatggtaggcattcattattttctcatttgaactccctgaggctactaaggcccacccaagagtacctcatataggggctcctttgtttgacttaagggaaacaggtattatatggcattcgacatcactaatttaattacaaaaaattcataaatagatgcaaataccaccaaccctgagcaggcacatcctctggtttctcctaagggccagccagcaagccaggcattcccagtgtagtaacttaaattcttacaaaactgtatttttccttttaagttttccaagtgagcccagtggcttaatcctggaatcttaatagtaaagagttaattccatttagacaaaaattgtgatttcactgagtgaattgttcttggctctgttttatccaaactgaaggagggcatgcatgagtcctattttgagacaaaacaccttcaaataatctggaaaacaacccagagtttatttctgccaaatggctccctgtttcttgaactggcatgctatggtgtttgcattgaccaaacttctgcgtggagcctttgttcttagaggttgtcatgtgaaaagtttcaatcatctttctaatatgtccttgtctgtgacatggtcccagtccttattttcatccaaagagcatgttgttccttcttctttatttccacaatactttatacataccctctatattaatataactataatattaatgtatacttattatataagaaatatatatcagctatcaatataaataataactagcacataacacctactgtgagccagtttctgtcctgaaacatttgatttgtgtttactcattgactcatacaaccaatgggagtagacacaattattagttgtgttttgcagatgaggaaactaaggcaaagagaatttaagtaacttgctcagggtcacatagaaactaactggaaaaattgagatttcgacccagttagtctagcctgcgaatctttactctgagctactttttaactgattctcaatgtatagtcacataggttgtagtttattatatgtccatgtgtctgtctttccttctagataataagttttttaagggttttattcatttttccatctctagtatctaggccagagcctggcagataatagaaatgttaaattttcactaagaaaatcaattttaaaatgaacctgatgatgctgtcataatggcagatcaaaatgtcccataatttgaaagaggcaattactaaaacaatagcaaaaaataaaataaaacaaaataaaataaaaaatgagagacaatgcttatttatgccaaggagaggagcacttaggacactcattgccacatcctgactctgacagccttgtcaaagcattccaaagccatgaccttcccttattctcccttccttccccacctcgccttcaaattccctctcctattcctttctaactcctctattttgccctcttcattggttttcccaaattatatttacatgttaaaataccaagtaaagggaacccatattttctgagtgtctattgtggggccaggctatagtagactgcattagttcccaatggctgctgtaacaaatgaccacaaatttagcaatttaaaacgaacatagtattgtacagttttgaatgtcagaagttcaaaatgggcttcactggactaaaatcaaggtgttggcagcgatgcattcttttctggagtctcatggggagaattccctttatgccatctccagtttctaggggccacccacattccttgactcctggccccttcctccatcttcaaagtcagcaatgtggggctgagttcatctcataacatatcactctgccctcaccttcatcatcacatctctttctcttatcctttcttccattttcaaagatacctgtgattacattgggtttacgtgattacataatccaggataagcatgctgttttaatgttagctgattcccaaccttaattaccctttgccatgtaatctaacatattcacaggtcctggggagtagggtgaggacatctttaggggactactgtctattctgtttgcgttatctcattaaagcttcccagtgaccgtttctctagcaaagagcatgtgaaggccattcactctgaattaatttaccaaaagccagagaaatcaccacacagccagaatttggacttaggttagttttggctttttgccccatgcttttccttgttttattgttttcttgtgcttcacttttttttttttttgtacttcacagatactgtatgttttacaaattgaagatttgtggtgttgaagtcaaaataaaaatgtagagatgaatctctaaatttagcatttcatttgggaagaaagacttgcaatttggggcatttatgcagattaaatagtctttggtatgttcaaagaacaaagagaaagttggaggttttgtaacaatgaaaaatgttatgtattgctctttgagaaagttcattgacactagtaaggttctgggaagctggcaagcttcagctggtgagtggcatcagtgagaaaattagtcctggagttgcagcaaattatcttgaagctatagataaaactgggttcaggttacagcagccaggcttgcagagaattacattgttggagcaatgctttgtgtccctagtgtgtttttgcctggcttcttgactttgctttagttgggtatgacaagaataacccaatttgtaggatcagctttcaccttgacaactctgcactgagcaagtttatgggtgctgtttttccaacagtatgtgatcactttgtgtctctgtctcatgttttgataattctcccggtttctttcctttttttaaattattactttgtctattttggtgatgtctgatcagtgacctttgatgttactattgtgatttttttttttttgggtggggggaggcaccacaaactgtgcccatataagatgccaaacttaattgataagtgcgtgttctgactgttccaccaactggccctttactcatctgtctccttctcctccaaacatcctatttcctgaaacacagcaatattgaagttaggccaatgaataagcctacaataaagtactttctttgcctctaagtgttcaagagaaaggaggagttgcatgtctctctctttaaatcaaacctagaaatgattaagctaagtgaggaaggcatgtcaaaagctgaggtaggctgaaagctaggtttcttgtgccaaagagtaaagttgtgaatgcaaaggaagagttcctgaaggaaactaaaggtgctactccactgaacatatgaatgataagaaagtaagacagccttattgctgacatggagaaagttttagtggtctgaatagatgatcaaaccagccgcaacgttccctcaaaccaaagcctaatcctgagcaaggccttaactctattcaattttctgaaggctgagaggtgaagaagctgcaggagaaaagttggaagctagcagaggttagtgtgtgacatttaagtaaagaaacgatccctataacataaaagtgtcaggtgaaagccaagcacagtggctcacacctgtgattccagcactttcggagaccaaagcaggtggatcacgaggtcaggagagcaacaccatcctggtcaacatggtgaagccctgtctctactaaaactacaaaaattagctgggtgtggtggcacgtacctgtaataccagctactcgggaggccaaggcaggagaatcggttgaaccagggagtaggaggtttcagtgagctgagatcacaccactgcactccagcctggtgacagagtgagactccgtctcaaaaaaataaataaataaaataaagtgtgaggtgaagcaggaagtgctgatatagaagctgcagcaagtcatccagaagatctagctaagatcattgatgaaggcggatacattaaataatacattttctacatggttaaaacattcttatactggatgaagatcccatctaggactttcatagctagagagaagaagtaaaggacaagcaaactcttttgtctgggactaatgcaactgatgactttaagttgaagccaatgcttattcaccattgcaaacatcttagggcccttaagaattgtgctgaatctactctgcgtgtgctctacaaaaggaacaacaaagcctggatgacagtacatctgtttacaacatgatttattcaatattttaagcccactattgagaactgctgctcagaaaactatattcccttcaaatcttactgttcattgacaatgtacctggacatccaaaagttttaatggaggtatataaggagattagtgttgttttcacacctgctaatataatttccatttttcagcccgtgaatccagaagaaatattgactttcaagtcttactatcaaagaaatacattttgtaaggctacagcttctaaagattgtgattcctctgatggatcaggacaaaatgagtcaaaaacctgctgaaaaggattcaccattctagatgcccactaagaacatttgtgattcatggggggtggttaaaatgtcaaaaataacaggagtttagaagatgttgatttcaatcctcatggatgattttgagaggttcaagacttcagtggaggaaggaagtgcagaagtggtcgaaatagcaagagaactagaattagaagcagagcttgaatatgtgtgtgaattgctgcaagctcatgataaaaatgtgaatggatgaggagctgcttcttatggatgagctaagaaagtggtttcttgagatggaatctaatcctggtgaagatgctgtaaacattgttgaaaagacaataaaggatttagaatcgtacctaaacttagttgataaagcagcagcagggtttgagaggactgctttctattttgaaaaaaaagttctcctgtgggttagatgctaccaaatagcatcacatgctatagagaaatcattcgtgaaaggaagagtcgatagattggcaaacctcgttgttttcttattttaagaaattgccacagcctccccaaccttcacaaccgccaccctcatcactcagcagccaccaaaatggaggcaagaccctcaccagcaaaaagacaaccacttgttgaaggctcagagatcattagcattttttagtaaaaacgtatttttaaattaaggtatgtacattgtttttagaaataatgctattgcatacttaataggctacattatagtataaacataacttttatatgcactgggaagccaaaaagttcatgtgactcactttattgtaatatttgttttattgctatggtctggaaccgaacctgcagtatctccgagggatgcctgtacatgcagcttccctgtttacagtttgaggagaatatgttgggtagcatcttttagaaataaagtctaggatgttggttcaaattttgtgtgaaagcaacaatagggccaggtacggtggctcatgcctgtaatcctagccctttgggaggctgaggcgggcgaatcgcaaggtcaggagttcgagaccagcctggccaacatggtgaaaccccgtcactactaaaaatacaaaaaattagctgggcatagtggcggatgcctgtaatcccagctactcgggagactgagtctggagaattgcttgaaccctggaggcggagggtgcagtgagccaagattgcacctctgcactccagcctgggtgacagagtgagatttcgtctcaaaaaaaaaataaaaagaaaaagaaaaagaaaaaagaaagcaacaatgggaccgacgaaactaaaagcagtctccccttttacctccccaagaactgtaaaaccatttgtaagtgtctgtgaccttaatgaccagaaacgtgtcaggttttctgtgttcctggggctgtaaaacaccaggaacattttaaggaggtcagactcagcaggggcgtggacatgagtacatgcacatgtgtgtacgtgtgtgtgtgtgtgtgtgtgtgtgcatgcacatgtcctggaatgctccattcctccatgctttccctgtaggcagtatgcctttgtaaacccttccaggactctgggtttgtgctccctgggaggataaagaattaatcaaaatacactgctgcgatatttttacatcctgcaagtcagaggcagtatcctttcttcctcacaaatctaagaccctccaaattgatctcaatacactgactttaacaagagtaaaccagagatgttttatggcagggataaagtaactatcaaccaacactaatgacaagaaagcaaaaagagttggagagaggaaagcataaaggatcccagagacactggggtgttggtttggaaaataccttcttggagctggtttaagaggggatggaacctgagagtgttctcaacctcgtgagattaattatttgtggcaggaagtttctctctttatttgtggctgctttggagacagttgtgtcatgtttttcttcagtcctgatatttttcactggcctctgggatatatctgtgatgtcagtggtatcaaagacttttctgcccttgttccatggatgtttagtgtacaatcagctgctgcaacaaacaacaccaaatctcagtgactttgcacagcgttccgtggatgtgtcttgtggggcggttctcccgagtaactgtcttctgtgcaatgactgattctgggctctttctattggatgactctgccaccttgggagtccttccttcctatttccatggataggagaagagaagatatcatgcaggacattcaggggccatgtctagaagacgtgagaatccttccacccttattctgttggccagtgcttagtcacatgtctaaaattgtaatggagcagcagcaccatgtcctattgtgagaagtagccagagactaatctcaatgacagttcttatagcttgaaaaggtatttgcaaaatctaaagcaaaagttgccaactcgaatgcctagatgtccaagcaagtgtttaactgaattgagtgagcagaaacaagaaccagggagtggtgctgagaaggaaagcttggagaggggcactctacataacatgacaatttaacttgatgacagacttctctggctaaactaaccacatctgctggccacatccatcccttatgctgccagttggcaacctacagtatgggagagaaaaagaaaaaatcctttctctggaagcaaactccaaagttgggtatattcttgaatcagtacctgtcaggataaaaaaaaaccctttctttttaagaaagaacgaaagttctgtactacagcaaataaatggaagctaaaaagaaaacctggtataaagagtgtgatttaagaatttgctttctgtgcatacatttagggtagtggctcttgcatggaagagagatctctgagctgctactttaaaggatgcttggtgtcctacagaggtaacacaactcaatcatatcaggcactgatgttctgatggtgcagctgatcctgagatgcaaacaccccatgatcttctgctgtctgattccctgctatgtccctgtatgtagtctaaacagtctattcactgaacagttttttagtaacaacaaaagtaataatatgttggtaatagtttgtcaatgtctaccctggagaatatcagtgaatcatgaatatggatttaaatataatacatagaaataataatagcaagcatttattgagcaagtactatgtaccaggaactacttaaggctctttacaataattaactcacttaatcctcataacgggtgagataccattactcctgcttttcagcttagaaaactgagacacagaaggttacttgcccaaggatagcccgctggtaaacgagattcacactgaaccaacgtggcttaaacctgtgcttatagtccgtctgaaacgtgaatctttgtagcaggctgatggtaatttttagataatagaaatcttttgttaatcatagaatttgattattgctgtgctttcaaaggtgtcttggttacctctcatttcttaggtactcactgatgcataaatggacaaacatgtcatagagtaagactatgattgccgtggcattaaagataaatttggaatgatgctcagagcatatattctagaaaatttacagaggatttggggaaaactatgtccaggtagtatttttatgcatgtgacatctcataatattggagaaagggcttgcctggttttggagtaatgtccaagttctaattcttacagcaatgaggggtgctgctttactgctttccatccccttaccaaagttactgtgaatgaaattgaagagcggatatcggtggcaagttcaagcatagatactgttttgaattctcttaagaaattaaagggcaaggctgggcttggtggcttatgcctgtaatcctagaactttgggaggccgaggcaggcggatcacgaggtcaggatatcgagaccaccctggccaacatgttgaaactctgtatctactaaaaaaatacagaaaattagctaggcgtggtggctggcacctgcagtcacagctacttgggaggctgaggcaggagaatggcatgaaaccaggaggcggggcttgcagtgagccaagatcgtgccactgcactccaacctgggtgacagagcaaggctctgtctcaaaaaaaaaaaaaaaaacagtaaaaagaaatcagaagacaatagcagtaactagaacattctactattattgactagtaagatatttagcttttggggaagtcctaaattagcctggaatcatttttaaatgcagttttgtaatttcagtgatgtgttacatgaaactcaaagagccacaaaataattcacgtgtaagcgaagagtgtgctggtttaaaagatgagtctgcattcttctccctttatgcagataattcgtaatcatctttgagatcccagcagaaatgtctcttttgtggttttgctttccttgatgctctagatgaagttagacttccctataccccaacttttacatgctcccagagagatctatattttcctttccagttaaattttaatcttggtgaatcacttaaattatgatttgttaatgcctcttttctttttgagaccataattatatttaacaattattgactccttatcctgtgtggcacctttctcattgctttggacaatgtgtagcaaagtcctcactgaatcccaggagtctaataggtatttgtgaatgaggagtgagtgaatgaatgaatgatttgactaattcttacctcactaagtcacccatggcccaggagggtactgtgtacctttatgttacaaatcatttaactttaattttgactggtaggtgaagtgtcccaagaatttgtaaagataaaactgtgcctttggggcttctcctactgctcccctcttccctaagagtcagcagctggaaaaggtttatttattttttttattttgtaactgtagaggaatcctgaatgggccctgcaaagtaatctcagagattgagccacacatagacaaagatggagaacacagctcacctgcagagtgctgtttctcatcactaactgtggtttctctcagtcctgactttttatgctgaggattctgggagaaatttcaccttctttacttcctacaggatatccagtttcctggtctgggagctgagagcagaattagccaattggaaggttaacgcataattgtaggcactgggtgtatggaggagacccttgaccatttgctatttaactgaattaatgttggccagttatagattttctgtttgcaaaattgccagcagatttttctgactcctggatctgcatcctgtgtatgtgccacttgggatgccagcattttgattgcttccagagcgatctaaccagagcctgctctcaagacaagggaatccatgattcacaagcggaaccgtacagatgccagaccacagcgttcttttcactttgatttgagggagatgatgttggtcagggtgatgactcccccatttcaatttctctgatgttgttcaggccagccacacggtgaacctcctgagattgattcttgctcccttctttggggttcagtgcatttcagagggctggtatttagagagaagccctggttccacagcttccaaccttttgacactgctttgagttctctggtggggatgataatgaattttcttcaactgtctgtgtgcagtggttaggattttgaggtctgatattgaagttttgttttctaagaaacacacagagtcgaggatttgagtgcaagtaatttgagtgatggcagaaattggtttaagaaaaatactagctggggccgggcacggtggctcacacctgtaatcccagcactttgggaggccgaggtgggtggatcacgaggtcagcagatcgagaccatcctggcgaacactgtgaaaccccgtctctactaaaaatagaaaaaattagccgggtatggtggcgggcgcctgtagtcccacttactcgggaggctgaggcgggagaatggcgtcaagctgggggcggagcttgcagtgagcagagatcatgccactgcactccagcctgggcaacagagagagactccatctcaaaaaaaaaaaaaaagaaaagaaaagaaaagaaaagaaaaatactagctgggtgcagtggctcacgcctgtagtcttggcactttgggaagtcgaggtgggtggatcacttaagctcaggagtttgagagcagcctgtgcaacatagtgaaacctcctcagtacaaaaaatagaaaaattagctgggcttggtgacgagtgcctgtagtctcagctacttgggaggctgaggtgggaggatcgcttgagcccaggaggttgggtctgcagtgagccacagttgcactccagcctgggcaacatggcaagactcggtctcaaaaaaaaaaaaaaaaaaaaaaaaaaaaggaaactttaaaagtcaaaaaaaatagaaaaaataccaatagggaatgaggaaataagtcagggaagagaaggcaggtaatgaatgtgagttatcaagctagattctctggtggactttggcactcaatcccaggtggaaactgggagacaaaatgcgtatctccaagtgatctcaccagaggggtgagggaattgggatatttacataccattccccatcagttattggttaaggaccactcccaggatgttaatttccaaacactctcttctggcactatgctcagataaaatacccttccacaagttttagagacatatctcgtacaaagaagaaaaaatgcaaagtcctgcacgttgacacagaaggtctgaggggaatgggtaggactctgacagagttcctttgaggacacttgaacctagattcagatgctggcttcacccattccaactgtatgatcttgggcaagcttgttaacctttctagaatttcgagttcgtcttctataaaatataccttataacattacacatttcataggcctgctgtggagatgatgcatatggtgagtttagcacattaatggccaaatactaagggctcaaaaatggtagctttcatttgttaagtgttacggagcctcttctctgtcccagtatgtgtggtaggtgctcagtagaaccagtggttggttgttggggggaggtaatacctgtttttatggccttatagcctttgcgtactaaaccttaagaccatttcttatttcactaagtcacaccttgcccaggagagaatcgtatacatctcatacattatgttccaaatcacgtaacctaaatttttgaccgctggatgaagtgtcttaagcatctgcaaagacagaactgtgcctttgaaagcaattgtaaattttaagttttatagtagccaagtttgcaaaaggaataagaaactggtgaaattaattttaataacatatatttaatttcatatgtaaaatattgtcatttcaacatgtaattaatatgaaattattgactattttacattcttttccttatttagacattgaaatccagtgtgtattttatacttacaacatgtcagtttcagacctatgactgttaaagtactcagtagccaccggtggttcatggtcaccatattgggccacagtgaaggcttaacaggtcctggattccttttagaagtaaattccaacagaatagttccattttctctttcctcctcttcatagatgacaatgcttctttgcttgtataaaaatgaagttggttttagcttaggcatcatggaaaattgacagtttctgtaataaaatttcacacatggaaaccatggtgagaatcttagcaggtgtaaaaatctgacgaagttatttctttaactgcaatttaatggaaactgcagcagctgttccatttgcgtattctccaaatctcagtgccaaaaagaattgttggcagccactggagaagtttcaacttacctcttcatttgggaaatgaaatcaaaacctcagcttgtttctaaaagttgcggatttggcgaaagttagcagggcaaacacataagccgctattaaaatattgatggctttggttttctcaggtgctgctgctaacatctgcagaagatttggactgcactcctggatttcagcagaaagtgttccatatcaatcagccagctgaattcattgaggaccagtcaattctaaactgtaagcaatgtcactcaaagatgcttttagactcttctcatatttgaatttactaatgtttatgactgtgtctcaggatgtggtatttcctaaactaagtgttttctgattatttttcttatgtcactgcttgacccaaagtggaaattcttgaatgagggcctggccaacttagaggttaatagagtgatatgcatctctttttagtattttatcatcagtgggtatctccatactgctgtcagaaaagggggctgtcagcctccaatgagagttgtacactgtgcaaaggaaatgaaattcatttcccctgggcagatccccaaaatcaaaatcattgccttctcgcagattgctgttctacctgtagtttctcatacatagcattagatcaaaataatggtgagagtatgacattggcttctgggaatttttagacacagacatcaaaaactcttattcttaaggctaataagatgggttttagaaagattcaaaacctctactgattattctatggattaagctcaactcatcctgaattccaattgatttatttaaaatatgcatctttcatatctgtggtgatgatctctttttgtttttaatgtcaatattatattgctttatctttaagaagtgttagggtacattgctaaatgcataacaagtacagttttagtgcaatagaatttaaaattggtggtagacaaatagctatttcattgtaggctcttgagtaccttgcttaacaactggaaatgaagaatatggaaacaactgatctaaactgatcagatgcagtcgggtgtgatggctcatgcctgtaatctcaccactttgggaggccgaggaggatggatggcttgaggccagaagttcaagaccagtctgggcaacctggtgaaaccccatctctactaaagttacaaaacttagctgggcatggtggcatatgcctatagtcccagctacgcgggaggctgcggcagaagaatcgctttaacccaggaggtggaggctgcagtgagccgagatcataccattgcactccaacctgggtgacagagcgagactgtgtctcaaaaaagaaaaaaaaaaaagaagaagaagaaaattaaaataagctgatcatacgctccaaggtcttttcaaggaaggtgattccacattggctcttatggtctcaggtttacgttccacgctagctaagttcctttagtcctatgctatgtggctgacaagtttaaaggaaagacaagaaaaaaaaaaaaaagcacacttgactggattattctgtgaggctgggacacactctaagagtcgaaaggaacacaataatgaagatgcactgttgagcatcaagggagctgtccaaggtgaagcccgtgcacctcccgatgaaatgacgccaatgaaatcatttcaataattagtctgtaatgacaaggtgcagggctggcacaataagtgaattccaatatgtgatttcctgctcatttgatctctgagtgtgactcctgggtcaggccattaggaaccctcctttgtcttttcatttttgtatttatcagaatcaatatatttcaaacagaacttgatttgtgagaaccatttttctggctctcctctcctctcttcctctgtcttccttttattttttttccaagtgattatcccaaatggcatctatgttaacatgcttggaaatgcgaagcgaccctgagtatggaaattaatagagttggtatgcaaagtagacctataaatgtgattgcttctgtaatcttcacgatagcaaacagtttttaattcgctgctgagaagctggaaacaatcatactttggggggatctttttaatttaaagtaagccatactgtacattgcagtatcacagttgtgtgtgtgtgtgtgggggggggggcggcggtgtgcgtgtgtgctttaatcccctaagtaattaagtgggttatggttgttgcttctgggtaagctagtaaatgctaaatgggactaggttcattatcaatgataacacattcagaaaaagtcagtgatatgagaattgaggacacttaaatttttatgcttgtatatgagttgttgggtcagcaaaatttgattagcccctcttggtgaaaccgtatgtccatgtatattactaaggtaaaaaaaaaaaatccaaagcagatctggttaggtactttcaagttcatctcaaagcaatgaacatattatgagtatagagcctgcagataaggttaatggtgcctaaatgaggaagaaaattgtcatagacttgagaatgcctattgaaaatagtttaggaaactctggatttctagaagtagtagcagtgctttgctttattccacttgcaagtagcggttcaattgaataaacttttatacctaaccaaccaatattttaagccagtctcactctcccctctctctcattctcagtttattttgcgtatttcttataatgcaaaacaaaaaccttctgtctctgaaaaacgtgattaatcaagaaaccaatgagtgaagtgtgctatcaaattgaagactctactggcacaaggctaaatctgaatgaaaaacgaaaagaaccaaacagaaccagaaaatgttaaatgcatagattccatttcctgaatcattgtataccaaagatccaggaaatggttagggatgttttagtctcatataaatataggtcagtgttgtacacagtgagaaaactagattagtagcatcatcttgtgccctactcatgacatttgcacttcatatttttcctttatctttgcaatatttaagagctttggttaccaatcattgtgaacttttgtgttgcagggggtgtaaacacagcataatcaatcaattgatgtctacactcttcacttttctttaaagttgtctgaaagtgctgtctctttgcctgacagacatagtatatctacccctaccctagacttgtgttcatccaattgtgtgttcagcttttagcaggttatggggaatgtttattctgtggatggcttcctgctatctttgttcagacagtaatatttccttttatcctttttcatcttcctcctcaattttcaatgacttatctttttctactttaactgttactaatggtcacctccactccttttatttccctaatattttattcactgttatctctgatacatctttctctcagttgttctgaagccttttatttgcttcacatctgaatcactctttattctactctcctttccactaactggacttgcttttgtcttaaaaacgccatttttcaacaatatgctgggaccaaaacatagcattcagctatttcttctaacgtaaccagtgggctcttcactgcatctttcagagagtgatgcaaagctcccaactcagggaaacttgggtaaaacttccttggcttcatctcagtcttgaaagtttatctgggaaaatgtgattcttcccatttgtcaatgaaaaatacaagaagaaaggagaagtcagcttagaaggcaaccactcagaaaggaggcatccatttaaggtctttgaattctgaaaggaatctgtgaaaagtttgtgggaggtgttttctggaggcctggcacccatatctccctcaaattgcccagcatggtagatcttgcttttccccaaacacgacaattgtgtgatctgggagctgacatcttagtaccaccagaattggacagcaaccctggttacatcatgacacccagaacagaagatccccagtcttagaagaatagctgtcttgggcaactgaccagccacccagctgggatgggaagatcccaagtgataaaatctgactatcctatgttctgcaaaattataaaacaggatagtctgctttgataccatcagctcagacagattttttccagcaaatggaaaaatgtgtggtcattgagctcattaggagaaaccatacccttgacctccagcctctattagcaggggatgagtgcagtctttggtgtccagaaagaagatcctcattggccacatagccaccattagaactgtacttttttttcttacccttgttcattctttatgggtcattcctcttaggccacccacatgcaaacatagacacataggtagagacagaaatcacagcatctgaatttacctacaatacaacttgcatcacatgtttaggaaagaacctgcattaacaagagcaggctaggctaggccatggtgtcaaacaactctagtgacttaacacagtgaaagtttatttctcactcagatcatgcagatgcagtcgggctgctctcctgggtaactctcctcccagtggttgccctccatgcaagaacctgatggccgaggctacttccaacttggtcctaccatcttgtagcttccagcttttatcactgagctggcagacaggggaataagaaagactatgaggaggtcactgcaggtgcttaaatacctcagccccaaagtggcatgtatcatttctgctcatattctaagatctaatcatgtcgccaacctaactgcaaaggagtctggcaaacgtagaagaacacatgggtatcgatgcaggatcacagtctctacaaagatcctaacaaaatgatgtcgcctatatcagaaagagacataaatagagacagaaatggaccacaaaggagccagctgtcttggagtaaccaaggcctacataggatgaagttagtcagtttaagcaggagagcaaggtcgtgcacctgcgactatgtcctgctttccttagtagagaaatattcccactgaacagaattagcttcttagaaacactataagctcctctccctgtgccatcttagaaacactaggggagggacagcacctactcatggactccagttgcttcctccaattggttacaatactgtggttaagatcacacagttttaaactcatatcgactagaattcaaatgtgcacacagtcatctattagctctgtggccatgagtgagttattcacatcctccaagtttgaattatctcatctccaaaagaagattaatggtagtccctgcttctagagctaatgcctcaactgatgggaaacatgcttagaacatagtcacaaataaatggaagctgctattattattattattgtccttataatttctgctgttactattattatcattactttcattcatagacctcagctagatccacttttcttataatggccatctgaaattggctttaagaagaaaaatcatgttggccattaaaaatacaaacaggtgaagaagcgactaaagcagtgattgtagggcatttgaacttcatggaccagtaatttttttaaatcctagattgatgagagtgtattttaaaaaattggtaagacttggtatgaattttttaaaagtaagtaaatgaagggaggggaaaacactaccgccatttacttttgccaggctttccttttaaaaggtcacttggcatcaaaaataaacataaaagaagtaaagactagttacagaagaaaagtcagttctttgagtaaattttgctttgtgaaaaatgcaccaaatattcttatttacttcgcttttgtggaaaccattgatctaagggattaggttgatgtcaccctttttgctcttcacttttctgatacttttctgaagttttaatatgtcgttgtttctgaagaggcaggggtatttcttaggagacattttcatgaagggactcctgtccatgttgacaaaagagagtgagtgtttctagataatgtgacaatcatatgcatgttaggaggtgtattagcctattttcatacttctataaagaactacctgagatggggtaatttatacagaaaagaggtttaattgactcacaattcagcatggctgaggggtggcctcgggaagcttacaatcatggcagaaggtgaagaggaagcaaggcaccttcttcagaaggtggcaggaaggagaagtgctgagataaggggaggagccccttataaaaccatcatttctcacgagaactcactcactataatgagaacagcatagagaaaactgcccccgtaattcagttacctccagctggtcacccccttgaaacgtgaggattatgggaatcatggggattacaattcaagatgagatctgagttgtgacacagagccagaccatgttattccgcccctggttcctcccaaatctcatgtccctttcacatttgaaaactaatcacacattctcaacagttcccgaaagtcttaattcattctggcattaacccaaaggtccaagtccaaagtctcaactgagacaaggcaagtcccttccacctagaggcctgtaaaatcaagttagctgcttcctggatacaatggaggtacgggcattgggtaaatacactcactccaaatgggaaaaattggccaaaacgaagggtctacaggccccacgcaagtccaaaatccagcagggcagataaatcttaaagctctgaaatgatcttctttgactctgtgtctcacatacaggtcaccctgatgcaagaggtgggttctcacagtcttgggcagttccacccccatggctttgtggggtacagccccactcccagctgctttcacaggctggcgttgagtgtctgtagcttttccgggaggacagtgcaagctgtcaatggatctaccattctggggtctggagggtggtggctgtctctcacagcttcactaggctgtgccccagtggggactctgtgtggggatttcaaccccacatttcccttctgcactgccttagcagaaattctccatgagggctctgcctctgcaacaaacttttgcgtggacatccaggtgtttccattaagcctctgaaatctaggcagaagttcccacacctcaattcttgacttccgtgcacctgcaggcccaacaccacgtgtaatatgcctaggcttggggcttgcaccctctgaaacaatagcctgaactgtattttggccccttttagccatggccaaaatgcagggctccaagtcctgagacggcacaaagcagcaaggccctgggtctggcccatgagaccattttttcctcctaggcctcagggcctgtgatgggaagggctgccttgaagacctctgagatgccctggagacatctccctcttacccaccagccctgttacaccattgacttggcgattaacatttggctcctttttatttctgcaaatttctgtagctggcttgaatttctccccagaaaatgtttttttcttttctatttcatcttcaggctgcaaattttccaaacttttatgctgtgcttcccttttaaataaaaattccagtttcaaatcttctctttgtgaatacgtaaagctgaatgcttttaagagcacccatgtcatgcttgaacactttgctgcttagaaatttcttctgccagataccctaaatcacctctctcaagttcaaaattctgcagatcactagggcaggggcaaaatgccgccagtctctttgctaaagtacagcaggaattacctttattccagttcccagcaagttcctcatcaccctctgagaccacatcagcctggacttcatcgtacatattactatcagcattttggtcaaagccattttacaagtctctgggaagttccaaactttcccacatcttcctgtcttcctctgagccctctaaactgttccagcccctgcctgttacacatttccaaatttgcttcctcatttttgggtatccttatagcagcaccccactctactggtaccaatttactgtattagtctgttttcttttctttttcttcttctttttttttttttttttttttttttttttgagatggagtctcactttgtcgcccaggctggagtgcagtggcacgatctcagctcactgcaacctctgcctcccgggttcaagcgattctcctgcctcagcttcctgagtagctgggactacaggcatgagccaccatgcctggctaattttttgtagttttagtacaaagagggtttaaccatgctggccagactggtctcgtattagtctgttttcatactgctgtaaagaactgcctgagactgggtagtttataaagataagaggttcaattgactcacagttcagcatgcctggggaggccttagaaaacttacaatcatggtggaaggcagagagaaagcaaggcaccttcttcacaaggaggcaggaaggagaagtgccgagataagggggaagagccctttataaaaccatcagttctcgtgagaactcactatcacgagagcagcatagaggaaaccacctccatgattcaatgacctcccccgatctctcccttgacatgtggggattatgggtatgacagttcaagatgagatttgggtggggccacaaagcctaaccatattaggaacatatgttggcatgcaagcttctgtgagtgtggacaagtatggcctccctggccttgataactgacagttactgtgtgctccctagtgtgttgagggccacctcgaacctcacaacagctcttaggggaaaggtactctcatctgcccattttacaggtgaggacatttaaggctgagctaggtgaaacaatgaacctgagatcatactgcttataattggtggtgtcaaaatttgaacccaggattttagggccctggttttcatccatagttctgtggcctagtgtctcttagtttttttgatgttggtggtgatacatcaaggaaatttgccggtgtgttttcccatcacttttatcaaccagggtgagatagagagaactgctgctgctgcgtatttgttgcttttcatagccaagctcatcctgtctctgtattatagaagaattagctttttctattctggatggacccagggccagattgtccatgacccttaactctcagctttccaccctctctgttagtttctttcaccaagacgttacttggtcatgccaccatgacactgaccttggttagcagccaggtcctccatggagtgtgtggaatcacattaatcatatttgtacttaacatacatgagtcatggcttttgagggtgcttttaattgactataaatcaagcaaggaacttgaaaaatgaaggcaattaatgaaaaagcatgtgagaggtgttttgcatcctaagggaggaaatacactgtcagtgaatttaatgtcacaacaaaggctcttttgaccctgctgaaaagatttcatgtggatagtaataaatggatgaactttgcagcctcacaggtggagaattgcctgtttcctgagttcaagctgacttaggcttttatctgtctacattctctatcttgagaacttcctagattcttttacttttgctttcatttcttgtgatttttaaaaataacaatgataattcttttcccattttctggtcattcttcacacatcctttacatattttatacaagcttgtatttactttcaggttgggagactgattaattgattagtgaggttatgtaacgtcccctgaactgcagtctggacagagctggacaaggttggggtttcaagtagtatatttgttttaatctgttgcgatgtgccaaggaaaattattctggtattgcctaattcactctatcattatgaagttgacgatacatcgggtcagaatgtggactcctatttacattaataagagtttttcctatatttaaacagagctcagtagaaatgttatgctttcacaggttttcccttccctcctaccaatccatttgtaacaatctagtagtaagtcaattaataatgattagaaacctcataaatgcattatcctacctaacaaatgtgaaatactataataaaatgacgtaagataagaaatgaacatatgtacacatcaaagacagatgtaacaaaatgtttagagatccttccattggacttgggtcctaacttgttctttaaagaatgggaaacacaagaagtaacagagtgagaaggacttctcagacgaggaacatgaacacaggtggagttcccttggcctaagttttcttatcagtagaatggaagagataaatagaccagaggtatcacactgtcagcctttgggctaaatttgcctcacagatacgtcctgtttggctgcttagtgtgagaatttgaggtgtttgataaaaggaatttgtcattaacatttagaatttcacctttagaaattcccaatttctgggtagtgttgcgtcttcagagcagacagagatgccacagttcagctgcctgggttcaaatctaaggccgatcctttaccaactaagtaactttggcaagttgggaaaaacaaaacaaaaaaactcactgtggttttattttctcatctggaaaattaatattataatggcagcaatctcaacagtctgttttgagggctaaatattaatctatgtgtgataactgctacattgtgtaattattatcattattatttgagatggagtctctccctgttacccaggctggagtgcagtggcgcaatctcaactcactgcaacctctgcctcctgggttcaagctattctcatgcctcagccttccgagtagctgggactacagaagtgcaccaccacgcctggctaatttttgtaattttaatagagcaaagttttgccatgttggccaggctggtcttgaactcctggcctcaaacgatcgtcctgattcgacctcccaaaggactgggttaggtgtgaaccactgcgctcagcgggaattttttttttttttctttttaaacacaagtcaagtgtagtagtgagaagtgcggaaggggtagaacaaggagtttgatatgtaactttatccttattaaaataccaatgaaattatttacagaaaaagaaaaaaaattctaaaatttatacagaaccccaaaagacccagaacagcagaagccatcttgagcaaaaagaacaaaattagagttatcacgttatctgacttacagttgtactacaaagctatagtaactaaaacagtgtgatactggcataaaaacagatgcatagaccaatgggacagaatagctaacccagaaatctatgcatttacagtgaactcatttttgacaaaggtgccaagaacataccttggggaaaggacagtcttttcaataaatgctgctgggaaaactggatatccatatgcagaagaatgataatagagccctatctcttgccatatacaaaaagcaaatcaaaatgaattaaagacttaaatctaagaactgaaactctgaaacgactacatgaaaacattgggggaaatactccaggacattggtcttggcaaagatttcttaagacctgagaagcatgggaaactgaaacaaaaatggacaaatgggatcgtaccaagttaaaaacttcctgcatagcaaaggaaacaatcaaaatcaagagacaacccacagaatgggagaaaatatttgagaaccacccgtttaatgagggattaatagccagaatatataaggaagtcaaacaactcaatagaaaaaaaaatctcattaaaaatgggcgaaagatatgaattgacgtttctcaaaggaagacaaatgggtaacaggtatatgaaaaaatgtccaacctcactaatcatcagagaaatgcaaaaaaatgtatatataaacatattctctccctgcagttaaaatggcttttatccaaaagacgggcaatcatgagtgctggtgagggggtggagaaaaggaaaccctcatacactgttggtgggaatgtaaattattacagccactatgcagaacactatggatggtccccaaaaaactaaaaatagaactactatatggcccaacagtcccactgctggatatatatctaaaagaaagggctggaagggtcctggggagggagaataaagtggggttggttaatgggtacacaaatacagctagaatgaataaaatctagtattttgtagcgtaatagggtaacaaaaattaataatttattatatattttacatacccaataagatgaaattggaatgtccctaacacaaagaaatgataaaggtctgaagtgatgaatactcaattactctgatttgattattacacatagtatatctgtatcaaaacatcataggtcccctctaaaaatatacaactattatgtacccataaaaatttaaattactttttaaaatattaatctatgtaaagggttttgaatagtagctgacctataatggtccctgaaatattagctgtcagaaacagcatagggatgattgtagctgaaagcttgctatggccctccaatatttatctttctgatatccagtaggcttcctagttaactctgcctgtcccacatgggcatctaaattcaccttcaggaagtcactattactcctaagactgttcatggagtcaaatgatgttccatagaagacaaaaccatcttgaagtttttgatgctgtcttgtttctgtcatatcagtaacactattgacaatacctgctattcactatcaaggaagcagaatacagtgctaaggggtgagaggacatgggctggctggtgttgatcaaagactttgaaatctgttttcagtgttttgaattgttgatacaggtaatgtatgaaaagggaaccatgtggtcagacagggtggctggctttctggaagttcagaataggaggaaggtgaaaaggatgagtgggcatggctcaggctgccatggagccatttcagaagtcctgagatggggacagtttgtatgtatatcagaggagagatcaacaagggagataggagtgttattggggagcacttgaacatgaaataagtgaaaggagagccccagggagatccaagggttgacactaacaggcatctaaaagaggttttccgaaagagaagcagaatcactggagtctaatcccagctctaactttgacttgcatgacagttttcctccctggacctttgtttttctcatttgtataatgagagcttgtgagttgggctgttttgactgtaatcaacagtaacacaactccaactagcctcagcaaaaacatataaaattatcagctcacatgattgaaaatttcacagtgtgagttggctttggaaacacttggatctagatgcattaatgatatcctcaatatcacccttcatcccccagctttgctttctataatattgatctcaatcttcactctcagagggtttccctccaagatggccaccagcaattccagtcttttattcttctagctaaaagagccagagcatctgttttcccagtgttccagcaaatatctcaaggctgaccgtccttggaccaacttggtttacgtgcttatccctaagccagttattatatccaagaaaattctgtacttctcttagccaggcctggggaaatggagatgaaattccctcaaggaaggaaatgatgctgggctggcaaaagtcagacagtccgttctaagggtattgtgctctgttgctaaggtcccattaagtactaacgtcttatgaccgcagactgtgccccaagcctgagaatttttagaacccagcatacacacaaatggaaatgttttttaggtggcaggggataaggacagccatcacaccaggtttcttgctggtgatgctggtgagcagattgcttaattaagactatcaaattctaagtgctgccatatggcctcactcttcaacctgttgagtgtcttcactcacttggttctggagctggtataaatctgtttcatttctgtttttctttaaggaattaagaatacaggaacatacggatgttacaggagcatctcctaatttaaggtattagaactacataaactgggctgctttaataagtaaggcatcaaaatataaattgggaaagattaagcatagctttaaataggctgagaaagcagaagttcttattattctgttacagatcaaatctacacacattctagtaatagaggtgccctctatttgttcttttcaccttaatgttgatggaaatttttttggcttgagagcaaaagggcaagaggtacaaatgcttgccagtcaaaatatccccaaggacttctgcatttgacaaaattcattctccttctggagatagaaatagggaatggaaaaggaaaagatgtatattgagtccctaccactcatttagccaactatagaagaaacactgaatgatcacctagtttttgccagaccctgtgctaagtataagggataaagctttgaatcagataaaaaatgtgcctcctgctgtggagctttgatgatatcagagagagaaaaaggcaaacatgatataataaacccttgagaacacaggaaaacggcacatgacaagacgatggttaagtatcatgaaggaaataaggcaaggtcatatgatagagatttctgcatggctgctgaagaatgggtggtcaaagaagatttttctaagaagccaagtcctaaactatgagaagaatccagtgaggtaaaaatcaatggtataaacacttaggctgagggagtaactcatgtcaaagccctaaaatgagagtgggttcttcagtttgagatactgtgatccaggaggagggctgtcatttgatacatttaatcatctcaaatgtcttgcaaataggattataaactctatgttatagataggggtataaagattgactaaagagcccaagatctcactaaaaagtgtcagtggtgttacaatcctctgactccaaaccccattatctttccatatggaatgctgtagctggtgttggagtcttctttcacagtaaagtgctcctgtcattgcctctgagaacagactggggtgtccttgatagtttcacaggacagtggtgtgggctcctaggttatattgcctgtctctgtcactcacaatgggtggtgtttttaagctacccaaacttccagctcctaatttttctcatctgtgaaatggagatagtatttcaaggattaaacaagatagcacatacaaaggagtgacagcagtgcctgctacatgcaatatttttattttaaaaagttggttggttttatcctttaaaagaataaggctggggtgggaaatctctgtgggatgatgctgtttgaatgggtagtgctggatgcccaccaaagatgacccacgaaattttcaatatagcttggctcctctgaaagagagcatattttcttcctacttcttctgagactctcttttaagtattttcatgttctagggatacttgttctcccccacccctgaccacttctcactcatgcttggtctctttgagctaaatgttaaaaacatactctatgaaaaatatttgagaaattagtactcccaattttaggtccagatgtgttctggaatttagaaagataataagatgcacacattgtattacacgattctacgagcggggtctcgggcagctccctgtattaaaacaggttggcatttcaatagtaaaacatatgaatgtttaccctcagtaggataaataaggaccacaaataacatcatgtcagttcaggttgggttttgctgccaaatgagttataaaaacatgtttggtatgctgagtctcttggatttcagaattgcagattgcagtccttagaacattcccgtgaaaagttgcaaaccttagtcgtgctaagatgttgagttggcgtcttcacatcccggccacttctgggagcagcagagtgtggtggctcagcccacccctcaacccctctactacttgtgaacaccttggtaaatgatgtcttggcaggccacccccgagaagtggccaagtgctgcaccagcttttttcttttccatttgaagccaaaacgattgtcagcgatccaggcttctcttaactgtgcctgtcagctgattctgaagacctcccagaggatctatttttagctaaaactggttttaaattttcatatgtatacattaaattccatagaggaaggggggattccaaatgaggaaacattgattctgaataacataaaagaaataagcagtgcttgaaaaacagttcaaaatatgagtcaaaacctcccaggaatatggttagcactgcatttttccatggaaggaagtctgttgaattgaaaacagaatgagagtaagtggggataaattatactaagaaagagactcagcatgaaattctaggtactgaagaggggaaggagaataagaatagggaggactgaacttagagggcagttgggattgccagatggatactcatggggatgtgtggccaggtaatcaaatcgcattgtccaaaagggacatggaggccatgggctaggaccaggcttttggccatactcaagagggagagagaagatacacctcccaaataaaggcctggagtctgcacatgacagctttgattatgcttccaaggttttgttcatttttggggcatgaccaaggtagttctagaatgagtgaggccaaagctgaaagtgtcacaaagtttttgcgtatgacaaaagttgcctgctttgcttttggatgctcaactcagacttcttgttttcatgatgtgcagttttgatcaggacattttagtgataggtatagcctacttctgtaccaaaggagaggttggattatctgttgaaaagcgttttgttggctataattacaatatgatgacttagttaggattctgataaatcctgactaactcaagactttaaagaaagatacttaattaaaatagaaggaagttgcatagtcacaggttcatccaaagacctgaatgacaaggtctcagaaaggacagaaactagagaagttccatgggcttaagcaatgggaactcatagaattaggacagtgcttttcaaacttttacagtgaatgacgatatttgtttcattttgttttgttttaatgtgtcacagtaacatacttttgttaaagaaaaatgtcaaatatagttttcaaaaagtttaaaacatgactcacattcatatctaaagtgaacacatcaaagattttatctatctcaacaatgcaaaaggggaccaataaaatgataagtatgattcaaagagcattcgagaaactagctatttgcatgcaatttaatagtaaaggagtgttagaataagtttgctaggttacatacgaagctggttaatgtcctgtattagtctgttttcacactgctgatacagacatacccgagactgggcaatttacaaaagaaaggtttattggacttacagttccacatgagtggggaggcctcacaatcatggtggaaggtaaaaagcatggaggagcaagttacgtcttacatggatggtggcaaaaagagaatttgtgcaggggaactcctctttttaaaatcatcagctctcatgagactcattcactatcacgagaacagtacaggaaagacccatctccataattcagtcacttcctaccggtccctcccatgacatgtaaatagtgggagttacaattcaagatgagatttgggtggggagacagctaaaccatatcatgtcctacaggacaaaaaactgtaacctctgtggttatcttttctacccatcattacttgtatctctgccagacagaaatctgtgaattaacatgtaatgttgttaagcctgaaaccatcattgagtagtgaatagtacattttcctagataattaaataatctttgaattgacaagttaatgcctgtatacgacattgaaagaacatgcaacccacatttttgtcttattttcaagttttgaaccttttttcttagtaatataatgaaaatcaagttttgtaaaattaaataaatccaaagacataaaaggtaagcttttaaaaaaatagatggaacaggtataacattactatgtcacattgctttcaacttctgtactcgtcatgggcccctaacaagaggttgggcattggtctgtggaccacacatttagtgttaagataggaataacttaactccaaataccttccagtttgggatgtctttattcaaattcctggtagagaagctgattggcctggcattgggtcaagagcccactttgtggtctagcagacaggtatcatgtttggaagcccattccctaaactagggactgtaaacaaacaaaaatcagaagcatccatacagttactgagtttggagaggtagcccaaacaaggggaggacttgggcagtgctgagctctgaccatagaaaaaaagtatctgggaactatctcaagcgtcatttaggctcccccatttcaagcatgcacccaaacagctcatatactatacagtaaatacaacttctcaaagtagaagataactggtgttaaaacaagactacatttatgagaactcacttccataagggcaaatactaccttaacagaatctcagcaacattccagaagatggaagtcagaatagatatttatagggcttgtagggagggtatagcctcaagcaatttaagataggaagatgattggtattgggtaaattcatgacatcttgatttaagattgttagacatagcaagatgagtttactgaaataagtctgacaagtaggttattgtttgatagatgagctatttatctagctaaggagactgttgtcccagataaattgatatgcatggattgtccaaatgaagcagtgaaattgttcctggtttagagccttatgtttcgtggacaaaggtttctgtgaacaattaagtcaggttgacgaaggtgatctcagttgttggtcttaagcactacgccatgttgatttaggtggtctgaattctcaggacatggtagttcacatttgttccatgttagcatttcccaaacttctgtctgtggaacactattctgcagagtggtaacagcaatgcaatggggggaaacatattttgaagttaagtaagtttgggaaattctgttttgttttttaatttaaactgtaggccctctcaagtctttatgatgtgaaaatgcacagtaaatattccagaaagcatgcaaaaataccccagaatctaactcctttccagtctgaagagctcctcaaatctctcctaaagttacttgctttacacacagccacctctattcatttttttttttttaaatttccagtagccagtgtaacctgggggccagggaagacctgaacctctaggactcaaaccctgtcatgattcttgaggagagaggaaggtggaaatacatacatacacatagacacacacacacacacacacacacacacacacacacatatacacacacacacactctatatatgtatatatattctcattctgctaaactaatcgaaagtaagatatagtaaaatgtttgaaaatacatatgtgcagctttgaaatgtcttcccatatcataatggctgtggaatcagcctcagaagccagattgtctgagccccaaggaaacgtcaaacccctctccctctccagtagcattccccagtctgtgtcacttagacgaaaaggatctcagggtgggtggcaatgctccttcactgaaatctgcagttatctctacccaaggcttacagtaaattttttgcaaattagaaagccctttgctctctcagtaaaccctggctttcaagatttttgttttagtaaagtctttagactaaatgttgaatctttcactctctttgctcctaatcatctctaagacagcaaatgcctctagcaaaaaagaggagacgtcaactgggaaaatttgaagagaaagtcacacagatacatttcagtaaggttgtctctgttacttgaggcttacaagaaggaaagaattccctctctaaacacactctaaacacacaggagttgagaacggggagatttattccagaaccccttctgtgcgttggggcttctggtagcttgcctttcttggtaacgattttctcagagactgggtagattcgagtggagcctggggcatggttgttggtccaatggcgggggttggggagacacaagcagttggcagggaacttacaaatctccaggaggttattgagaataaaaattcagatattgccatcttttccatttcaaagcaccaagagtctgtcatcagcaattgtgcctttctaggtgtcacctgaatatctaacattgaggcattgaaagatagatcaggactgattttactgagcattttcaaaggcagcaggcaggcttttcaatgctgcatgagatcctcaccttctctgaggtgacaggggcttctgttttcttgagtttccctgtttgctgatgtcatcccctcctaccccatgaccatgacaccaactacatccatgatgtatatttccaatgtgtttcaacttatggtcagctcccaccagctccatattctggtgggataagcaagccttgccttgagctttgcaggctgggcccatggttgtggacatcacagctctggtcctcatagtattggtggcaggcagatgcccagctctggcacctgaatgcttggatttggatgccagctctaatacttactagctctgtaacctagaaaaagctccttagcttctctgcactttaggtttcttttttaaggaacactgaaggaaaatctgaggctggtacagtctctgcttggcaaatggtggttatttctatccattaatgtcatctgatcatggcccctcaaacctcactttgagccttgtgagcaaatgatacatactgtttatatatatattttcctatatatgtagaaaaatatatattaaataaatataaaatatataatttaattaaatatatttaatatatatttatagtatattaatatttaatatatactatataatatatacatatattgtatattttatatacaatattatatattatatttatatgtaattgtatatttatacataatataaaatatctattatatgttacatatatttagatataatatattttacataaattataatatataataatataaccagtatgtttcattatatataatatatagatacatactgattatatatgagtatataacatatttacatgatatataatatataagtatataaaatatgaatatatattatataatttataaatatatataaattatgcaaattatatttgtgaatatataatagatttatctaaatatatgttatatttagctatagaaatatatattatatatttagatattatagaaatatataatatatattataacatcagtatgtatcattatatatagatccatacagattatatattaatatataatagattatattaatagatcatatataatcatataatggattaatagattatatatactatttatgtaatcagtatgtatatatattatttcaaacctcactttgagccatgtgagcaaatgatacatactgatcatacctactgatcagtgtatatttcagtctctttgtatcgccctatatattttccactttgcaatgagaggcctttgcttctcaagtgcagcgtcctcatgcttctcccacctgaacaaattattaaccctgtaaaccggctttcagcaagctacgtggatgaggggtctgaaggtttttagtttcttattagactgtctctcgtttcacttacatggtacccgctgggttgattgcttcatatatcggtggtactaatgtggatattgaatgtttcacctgccgagggccttcatctaattcatactgagcacatagaaaggtgatttgaatgggggcatttgctctgttattttggtgatggatttagggaaatggaaagtagcaaattgctttgtttttggacctttgccaggtccatcctggttatggataatacttgcttggttgattgaagaaggccagctgctactctaatagcccaagtcaatggccaacggtgcctgattagcaagcctgctatgcttactgtagtgaaaaacatcttataattataaattaataccctttctattatacatcaatatgctggtatatttcataagttggccagcccttcatgactaatattgatattaaggtcaactctagttttatgataccaaggcaaagaacatctttaagaaaatttagatacaactcctgactttgaatgagggaattcatactgagaacctcagtgttaccatttgtaaatcagattaaataatgcccaacatctggggctttgaaaaccaatgggataaactttgtgagaacaatttttaaagcctttagacattaccccgtggtgtctagtgtctcttcatattttcctctgggtttatcttgaccctttcaaatggaatgcgtggatgccattagtatttataacattcattttcagtgctttagtattgtttttttctttattgttgtgtaatatgtatggaaaaggcatatagcaaagggtgatcaatggctgggcttatcctaatctttgtgcatgtgcttgggtgtgtagaggcttccgttcgtgtctctgggccatcttgcataggggttcaagctcccatttggatgccatgggttgaagtctccggaaagctgacctcagatgaggattggtgtgtaggaagtttattagggagtattctgggggtcatctgctgtgggagggaggggaagaaagctggagtctgacagtcttatcaaaggctcagtcaatatcacagggactctgaagccaggatggctgttcacaatggtcctgagttggggcaagggagccaagcctgtataactccattacaatctgtttttggatgtgggctgtgggaaggagccatgaccttagaggaaaagactgtctttagccaaggtaacccatagaggactgacaggtgaaggctgtctgcagaacctgggaaacatagtccttccgtcctgaaaaggaatacaacaggcacattacagaattcactacagtcatctagaaaacaaagccatctggtatccatggagacagcttccatagtcactattgcccttggagacagacacccacattcctagtgtggttgcctgacagtggtgaggaggagggggctgactatctgagtgtccccctgcgatacgatagcatgtcacctggttcatgacccccacacccaggtctctttccagagctcacccctttttgaggctggcaccaccctggacccaccaccagcttctgtggcagtgcttactctgctgtttaacctgcagtactaattcctgtctttcaagaactctgtctttcaagttccccattattaactttaatgtatgattatttatgtgtatctattcatgcatctatgtttttattaatttaggtatgagtgagtcctcagctcagtctgattcacatcagagcttttttaaaaaaataaatatcaggaatttttagagcatgtaaattatgattcaattcacacttgtctttttatgagttactgccatggtgtgaataaagcacacaagtgtcacaaagatattaacataataataagcattaatctccactagtagagtgttactaggcagggttccttccagctgccatatcaggaatccttccagcctgggtactaatgtcatcttcctttggagaccaggcatgaagagtcactcacttcctgaagtcactgggactgaaatccaggcagtctggctctagtctccaactccgctgccaatgaccaccagcattgcaaacccgtacacatgcgtatcaggcagacctggccgctggcaggcaagctaaccagctgtgaaccatggtcaccgctgcagggtagggctcgatgatcagaatgtgttccttcatttcttaaccatgctggaaaaagtatgtagagggactaagggtgtttttattttctttggcttttttccttccttccctcccttcctatcacccttccttctttccgttctccctttttccctctctctctccctttcttccttccttttagaaaaaacaaacctaacagtatgtatgtctaatacatacaaaatctggtatttaattttaaaaatttattcatacgcttggtaagatttttaccaagccatttggttttttattcactctctctgatgtggatcatgcctattctccttcttgggatattaggagaaaaaaaggatactatgattttcttaaaatggagctgtttaaatgaaggaagcatgtataagcctacccctttaatgggagggttcaataaatcctagaatttgcctgtaatgtgtagaggtctaaagagatttgtcctatgagaaagttcactaatttcaattatctgggttttattatcaccttctaagggttagagagacaggattttatagaatgccatcacctgaggctgtgacaatggggtttcacaccattaaattcagaaagcataagagaagagataagaaatgagagggcttgaagtgcatgccagttccgttgtggaaaatatgacctactaagcagctatgagaaatgaaagcaggcagtgtcatctcatgatctattgctattgtatgtgaaatgctttctatattagctgttgttaattaccatcatccccaccatcacatcattgtatttaatagcaggagaaaggaagcagctgttgtaggcaaagctctcacacttgagtgtctatcagagtcacctgggggaacgtgtgcaaatgcagattgccaggccctttgcctagtggttcacaatgagtatgatcaggctggaacacaggaatctgcatgttttccatcgactatctcagctgattctgattcaggtggtatgaggattacactgaaatagcaaacccatgctttgtctcctgttagtctagacagtaggcatctttctgttacctcttgggtgtaatgtttagtttaaatttcagttcctcatctctacgagggagtcataaatttgcatcttgctcacagagctgctgtgaggattagctgagctcgtgcccagaatggagcagcctctaatatttgctgtgctgtctctagagagcaacagggaggcatttcatggtcttccccatcttggtcctcactgtatctttctgtccttactctgtgcctgggacagctttagggcttaatgaacataacagaatgctgaagagctcagccactggagcccagctgcttggatgcaaatcttggctctccaacttaatgcctgttcatgagcaagttatttaacctcctagtacctcagtttcctcctctgtaaaatgggcttgattatcatacccccatcataggtgtttttttttgggtgtatgagatgaattattatgactacaacacttaaaaccaataatgaagtgccatgtagatgttcattaggtgaataaatacaaatattgttgattgaatgcatgtctgcatgcacgctgtttctttccttatgctgtttctttccaacataatacagatgtattctactagctgacagacttttaaagtagaggccacttttaaaagcctgggctcccatgagaaggaaatctgcaggtataagatgggtttgtcagtcagcagaggcatgctattgagaaaaggaggcaacctggggagggggtgttagaagagagcttgggattcagttcttctaaccaggagagctgacaagtaacaaaatgagactccttctgttgtctgttgcagtagacaaagcaagatgcttagttaacagcagcaacccagtgcctgtaattttcaagtccttggaggcacaccatgtcacccaaggtaagccaggggacacaggagggaagcaagagaagccagggagaatctatttcctgtgtcccctgtaggtgtttgactcacctaaagttaacactaatagaacatttgctcagaaatgtcatcgctgaaataaacgtgttaaatttaaacttgactgccccaattcatctgttatgcaattgaactggaaacagctcagacttaaaaggcatctccaagtttttctcagccaacaagacttaggccactttgttttctcagatttttcagccttgtccaatttttggataaaaatcctttttgaaaacttcagcagccatattattttcttctccagtcatcaacttataacgtaaagacaaagctgtggggaaaatctaaagttgcgtcaaatttttattttctagccagctacagctctagtctaaagctctttcttttggggagaaaatcccatttgcacatttcctcttagttgggtggacttacccatatatacttgggtgacattcaggaggctactttgtgttttggctgtgtattctaatttttcttccggtactatatacagcaagagaaggggatgttgttcagctcttgttctacctagaacccaactgcacttttgcaagagatggatacaaagatggatgcataatgcatgatagtatattatgagcactactcttatggctttgcattgtaagtaattttaatgtaaaacatatttctatagtctggttacaaaaacaaaacattttagaaaatttggtcattctcctgaaaacagcaaaaagaagaaaaaaaatcataaaagatctgctgaaaaataatcagttttatgttttttctttcatgacagcttcatccatctatccacctatccattcttgtagctctccatccacccacccatctatatacacctcccacccccccacccactcattcattcatccacctacccatccatccatccacccatccatccatccatccacccatccatctatccattcatccatccatccatccatccatccagccatccatccattcacttatcctgccttgcatcctaccttctatccatctgtccttctaccttttcttctatctatctgtatattctttaatctatccatccattcatcctgggaagaaataatagtatctttaaaatgtagtgcattggttacaagcacaagatcttcagtgaatcattttgtgcattcaaattctgtctgtatgtatcatgcactttctatgtaaccttgggcacgtttttatgcttctatggccttttcagtctttaaaaaatggggttaataatagtgcctacctcatagggttatgtcaggatttaatgatataatccatataagatacttgacaaagtgcctggcatagaggaagttctcagtaaatattagctgtctttatcattattatcctcttgctaacttaacagagttttcaagatctggtgagaaaacatgtaaaagatacataatataatgtctattaaaattataattataaatgcagtcataaatatacacatgtatatttcatttatgttactgatatccatctgtttcatcagctcattttaaaggtttctttaatagctgaaaaatattctgtagtacaaatatttataatcaaactgttatagctattcatttagactatatcaaatttctgttgttattaataatgctgcagtgaacatccttattcagttatttccttagattaagttttcagaagtgaaattggtggttacagagtgtacacattgcaaagctgaatcatattgccacagtgcctggtgtttgcatttccatatggttttgatggccaggttttctgcactattgccagtgtatgtgttatcactgcaaacgtttgccatttcggtagacaaacatgggatgttattgctattttattaacttgtttttatttgatcaccagcaaagttaaactttgccatgtgttttttgaccatattcatttctgtttcttaaaattatcaacttagaatatttgtgcaattttttttttttacatgtggagcttgttcttaatgattctgccagggcttaaaatttttactttctaatgagaaagttttggaatttactcttttccaatttatgaaaattggacaccggctccatgcactgttctaagcctttttctgtgttctctgtgattccttagagcttactaactgtgaccctccagtcaaaaccatgtttaaccaagtgctgatgggcttgagtccattcccaagtgactcggaagttgcttacttccctacctttgagtgggtctcattttatctccgtgatgttttccttgtccttctaagtcatattcactctgctcattgaagaaaaatggttggtaattgtagtggataactactccattctgtatgccttctatgtcttttcttgatgtgtgcacctctttctttatccttatttttaaacttgtgcttattagataggtttctgtacaaccatatctgtgtaggtttctcaccctagaagcctccttttaaatagggcaaagaagctacctaaagatttctctttaatatagggaggaaaccactttcgaacttgtgcccaaagatttatcttcaccaatggtctaggacagaggtcggaaaacttttactgtaaagggccaaataatacatactttcagctttgcaggccagctggcctgtgttgtgactactacacaaaagtagtaagagtctaatttggcccaggagtttgctgattcctggtctaaatgagagtaaagaatgggaaagggaatggtgtgggaggaataggcattttcattcattgttgttaatgagaaagagtcttcaaacaccagcatgcccctgtgggttggattaggttagaaaatccttggaggactgccttttccaccccagagtcctggagagaagaatgcagcctgacaggaaggatctgggtaggtgacatgtggggagaggattaaaagaaaggagggccagtggctcacgcctgtaatcccagcgctttgggaggccaaggtgggcagatcacgtgaggtcaggagttcgagacgagtctggccaacgtggtgaaacctcatctctattaaaaatacaaaaattagctgggcgtggtggtgcacacctgtagtcccagctactctggagtctgaggcaggagaattgcttgaaccctgcggatgagaggttgcagtgatctgagctcgcaccactgcactctagcctgggtaacagagtgagactccgtctcagaaaaaaaaagaaaggagaagagtgtctcaagggtttttttttccagcaggtgaacccagcctccctagcaacccaaggttaagaacgtgttgaaaacagcatggaagcccattctggaaagcagtggtgattgtgattctgaacttaaacagcttcccttaaacacactgttacttcagaaaagtacggttttggccaaagggctgtatgtcaggtatttacttgctcatcttggtgggttttgtttgtttttgtctttttggttagccatctaagacattatttttctgagatccaagttccaaaaagcaccgaacaaccttttgggaagaaaacatacatagtgtgtaggtgctaccgatttgtatcctctatgaccttgccatagaaaggcaaatcagacgggcgctcccattgcctcattgcaggctgccattttcatataagcttcatgaaatctgggagaataaaggcaaaaggtttgatctggctgtgacagggaatattgtgaagctgctggactgggcctgtgggttgcctgtgactgtcatcaagttcttcttctctggaggcttcaaattcctcctctgtcaaatgaagggactggactagaaacagaatggcaagtacagggcaaatgccccagtgctctctgtccctgctgcctctggcagccacttctgctcccccacagcatctcctggtcgcctggacagaaagcctcctccatgcagcactgctccaggaactgttctcagccattaaagcagggttcagaaaagcttggaggaagatggccttgtagacctcccctagcactgaagttctgtgatgcttagcatatgtgaaactcaagtttcttctgttcctgaatggggattatttattgccttggacagcagccctgaaacttgatccatttagctgcccctaagtgtagttaagccccgtgaaatgtaaacttcgcaagtaaatggaccattgccatttgcctctgtcttctagatgcaattgttttctatagtctgtcttgtggccggttataaaatgtctgtcttgagcaagctggggaggagggtggatagctttcgatttgcccaagtttgttaatgtttcattgcttggggtgttttaagatcctgtgcctttaatagatttcctgaactaacagtttgccttatttacttccctgggctataatcattattgtggctgaccatgttgataagctactctgtgaagccttctctaatgaatgagagtcactcttcaagtggttattccccttaaccttattttcaatcacagaaaatcattctcacagaaagtattctttccttttgttcaaaaaatacccccttgaatgttttaaatgtcactgttttttcagttctaaataatttttaattggtttttacatgaagttaactgtagcactcttgattcaggaaaattgtgcttgtctgtctctctattatctctctctctctctctctctctacctacctacctatctaccaaccaaccaacctatctaaaatctatctataatctattagtttttcttgcttcacaaatgacttaaggcaactcgctttcgggttgatggaagaaaaaatacaagtagcaaacttggatgaagttggaagaaacttggcacccactgtgtctggcatgtgcagatatgagtgatggtctataaatttaggatcttattaacagccaaagcaaagagtacaatttttccatgtatctggtttatagtatccacaggatacaagcatgctggttgatcaaatgttgcatctatatctttgtgattaacacctgacagatatttctatgatgcgttctgacagggttacacatgacagagttggctctgtctatgttgtacttaatattattgtagaaagaaaaattgagtatatcttgtgaaaaatagttccatttgaaagtccatttctttcaaattcaaagaaagaaaacaactaaaatacgtaagtctaaagggcatggttgatttaggattttcgagtgggaagactattaaaagagatgcttgctcaagagagtatagactcttctttggaaattggcatgggccacagacctccataggtaatacatttaaaacacaaatgctttttggggtactgtctcccagtactttgtttttgaagatttgtgactacatggtttcagtgctatatctaataaaactggcttcaaaacgcagagcactagcattttcatatgtttcagtaagtctcccagccttcgtgattctagagacaccaatcagttgatgctagctgcagttgctagagattccttcctggaattttgatgtaggcttgtaaggagggaccatacttaacatggaaaattaatgacctgagagcctgtcccaaaagaaatgctccaggcaggagatcttcaacaatagccatctagagtttcagttatctaggatagaacagtgtataggctggaaagacccagccctttcagtaaggcatgtgagtttgatcactcaccaccatctccagcctcagccttcttggaaggccccagacttaatggtcatttccaaccctctttaaaaacgattcctttgctagagtcggaataaataattgaggcaggcttctccagaatctcattggtgtcagctatggagtcatcaacagatgaaattattccatcaggatagtaaattaaatggcagtcttagagtggagttttcaaggtcttcttacatttgtaacatttgttgtcctacatagtcttcatacaaactataaattgagcatgagagacattctttttttttttttttttccaagactaacttttgctctgtagcccaggctagagtgcaatggcatgatcttggctcactgcaacctccgcctcccaggttcaagcaattatcctgcctcagcctcccgaatagctgagattatatgcatgcaccaccacgcccagctaatttttgtatctttagtggagacagcattttaccgtgttggccaggctggtcttgaactcctgacctccagtgatctgcccaccgcagcctcccaaagtgctgggattacaggcgtgagccactgtgcctggccggcagcaattcttttatatacttggagggtaggcacttgaagcccagaaaggctaaaagactaggacattaagtcatagaggagggtttttttttttttttttaagttttgttgttggtcgtgatggtgttattcaattcttttattatctcagaactcatgtcatactgccccagcctctgtatcagcattatgtagcaatgatgttactgagcctgatctctgtaagaggctctgaataaaatgagttccatgctggaacttatgtggagaatctatgttctgtatctctcccttggggactcttaatttcctgggtagtgaagaggtcctctaagaaagaagcagatttcgtggaacccaggatttcccatcctctttttatctgcactgcattttaggagcttttaaatttctgttctggagttgggcatctcttcaaggttaagactcaagggctgtttgtattcctcttggatttgcctacatttagcaaagcagaaactcaacacattgttgaaaatactgaatttcactgggcatatattttgggttgtctggaagatcccacctattgagtacactgcaccatcacccctccaactgctcatgcacttatcggacatatgttgttatttttggatcagaaaataccatcccagtagaagtaggagtgatcagtgtgacagagagctgtctgtattgcggctgtaaatgccagtgaccatggcattgagcagaccataggttatacttactgtcgtggttctcacctaaagtacacatcacactttgggtttccataggaccaggcaacataatgacccacctgaagatgaaatgattttgaaataccaggcccttatcatgggctagggacagtgtggacattcatatatgtgaatgctccttaaagcttccctataaccttggatactgctggtcacgtgtcccttaaatatagatgaggaaattacagctctgagacaattgttgttggtcagtatccttttgatcctttgtttgtaaatcttgcccagttggggctgcatgaggttgaaagctcagactgcttcacttccaacctcagctcgtccctttatgaagggaggcagctcaactgcctcccttccaacctcagctcatccctttatgagctcatagccttgggcaaattacttaacctgttggtgttcagtttcctcatatgtgaaatgaaaatgatggtatcatttcctcctaatgctgacttgaggattaaatgagttaacacacataacgcttaggatggtggtggacgtacaaaacactcaataagaatttgcttttgttattattacttgttcacatctatgcagcatttgtgcctgcatgctcacacactctagtcttacgcagcttattcaccaacattggttcgggatgacatttgactgttttcaaaagtcaaatccacttttcatggacaaagattttccttcataagtgttattcaaaagattgtgctgtctgccctgaaaacagttcttatggaggagaccaaaagtatttttggtaaatgacagtctgtgtagagtgagtcatgtcactagatgtgtacttggaagggcaaaacagttatttcaatgtacaaattattgcctcattactttatcacataccagaagagagtttgggatggatctaagaagtataacaaaaccactgcaagttgttctgtcatttagcatttaattaaaaataactagagaaacaactatttgaaatgctcagtgtttttcttctttttttttcatgtaacaatatgtttagtgaatttttcaaattactaaaagcattcaggcagttctagaaatttgcatcttgtaaccctttagttgtttttatttagaatgttggcattttacagtagtgtcaagtatggtaattatttttcatagatattgaatttaaaagagtaatccctaaacacattttgacatttggctctccaagacaaagtttgtaaaaaaattgtgacctgtgaacggtaactttactatatacttgtttgaccattatctaagaaatatgcctttaatgaataagagggaaaaagatgaggtcagacatcaaagtccctgtaattctaatgtgaacaaccatgattcctgaattccatgtaaattagcactacagaatgaaagcaaacaaacaagcaaacctcaaacagagaaacctcaaaattactagagccaattagatattcaaaggaaaagtctcagtttttaataccttataaaatcacacaaatacatacacatatgtgttggcatcagcagttttgatagacatggcttaaaataggagaaatccaaaaatagataaaggcacttttaatatggcctaagccatagcaggaagtattaataacatgccgattttttactccaaaaagaactgagtgtgcaaagcaaaccaagaaagaaatgtggactgggccaactaatgggtttctaatcattgttaatctacaagtgtgatcagtttattataaagtgttaatttttcctgtgggtaatacttggagaaatacagtataccactcatttccaaagtgatgaaatggctttctgtttggcatgcaggaaagtgaacctctttagtttagaatatgggttggatatgcttgccaggtctgggctattccctgctgcctctgagcgaaagctcaggaagccagaacctgaatctcttcgaggaagttctacagctgacttttaatcattgggccatagcacaacacctattagctcgcttacgtctaggtcagtagaacctcctctggacctcagctactcttcccactctgcatctcgagacacttgccttctttccatgtgacttatcgctaagctcctgactgcatgaacctccttccttccactggtccaagtgacatcattcccccgtcctcactcccaataccaccacttcagtaacctcccacatgttttcctgctctactttaatccagtctacacagagagagcagccagccactatcctgttttatttatttatttttttacttccttaacagacgtttactggatatgtcctgaatcccagtcactgtgttaggaagtagctcaatccgttgtctgtacacctccatgcatccgttccttcattcaatgatgagtacataggacaggccagttttgttctccaggctggtctcgaactcctgggctcaagcaatccacctgtcttggccttccaaagagatgagattacaggtgtgagccactctgcccagctccagggcaggattaaaggattgttctcccatgttggaagaaaacagagttcaggccccaaggcaactgacattttactgggccagacagtgccttaacaataatagggcaggcgtggtggctcaagcctgtaatcccagcactttgagaggctgaggcgagtggatcacctgaagtcaagagttcgagaccagcctggccaaaatggtgaaacgtcatctctactaataatacaaaaattagccaggcatggtggcgtgcacctgtaaccccagctacttgggaggctgaggcaagagaatcgcttgaacccaggagacagaggttgcagtgagccaagattgtgccactgcactccagcctgggcaacacagcaaaacctccatctcaaaaaaagagaaaaagaaaacaataatataattcaggtagtgaaaacatcccagaaaaaaataaaataaaatagagacgatgggaagtaatgggaaggctgtagctagcatggccacggcaggccttcccagcagggcatttgagggagacagaaataaaatgagaggcaagtgacgtgaatatgtgtgagtgtgctctaaccagagaggaagactatggcgaaggccttggtgagtctgagaaatgccaagaaggaaggccaggctagggagtcgtgagcaaggtggcggatgggaaaggtggggacacagaggtagggaagggggatgatcttgtggggccttttatgccacggtaaggaggttggattgtatcagccatgatgttttccttcttcctgtcaaggtgaaatttatatgacgtagaatcactcattttaaggtgaacaattcagtggcatttagcgtatttgcagtgctttgcaatcaccacctctacctagttcaaaacattttcatcaccccaaaaggagagctcatactcattaagcagccgttctgcattcctctacctccagcccttgacatccaccaatactactttctgtctctaaaaatttaccttttttgatattaagaagaaaagacacccacacatatactcaattgtgtccttccctggcttgttaccctccctccttcatcacacttaggctcaaacacaaatttgccaccatcccctcatcatctggtccttttccatttctttagtctaacttcctgctagtcttttcttcactctttaagagtaaaggcccagactcactggttctcctcaagtggtgtgtttgttacaattgatgaacccacattgacacacaattaccaaccaaagatgccatgctttatatcagggttcactcttaatattatgcgctgtatgggttgggataaatgacatgcattcaccatcatagaaactttgaattatgtgaggtagtagatgatgaaacaaacattacatactaggaaagggacgcctctccctttttttttttttaaagaggggtgttttctgcttggttttgtccattataaactgttagattaaccatttgtacagccaatgaaatagctttaagggaggcactcaggagcttgaacacgtccacagaaattccaaggtctctccagtatcaacttgcagtacgtcaagccagtacacatgggagagccttgaaggggtacaagatcagcctcccctctgctctttgaacacactgagcttgtggctgcctcaaagccttcgcaggcattatccctcttgcaaattttttcatgggtagtgcttcctgtcattcagttctcagatcaaacactacctctttaagagctcttcactgcctactttaaggcatcaccctgttttatgttgtttatataatatttcacaacctgacattctctcattcattcattcgtatcttacctgtttccctgtagaagtataggcttcatggtgagcaatagccttattttccttgttaacgggtgtatttccagcacttcttacaacactgccaggcatattgcagattgagatagtctgagtcttctgagaactaggattaggatttttttttttttttttttttttttttttttttgaaacaaggtcttcctctgtctcccaggctggagtgcagtggcgctatcacagcttattgcagtcttggcctcctggactcaagtaatcctcccacctctcatcctcctgagaagctgggactacaggggttccccactatgcctgggtaatttttgtattttttttttagagattgggttttgccatgttgttcaggctggtctcaaactcctgggctcaagcaatccgcctgccttggccttccaaagagatgggattacaggtgtgagccaaggtgcccagctccaggacaggattaaagtgtgaaaaaattattaggggatatacctgggagatcaaatgaggtgggagttgggagactggaagagctgtcagaccagatgcaggtctgactctcagtgaataagagacgaaagaaagaaagattgagtggaattattttagactgctgtgcaattcttttttttttttttttttttttttttttgagacggagtctcactttgtcacccaggctggagtgtagtggtgcagtctcggctcactgcaagctccgcctcccaggttcacagcattctcctgcctcagcctccccagtcgctgggactacaggtgcccgccatcacgcccagctaatttttttgtatttttagtagagatggggtttcatcatgttagccaggatggtctcagtatcctgacctcgtgatttcctgcctcggcctcccaaagtgctgggattacaggcatgagccaccgtgccctgccacactgctgtgcaattctaaagaattctgggagtgctgtcagagagtacttgagccaaagttgcccatcaaaaaagttttaaattcacaggagtgggtttgccttagcatagcttttgaactaagtaactggccagcagcagcatgtggaagcatgaccttggcaagaaatgtggccacagatatcagcacacagcagctggggtagctgatcaatgtacttccttcaatgagagatctgtgaggtgcatttccatggccaccacagagatgtataagaaatattagttcaatgaatgaataatgaataaatgaatgaatgaaagaattactccttcatgttatgtttataactggctcttcctccaggttttctgcctcacttttggctctctcagctactttattactgagaatttatctgtactgtctagttttacagcaacgctgggagctgctattatccatccccattttatagatgaggaaaataagcctccagataggttatgcaacttactcaaccaagctcaacaactaataaatgactcagctctgtcttctgaagttgacacttaaagcccatacccttagctattaatgctgtacattgccaatgcaaggtggataaagacgtggagaaatactctgccctgctgagtagagtcctgaaactgcaaggggtggggaaatagcaatgaatcctaggcttaggccaggtaactaagatgtgcctttatgagtttatcttgatcatttctttattcattcatttatcattggccatttattcattgttcactagtcggcaaacatttatcaaactcctttgcatgccagtccatggactaagtgttaatctttatgcctctgatgcttatcatctgcaccgtccaatacagtaagccacgtggagctattgagcacttgaaatacagttggcctcaattgagatgtgttgtgaatataaaacatatacagttctcaaagagtgaataaagaaaaaattatttttaaaatctcatgaatagtttttatactgattacatattaaaatgatagtttttggtcatataatgttaaacgaaacatattgttaaaattaattccacccatttctttttataattattaaggtgacattagacaattaaaaatgaacatggccgggcgtggtggctcattccagtaatctcagcattttgggaggccaaggtgggtggatcacccgagatcaggagtctgagaccagcctggccaacatcgtgaaaccccgtctctactaaaaatacaaaagttagccgggcatgctggcatgtgcctgtaattccggctactcaggaggtggagacaggagaattacttgaacctgggaggcagaggttgcagtgagccaagatctcgccactgccctacagcttgggagacagattgagactccatctcaaaaaaatgaacatatggttcctattataattctcttgaattatagcactggtctcatggatgatatagatagtggtctaaaagtccagaggtttctgaggtcacagagcccggagcaaatgtctgtggggaatgtttacagaggtgggagatttcacctgggccttgatgagagcactagattttacctgatggatgaagcagggaatggtcttcccagtgaatgatggaagggtggagtagtggagagaaaagcttcatccagttatttggggctggaattctaagtgaagttgtctcaagttgggttttctaggaaacagagtctgagctgcagtttagcatttttatttattaaagtgcttgtttattaaagagtatgcttaacttcactcagtatgtagatatgggcttccctggaaggggcaaaaccttggatgaggcagctctctgcagctgaggtaattcccaagaggaccagcattcagactgtcccccaagatcacactcatcaactaggatgacaagtcctttttgaaggaccatctgaagggtccatcacagtgtccacttcagttgtctagagaaatagagggcacagtgtgccttcctttactgcaagctcagtccacagggtctcacattagctgagtgtgtgggaggaagaccaagtgtctgtgatgtcaggtgggtatttcggagtgtatataaattacagtaagggcagtgtcaaatgagtatgtgtaatgcatctacccatggtccctagagtccactagaagacaatttcttggtgtttaagagattattcttttaataattcattgatcttaacaatacaatacatcaatggtttacgcaaaagccatgttttatctgcaatgcacttctaaattgaaaggtatcataaaatggcacttaactttcagaatccttatgttatctaaagctcagtttcagatttgtttgatgataacgaatatcctgtctattttattatctagtacaagccctagtttcggaactcagaaataaatgaggcaatgcctgcaggtgggtggcacgtgtaggtgcctgtgtgtgtgtgtgtgtttgcgtgttttggagtatgcatggatttggccttatagtttattgagagcatttttgcactggtttatagtcatgcagtgaagcacctctgcatttctcacctggcccatttagtgtggacacattcctttgtcaacaaggacataaagccacaatctcctcctccaaacaaaacaaagtgaatcgctatgtgttcggtataatgggattgagaagtagagttctctttgctgttatttctccataataggcccatgatttcctggcccctggcattcaggatagtgagcatgtgcaagtgattacgagggcagagcagttgccagttttccctgtagctttcagaatgtcatcagaaatctacacgtatgggcagtgaggtctggctctcccatgtctcccctgccccatcttgattgctctctctctctcttgctttctatttcccagaaacatgaacttactttgacttttccaaatataccatgttccttaccacccagtgtccttgcagctgccattccctctgccaagagtgattcttgctgggccccttttagatcacatctttattcctggtggacagaaagaaccaggacaacaagcccatgcctgtcccaagtatagctgagtgcttgacacttagagaatgtgaataagtgaatgagcacagcataaatgaaataccacaaacaggccaagccaaataaactctgaagttgagttttacttggttattaatgatctttggcacaagagtttcagtgacttgataaggccacaagccaagtgtggcctggttcaagaagtacagggatgatacagacaagacagaaaggaaataaattctatcaaaaagctcagctgtcttgaaaaagcaagagataagaaataacttcagaggtgggtagaattgagaaaaggatttctattttgttattttccccgaataaataagccttaaacatgtttgtaagctgctgtgaagtaaccagcagagaggaagtgattgaagatgagagagagaaacagagtaattgatgaaccaacgtccccgaggagacgggagggatgaaatcaagagtataggtcaagaggcgagcctgggagaggccagtgctaaggcaggtgatatttctgcccggccgttagcttttgtgcagaatagtgaaggaagaatcaatcacttcctttctggctgggtaaatgccaagaaattctatggcagaaacttccccaggcaggagactcagaattaattgttaggattaagcataaaccaaaacgagcagggaaatcccaagcactaaatcccaggaatggggccttcatggataaaggaacttcatctgtgaatgatccaggagcccagaatgccaagggaagtttctaggttcttggagatcaagttaatgcccctcataaggttgtttcacatgagccaaaatgtatattgattttttttttttttttgcctttattacacttccagaaagagagcatgatctcctggaatctgtttagggaataaaaatgtccgtacagaagaaaaaggttgttttttgaccttctgctgacactgtcttcttgctctcatcacagcttattttctagcaatatgaggcccacaaattaggaatctccttgcaggccttcaaatatgatttacctgattaataaaatcttagtggaatagatagtattctcctgtgtgtgtgtgtgtgtgtgtgtgtgtgtgtgtgtgtgtgtgtctgatgattggggttcttggatacttagggtgcagggatgagggcaagctgaccttgtttttcatctaggagacctgacaaagatggtgggctgagatagccgtgtaaagctaaaacagaaatacttagtgaacaagcaagtgtgtgagtgaatagatcaaagaatgaatgaaactaccctctgcactctaggttctagaaggcaccctgaaaaaggcatgttgcttggggtataataattgctcaatatatttttcagtaaggaataaaagaaccaacaaatattgattggattaaatggattaataactgataaacacttacagggctgcggcatgtgctaggtataatgtattacatagataaaatggatacgaaccatataccaggccctgtgccaattgcctgcatgtaactcaaaacaaaagacaaaggtcttgccctcatggagcctgaagtccagtgagggtttcgttaaacttgtaggacaccatttccatgccttccatcagtagagcagattctctgtgcagatacttttcacacaaacaatgcctaaccatcccagaaaatctgagcggtgttagcaacctcactttctctgagataaagctgagatttcttttagtgacttgtccaaggtcacatagctattacgtggcagagtcaagactcaaacacaagtctgtctcatttcaaaacttgggctgtttgcctatatcaaactgcctttaatttgcccattttaaagcaggaaagaactaaaaggcttgctttgatggatgtgaggtgatttgttaaaagcttaagagactgccatttttcatgatatgcgtaaatgtgccctaacctcctgaagcaatataaagtggttctttatgttcttagggtattccccatctaaggtaaaaattatcaaaactactggggagaaagcttctctggagatttgccttataaaataaacagaaatcaattttgacttgttttctaatcatgataaatgaagccaggttaggagaaaaaaaaaaaaaagtcccagcattagttgaggatcattttgccaggatacattggtctttgacaagcaattaagaagtcctgtgattgtgcctggcagtgccacagctcagcacactcctgattaattctcattttctttctttcctcgggatttatttactcgtttcacttggaatgtgtttagcttcttaacctcccccacccctcttttctcacgtgcttctttgcttggccccctacaactctacctatacattaatcagtgtcatattcattactgctggtgaaatgccatacaacattggcattcattcatttttgtctcttctgttgagccattcatggtagatttccccaacgaaacctaccatgtttgttttctgtatttcccaccagatgttcttttaaaagccagaagatgtctgccttggtctggttggtataaagagggttcatccaatataaactgccaacagtaggttggaaatactcatcagtatggaaagggcgaagtctgggcaaattggatgggtcttggagaagctctaagagttggaatctacatcatcatctttgtcttcatggctagcaactgttgactcctttctctagttcaggcattctgtctgactcttacattatttctttgaatccttacaacaactctataaagatggtaatggaaaaagacaagatgaccaagattcagagactttaaagcacatgagcagtaagtggtgaaaccacctcaggcctctgcctgttgacttattcataggataacccacagaaacactaattcaaacatggtgtcagaaacagcagcagtaatgaatgcctcaatgaaaaacatttggcccagcaccttggttaggttgagtttgcatggcaaccctattgaatcatgggtttctcagagctgggagctgcaccatgccatctacctgcacctgtcctctttggaggctgggttggtgtttgaccctgtgaagagctttggattgctttgcctacccgcagtggacttgctcacacataagtgggagccctagctcatggtctccaaatttttatcctcatcgtttcttcccacctagttttttcctaattctggcccttcctggccacccaccctgccattatctttctctgacgcttaggacttgaacccttttttcatcctttttgttttattctggtgttttagtcgtgagctaactggaaaatgcttctcacagtttaattgccgtggaaactttctacttggaatcagaccctaacgggttttttccctttccttagggggctgtgcatataggaaaagggaacatatatgttatccctcatgtgttaggggctgtatagtaacaagcctggaataacccttagagcaccttcatagggaaggtagggtttattatccatgtttcgtaaataagagcactgaggttgagagaggtgatgcagattgctgaagtgcctatagctaggaagtggcaagtcacaatggggccccagttctgtctgctctaaagcccagtctgtctgtctgcttctctgtatgtctctctttttctctctccctattcttctggaagtcatagaatcctgtgattctcttccaaactgcttttttttctattaaaattataacccgttattaaaatatttaagcacacaaattaactggtgctaattatgatattttgaatggtaataagcaattagagtgagatttaaagaagaaaaaaacacctgtatataacttggcatcttttgtaataaatacaaacacctaaatataacttggcatcttttgtaataaatacaaacttttgtcaatcatgacttgatctaaccgatatgcctcaggtctgcacagaacggaaatgttttttggaaatcctagtacttcagaaggctttggcatccaaatccattgcaagtagctttctatttagtctctcattttctctctaaagagagattgatatgatgatttttagcttaatttgagagatgttgagttttctccaagacaccctcgttggttcaccttgctctgaatcctttgtcttctcaccctttgtggcaaattgagacgggggaaaactattaggttggggcgaaagtaatttctgtttctgccattacttttgccccaacctaatacctcccagcaaaatgcaggggttgcggagagaaagggagtgatgtatggagagtcagtcatagtacatgtgcaattcaagatacctgggtgggcatagtagtctttcccctggagttctatgtcattgcagcctcctctcccatcacagcataatttaagtgaagcaggtttaacgggtggtcagtatttaccagagccagccttctgcttctggccagctgggtgacttgactagcagaccattactccatgtgggccaccgtttcccatgaatagagtgcgacatttgaactaaatgaacctaggtttgtcccatggagtgcagtttctccctaaatgaacctaggtttctcccatggagtgcagtttctccctaaatgaacccaggtttctcccatggagtgcagtttctccctaaatgaacccaggtttcttcaaaattctagaggctctgactctagcagctgcaattggactcttccctagaagcatctcgctgagtctgagaaaggcacgtcaatgattcttcaagggaagtagggggaagcagaggcagtgccattcacaatgagccacggctgctgacagcagttctgtaaccatccggtgtgtttagacgggagaaagagcttgagaatcgcgattatatggatcatctctctctagatggacttcttttatgggagataatactgaggttaagaggttaagcaacttgctcaggtcacgcagcaatttataatataacaagatatttatgagtaaaacatatatgaactaattatatatctgatagtcgtttttaaggaggaagaagttaccataagaaaaagaaaaacaggacttgggtgttataccatgaatcacacgtgtgtgtgtgtgtgtgtgtgtgtgtgtgtgtgtgtaagataattttttcagcaaattaaaaacaaagcctaagaaaaatgagaacttcctgaacaaaaatattcaaaatgatgactaactagaaagtatcagaaaccacattttccttaaccagtactgtctcatacaaatataacataagtcacacaagtaagtttaaattttctagtaggtgcatcaaaaaagcaaaaagaaccaggtaaaattaattttaataatgtactttaacccatatctaaaatgtgacttcattgtgtaatcaatatgataaattattcacatatttgacctttttgtactaagttgttagaatccagtgtgtatttattttgcacttgtggcatgtctcgattaggacgagccacatttcaaatgcttagtaaccacacatggctactggctacagcattgtacagtgtggcaaaagtttctctcctttttctcttttcccaggctctgttgaaatttttctttcagaaaaatatttaaataggatatactctgactttgaaaaaatacacatatgtgtatgtttatataagtatatgaatatatacatgcatatttctatctatctacctgtctaatatctgtcatcgatctatctacctacctacctacctgtacatctatctctctagagatcttctccacaaaagcaaggaaagagaatctctgacactatattttcttaatgaagatggagaagtttttgcagttctcattatttcatttcaggctttcagatgttcaggagccctttactagaaggttgatagattaataatctccccactaagcttatagcttagcagacctccatggtggccatgatgaggattcctttaacacatgattggcccttagtccccatttctctggtgtgagttttcagcttttgttaccacatcaaagctccggcaatttgtgcaggaaaccccttgaagcaatcatgaacccacttgtactgtaagagttcttacttccatgtcctaaaagaataataaccacaaaaggatatttccttgctaatggactggggagaatggactgtgacaaaggctggtttctcattgccaggattttaatgaggggactcacctgaaaatgtctagtgcacattaggctcttctaatagtttccgagagctggagtaacagattaccactaactcaaatggcttaaaacaacagaaatgtgttttctcacagttctagtggttagaattccatattcatggtttcggcagggctgtactccctccgaaggctccaggggaggatccttccccaccccttcctagatgctggtggctcctggcagtccttggcattccctgcaggtgcatcttgccaacctctgcttccattgtctcatgacctcctcttctgcctctctgtctgtgtgtcctcatgtgtttttgtaaggacaccagtctttgagtttagagcctaccctaatctaaaatgaccgtaactttgtcacatctgcaaaggccttatttccaaataaggttgcattctgaggttctggatgaacatggattttggggaggcatcatttaacccagagcaactgtcactaaaattttcctaccaagatcccttactctagtttaattggcctcttattcaaggcctactccataagttattttggaatatagaatttcagaacagaaatgggatctgatgattgcctagttcagtggaaccctttctttaaatggaaatttagtcacagtaaaggacagaaaagaacgcgaaccaaagcttaggtgatatgtttgcaggaggaaggggtggcccacagtgacccccgctgccccctcctctttacccctcactaggctcccggaagacttccagagcatcccaagggctccacaaacccctgtttaatcataatccctttactgtagggattaaaaactactgtttagggagatatagtgaattttcccaagtcacactgcaacttgaatctgaggcttgacccatctatgaaatatccaaactgtcggtccattcatttctgcattaccaacaatggtcagttatatatttttctttgagaagagaaaagcaaaacagtccatgcttgcaattcttttcttcctttttgtaaactatgacagaaaattcatggtgaggccaaagccatgacaacacctgtgttgcctcacattgattttctgtttccaactggaggaagaggttcccggaacagccacttttgagtcaagtgtgtgaggaaggagtctctcttgccaaggactgctgtagatgattcctgcatagccagcgctgtgcagggcctccacttgagtgagcactctgttcccattctatttctcactagtattttgagtatgttccccccaaagtagagatagtatgtctttgaatgcaaaccatgggctgagccctccaaattacttttaaaaaattagcttcttcaaaaaatttttttccacttccctactgtcttaaatatactggtgcttctgccctaagacctttcaggaaaggtacatgttctacctgatttacaacaataggttattctgggtaaataatatatctgttggatttattgtgcttattattttattggaccacactatccttaacctagagaagaagcttgaggaaaggagctagggtcaggcagaagacaggtatgttttgaaataagaaaggaaaaggaaaacgtctggaaccttgacattccacaggatattgtcccatgaatacaaaaggtgatgggtagctagaacctgagggaggaggtgccttcttttggaattaaaattccagaatgttctggaaagtgccagatgcaagaccaagtaggaccagctagtaatggaaattcctcccatattgacaaggttgatgaacacatggtgggtgcagctcatggaacactgggaggtcaaaagcggtctcagttacctttgtacaatggacatggcaccccaggttaacacaggggccacctgcccagcaggcatgggcatcagatgaaggcattttttaaacaccttatttaacaattcagagtctagatacgagtacattctcattttaaatagttcagaaaaacagatattcccttttcctccttccaaacatattcttcccttagaggcaaccaacattattagtttaatgaatcactttccagacctttctctcacatttaggtacatacaatcacccctcggtatctgtgggggccaaaatccagaaacctctgtgaataccaaaatctgcagatactcaagtctcttttataatatagtgtaatgtttgcgtaaaacctaggcacattctccctatacggttgacccttgaactacatgggtttgaactgaatggctccacttatccacatgtttttaccaaatggcaaattgaaaatacagtattcataagatataaaacctgcatataaggagggtcactttttcatacacaagggttccacggggctgactgtggggcttgagtatgcatgggtcagggtatatatgtgggggtcctgaaaccaatcttctccatatacagagggacaactatactttaaatcatctctagattacttatgatatgtaatacaatgtaaatactttgtaaatagttgtactgtattttaaaatttgtattatgttttatagttgcattgttatttttattgttttaaacaatattttcaatccatgattggtcaaattcacagatgtggaacccacagaaactgaggactgactgtatatgtgtgtgtgtgtgtgtgtgtgtgtgtgtgtgtgtgtgtgtagacacgtagaattttgtgatctagaagtgttaaatataagaggtaattatgtgaggtaaataaaatgtgtgcgttaaatataacaggaatactactatatgaatttttctgaaatttgtgttttaacattttaagttgtttttaactattctttggtacggacattgtattagtctgttctcatgctgctgataaagccatacccgagactgggtaatttataaagaaaatagttttaactgactaacagttccacatggctggggagacctcacagtcatggcggaaggcaaatgaggagcaacgtcacatcttttgtggtggcaggcaagagagctcatgcatgggaactcccatttgtaaaaccaccggatctcatgagatgaggggaacagcatgagaaagacccaaccccatgattcaattacctcccaccgggttcctcccacaacacatgagaattatgggagatctcatcttattcaagatgagatctgggtggggacacagccaaacgatatcagatgtacttcgcatatcatgtatagatgagaaaacaggcatttcttcccaatttttgcccatacacatgtggtggacatttttcatgtgcaccaatatctggtccttttctgcttcctggttacaagaggttttattaataccttccctccctgccttcttggagttagctgtggccatgccactggatctgaccactgaaatgtacttggaagtagtggcatgcgacccttctcagccaaagtatacaattgccggtgttcaattctccacccctctttacgcatcccatcaaatgccgatgtctgagtcatctgtgtccctgggtgtctatgctcatcagaatcctgctgctgacctgcatgcagcatgtggcacaggcaagaattaaacccttgttgtttgacatcatgcagactttggaactacttgtcatcactacataatccagcctattctggccgatactcatagctatgagcagccttgtacatgcttctctctgcacctgtgatgacatttctccagtaatgaatgtctattgaaaagttaaaacattaaattgcttttaaagtaccttcttatccctccagcccctaccttttgtccctaggctcctctgcatctgttgactttagattttttttgtattatttattcatgttttattagataaatatcttccccagacaaaccttgaactccctggagtcaaccgattcccttgcccaagcctctggtgttagtgattgtttcattaaactctagtctcaaggctaatccttgttggaaaattcgttctgtcctataagaaggctcccaggctcctagtctcaaaccactaaacaggccgcacaggtgtttagtggtacttattggtggccatgtgacattgttatttctctttgcatatttctcatatgattcacagtgtttaaaaggattacctttttggttttggaggtgcagatttagagaatgggatttccaaagccatattgtccctttcagagcacagtgagggtgttctttcttacccagagggtcaacagtgccacaggcttgccagtggatgagtttaatcaactctgactgtgtggccagtgagcaaagaacatgacaggggtttctttgaggtgagcaatgccctccgccagaacctagaagtagggtaatgatgctgaggttggtgtacactcagaactcagtactgccgcagagtaaggcagacccatcccacctgggctgtagctcccacgatggtgagtccctagatcgtaagttgatgggaagcataagaaggtcagaaccaaaccagagctttgagcgttctctcactgcattccatagtttccccgagcgctgaaattctttgcaacttccattcatttgcacatctcatctggctgtaaggcataatgtggtctgtgtgaaaaagaaacttctgcaaaagagtcagattcagagtttatggcaacatcaaggaatagtttatcagttcagctgagtataaccacttgatttagcacttccttttcatcatgcctctcccctcatcacaaaactgcaaaggctccctgtgacatccaaagcctctttgtctttccctgtttaggaaaaagtgacctagagggaactctgcaggggctacatacggaatcttgatgttgcctcctgcctgctgtactgtcctggttaaatccttcctcttctctaactctgtgtctccatctgtaaaatggggatggtaatagagcctatcctgcaggataattgtcaggattaaaagagttaacccaaaacagataataaggggttctgaagatccaccaggagcctcactcagacaccttgatgcagacagcacctggtaaacatgggtgttcagaagtatggtccttcccttacggccccttactcaatggccatccattgtctgctgagcctaggtccctcacacctatgccccaggctcctgtcctggaatcctggcttttaccaccaaattccccaaaagccccgtgagtggctgttttgagctgagggcacctgctcctactggcttcctggagccttagacgcacccagtgctctggacctcccacaccttgttgaaccacccggcacttgctgactcctctcctgaacctcatgtgcttgtgacccacgattcagccactgtctaaccagctcttccgtgtgcagccctcagagccccagctcccacggctctaattccacggccgcccctgccgtctcttcagccatcccatcccgccatcaccatggaaacctgtgggaacagcagcttttcctcatcctcttctccccttaatctccagcccactcctcctccctcttcttgtctgtgtccttcccctgagacatgttcaaatgttgtttctgcatgttaatattttcttaactatttagtgaattcatcatggcggagggagtgagcacgaatggactctgtcatacttcacagaaattaaacctgagccagctaaatatcctttcctgctccattctaaacctttatgggtctccacaataaccagtaactccatggttgtagagttcagataatcatgacataaatgtaggaatgaaggcaaacaggccggcccttcccccagatgactggggtcttcccagctggtgtaaaaccctcttctaggtcaaaacatttcttaaagtaaatgagtgatgactatgacaggtgggaaagtacataaaataatgtgattgaaatactcttagttggttctgctccattgaccctagggaggaagaaacaactaatttgtgctttctgttattgcattgaaagagagtggtgactcgccgggcgcggtggctcacgcctgtaatcccagcactttgggaggccgaggtgggcggatcacgaggtcaggagatcgaaaccatcctggctaatacggtgaaaccccgtctctactaaaaatacaaaatattagctgggcgtggtggcgggcacctgtagtcccagctacttgggaggctgaggcaggagaatggcgtgaacccgggaggcggagcttgcagtgagccgagatcacgccactgcactccagcctgggtgacagagcgagactgtgactaaaaaaaaaaaaaaaagagtggtgcttcaaaattgtgtctttttcaacgtttgttgtctctacatggtaaaatctgaatttaggcctaattcaaaatccatgagattgggaatgggattgggaatctcattatttgcattaatgtatgagactctctgagtaagtgttggtttaagtaaatttttttcttaaaaaactcagtagaaatggaactcagattttaaaatggactttaaaatggtctaaaaagtgtttctaggtacaaaatgaattggagtttacctattttttccaaagggcaggtagcaggtctgaagtgagagagggaaacgttcgatgctgcgttgttctgggagatgtgagccgccggctcattcagaatgtgcagggatgtccattcccacaggagcatgtgtcgttcagccaggtgcatgttttaccttgatctactgtgcttggagccttttctttcccagatctaggtctgatacctgcccctcctccttaccctggactgtaattaaagggaatatgtggaaatccaggccacaactattttactttctgtgaataaggccatcaagttgatggcttgttactgtgggtcgatgggtcaaacatgaggcaatttggggaaacagcctaaggtggctataccacagaggccagcagagcaggtaaccaggcacaagatgcgatcgctgacgagagagctgctgtgacagagtaaggagtgcatggggaggagggaccactgaggtttgtctgcgtgtgggtaccccatgcgcagatcctcaacagccgttccaaggaagtagtcatttgggagatgaagggggtgcaggtagaggagtgggggattgagacagggaggggaagccacctagctagtgaggtttgtgtagcaagaaggtaaccactcggagcacctggagtttaatccttaaggagactgctgagaaacagagtggtgcacacttagggttattttactgagaggcaggagatgtagacagcgctgggggatgtagacaccacttgttaaaatctggcagaagagaatttagagaagaaaggtattgctgtgtggtaagagcaatgacttggtcaggatgagggtgggcatggagctctgaggaagggacgtacagaaaccaggacagaactctagccattatctcctttcttctagcgatctgacaaggtcctgctagatccttcactagactctagggcaggcttctacttagtacaactgataccaccgccatgcagccatcatggcccctcccagggcccatttgttagtaataataataataatgcttaagaagcattgagtcctaactgtgtgtcctataaactatcataacccgtatagtcttcataaagatgccttcaaggagacactcttattatccccattttacagggagaaaaaaatgagcctacgttcagcaattttaagcaaattttctattgtctcatgactagtaaatagtggaataggccagttttgttttttcaccttgactgactgcaaatgtctcagtcatgattcctgaccatcttctaaccctctaaggacccagacactcctaagtagttaaagagtctgacgttatcaatcaatggaaatattttcaaaaggtaaagagaaaagaaattaaagttatgatgatcttttaaggcaaatcctgctttcttgaagcttggtcagccctggcacaggcaaaagtgcatgtcatttcaaggcatggggcaggtgaaatggaacacggctgtcctggcgtccacaactcacaggagagtggagaatgtggaagttacatgctccatttagacatcagtgttctctactacaaaatcgtttctgcagttcattaatcagactctccaaatttgtttaactcattatttataacagcattaaatccagtgacaccaaacggtgtcaccatgagtatcaggaagtctgattttaatcctcagaaaatgtgttcaatgtctttccctccctcctccacacttaacagggacagtgaatggaagccagtgttaaatttgcacgatgtgcagtggtctaaactttcactgaatcctaatcaacttaatatcctgttgcctttttgaaatccagtgatgaaatgtaaccctgagacagcttaaacagaactcaagcctggatgctctctgcaaaatggtctaatttggtggttatagcgctagtattgtatgtacaatgatcaaatcctgtgttttcaattgtcctttttatggtcaatcaaggcggtcttaggatatagatttaatatcgcaagagtctaatgtaacaggctaatgcatgccctccagttacagggagaatgtctttttgtgacagtggttctctgggtacgtcttacaggcttctatttttgaacttgactccaagggccaaagcagcacattttggaaatggttttgtaaactgtaacgaaggtatctttcttcagcagcttcctgcccaaagacgccagagtgctttacaaacttatcaaagtgatatacagggatcgttttagcctctgctgaaatacaggggcccaggggggaaattacagtcattgttgaaaaatcttagattgtcaggtcgacaggaggagggagagtgtacagcacctaaaatatcctcccaaactggatggcatgtcccaagggctgtggtcttatctactgcctgctgcaggtgacgtttgtgaaaggggtcctgtgagttttgatgattgtctctcttagacatgctggtaatacagctccttgtaaagctgattcttcccttggatttgctcatctcatatcagagactttaaggtaccctctgacatacaccctctacaaaataggcatgttgcattttttggcatactagaccatcagaaggggaactgctatatcacagcctctggaatcctggctaactacagggaagagatgtctgaattatagcagaacatgaaagaaggcagcttgtgctttaaaggaggtgttcaaagcatgtctgagcagagacttttgggctctgttttaattaatactttaaaataattcatatttaaaatatcagatgtttccataaagaggaggatgtttaaatgcctccagactacattcctttttattcttgattttacctgggagtccaaagttcaattccataaagcaagcgtttatttgtcactttcaatatacatcgattgccatgcttaagatgcaatatgggctgcggaaataggttaacccacaggctcccagggcccagtgtagaaggtgagagattcgtgtaaaatgattcaaataaaaggaagaccctggccgggtgccgtagctcacgcctgtaatcccagcactttgggaggccgaagcgagtggatgacgaggttaggagttggagaccagcctggccaacatcgtgaaaccccgtctctactaaaaatacaaaaattagccgggcatggtggcaggcacctgtaatcctagctagttgggaggctgaggcaggagaatcgtttgaatctgggagttggaggttgcagtgagctgagatcgcgccacagcactccagcctgggtgacagggtgagactctgtctcaaaaaaaaaataaataaataaagtaaaaataaaaaggaagaccttgataaatgccatgatagatacattctcataaagcccagtagcatattcgggaggtttatgagaacatatcaataatttttatgtttgttaaaatattttaaacaatatttttatgtttgttaaaatatttagttgtagtttatcttaattttaattttgaagtaacagagcaggagacctaaaaaatattccctactaggagatagttgtggaatatatagcatttgtatttctacatttttatgtgacacatttaggtgttccttaaataaaatgaaattgaccaaagttctggttagtatgtagcaaactaaaattatgtgaaaatatccaaagccttaacagagctaggatattcccgcatccacactcacacagctactcactgtaaaagtgatcgttgacaaacataaggaggcaaataaaagggcatagcctttgtcttttaaaccactgtgacaggaaaagttatggggagtgggtcagtgaggaaggaagtctgaacattgctgcattcaacagagaaagtaaatgaaaggaagacgcttacaaataagagagaagaaaggaccgcattaactctaaagaaggggctagcaggtcctgtggagccgatggggcagtgcaaaagcctgaccatgctgatctccattgggtgggtccaatggaagaacgctcagggttacgtcaggaaggtgccctagttttggggaaagaacatttcaactcaggttcagaggaaaatttagatatgttaaaactttagataagttaatagacagggcagaaatgaaagaaagaaagattcttcacagggaagtcctggctatctaactgtgaaaacctgaaagatagttgagaaaggcaagagaggcaagaaggagtggaaatgagggggattcagtgagacatacgcaaagaaagggagagaataaaatgatacattcaaagaagcgtattgtgacaaaatgtgaacttctctaataaactcagtttaaaagagaacatataggccaggtaccatggctcacgcctgtaatcccagcactttgggaggctgaggcaggcggatcatttgaggtcaggagtttaagaccagcctgaccaacatggtgaaacctcggctctactaaaaacacccaaaaaattagccaggcttggtggctggcgcctgttatctcagatacttgggaggctgaggcgggagaattgcttgaacccaggacgcagaggttgcagtgagccgagatctcactactgcactccagcctgggcaacagagagagactccatgtcaaaaaaaaaaaaaaaaaaggcatgtaaagtaaatggatgcacatgtgaggagcagcatccatgacccatcacaagtgtatgggatcctaaagcttcctgacaattgcaaatgttaaataagccaaagatcacaaaaagaggtttgttttggcagttgtgcacaaacctgctgcgaggcagctggtgccctggtaaaaggtggcagagcaaatgcagaaccacacaggtgccgggtacctcctttctgtggtcaaagaaaataatcatcaccctgcaaaagggttggacaaatataaataggagaaaattgaaatccaagatagttgagaagattataagtgtatcctactgatttaaacgagttcacacctatgaaactagatgaattatttctcacagaagacccggagaaaatggtgattagaatctctgcaccagtttctgtgatttttttgagacatcctgaagatgagaggtgagtagacagcagatgggcagggccagcatggtttttgtctggttatttatttctgtggaataagttcctagaaataggatgtctctctgggtcaaaaggtatgtacactttcacttttttttttttttttttttgagacatagtgtcactctgtcacccaggctggagtgcaatggcactatctccgatccctggaacttctgcctcccaggttcaagcgctcctcctgcctcagcttccccagtagctgggattacaggtacccactgccacgcctggctaatttttgtatttttagtagagacagggtttcaacgtgttggccaggctggtcttgaattcctgacctcaggtgatctgcctacctcaaccccccgacaaaatgctgctattatgggtgtgagcccctacgcctggcccacactgtaacttttgatacatattgactaattgctcctctccagagtttgtacccaaattataaagccacccagagtatattagaggaccatttattatacctgtttgataaaactatgcatttttatcaaccaaatttttaaaaattaatgtggctttattgctcataaggtttaacttttttcatgtatttattggccatttacatttctttagtaaaatacaagtaatgttccttagtacatttttctgtttggctttttgttttatagtactcatagtaattgatatgacaagaatatcaattttttgttggcctatatattccaaatgtgttttttaaatgttatatttcaatcttactttttacatctttgtcatatggcatctttactttttaaactgttattttagattcaggagaatatatgcaggttagttatataggtaaactcatgtcatagagatttgttgtacagattatgtgatcagcctcgtactaagcctagtatccaatagttatttttttctgatcctctttctcctcccaccctccaccctcaaataggtcccagtgtctgttgtttcccctttgtgtccatgtattctcatcatttagctccaacttataagtgagaacttgtggtatttggttttctgttcttgtgttagcttgctaaggatgatggcctccagctccatctgtgttcctgaaaaggtcatgatcttgttcttttctatggctgcataatactccacagtgtacttgtaccacattttctttatccagctcaccattgatgggcatttagtttgattccatgtttattgtgaatagtgctatagtgaacatatgtgtgcatgtggccaacattttaaaagaaatggagaaggtaagttctggaaactggtagcagaacttaagccgcggtataattctgaacaggtccatctgttcgtcatcattcatctactctaaatccatgcatctctgttcattcagcaaatattgattatgtgcagtgtgctaggcattaggaaatatgctagaaaacaaacagaaataatagtccttgccttattgaaacttagagtcaaatgaggggaattattaaacacgttttgtgaattttaagagggcaatagtgagatttgtttgatagaaagagtaatatcgagatcaaaatgtgtgtgggtggggtcacgatctttgtgttagtcagggcctttgctactgcaagtgccagaaacttaaatcaaagtggctgaagcaaaagaacactgcatgcctcatgtatgcgagaagtccatgaatagggctggcttcaggcctggctgggtgtataaattcagatggcaccctccaccaggacttcgtcttcatctctttgcttggcttttgtctgtgttggctccattccccatgcgtcaccccttcccaaacctcttacatgtttttattttcccataagttctcccctcataatgcaaaggtagttgccagcagctccaggctcacatccatccttcagagaaactccaatggaaagagtctaacacagttcaaaccaaagcacaggatgaagttcacttaaatgaatatgggtcctgtgctcgtccatgaatcagtgatgtggccaacaaagacaacatacactggtgatcatgacctgggtcaaagtcaaatgcccctcctacaactaggaatggagtcaccccatctgtaaacagactgagagtctgtgggaacaaggcagtttcctatggaaaagaaaagaatgctgtctggtgaggctgtctccactgcaggccccactgtggatggtgctggtcagagactatcaggggtattaggatccattttttaatcttatattctctctcacacactctcttttttccccctctcttggcttgatttcactagttagagccttctttacaaaatcagacagaagggttaagaatggacatcattgccttgtttctgatgttaagtggaaagtatttcatctattaaacatttataccactaagtatgatgctccctgaaggcttttcagatgtgctctttatcatattgagtgagccccattcaatttcaaatttgttaaaaatcttttatcatgaataagtgttagattttatcaaattttttttctgcatcttttgagatgattgttgtttttgtcctctagtctattaattaagcttattgtattaattgattcttgaatattaaaccaaccttgcatacctttaataaagcctagttggttattttccttgaggtgtacaatccttttgataagttgtattagttttctgtggctgctgtaacagattaccataaatttggtggcttaaaacaagaaatttattttcttacagttctggagcccagaagtccaaaatcggcatcagtgggtggaattaagtgctggcagagctacactctctccagaagctctcggggagcttcatttcttgcttcttccagcttctggtggcagctggcattcctttgcttgtagtcacatcactttgatcctcaaggccactatcttcaagtatcccttttctctggtgtcacattgccttctctatctctcatagaatctccttctcaattccatttataagaaaacagtgctggcatttagggaccacctgaataacctaggatcatctccccatcctaaaatatttaattcaatcacatatgcacagacatttttttccaattcaggtagtatttacaggttgcagggctcaggatctgacatctttgggacccattatcagtctactaactatgttattaaatatagcttgcaaatatgttgtcgaggattttgtttttatattcctgagagatattggtctttttttctttagatatctttaaatggctttggtagtaatgtaataatgtaatagtggcctcatagaatgagttgggaagtgttctctcctcctatattttttgggagagtttgtaaaatactggtattatttcctctttaaatgcttgataaaacttacctgtaaatctatctgggtctgagcttttctttgcagaaatattctaaattactgattcaatttattattattattatttgtttttaactgttttctgctattaagatttttaatttcttcttgaaccagtttggtaatttgtgtcattctagaaatgttttctatttcatctaaatagtctaactgttggcataaaattattcatagcatttccttataatcatttaaatttctgtaagatcagtggtggtatgccctttgttatttattaatttggtgatctgtgtcttctctcttttatcttggttagtttaggtaagatttgtcaattttgttgacattttcaaagagcaaatttttggtcttattgattttctctgatgcatttgtaccttttttgtgtacttcaaagaagccattggcaaattaaatatgactggacaacttttcacataagtaactaggaaaggtaaggaaagacacagaatataattcaagtccctgaaggcctgtattacagaagaagacataggcagattctttcacatgccagggagtagaactcagattagtgtatagaagtttcgaagaagcaaacatgagtgttgttgcccccatcctagaacacagactctagaatcaatcagatttagaccctaattctggccttgcccctcttcttgttgtatgtattaattaaggtaatgtatgctgctataacaggtatgccttcaaaactcaggatcttaacaagttggtacttatttcctgctctggagagaaaagctcacagagaagaattttatgacccatgcctgaaagtgagaattctacttatgtgcacattctgttgactagacctaagggaggctagaaaattagtcaaatcatgtgcccgagaggaaaataaaatctctttggtgagccactagctagtctgtgccacactgtataacctggggtttaactactttttgagcttctgattccttaaatgtgagaagggtatacaggcctaccttgttgatattgaggatttgattccagacaacggcaatcaaggaaatattgcaataaagcaagtcacacatattttttgtatcccagtgaatatgagtcatatttatactgtagtctcttaagtgtgcaatagcatcatgtattttagaaagtatataccttaaagaacattttattgcaaaaaaaatgttgacatagagactcaaagaacacatgttttaggaaaaatggcgccaatagacttgctcaatgcagggttgccacgaagctgcaatttgtaaaaactgcaatatctgtgaaatgcaataaagggaagcataataaaaggaagtatgcctgtaataatttctgtcacatgggtgtgtccatactgctcagtatctggcacaaggtgggaatttgatgaacatttgttccatgagtgaagtgagtttaaggactggtgtgcatggtatgctcagaactacatttggtttatagtaagggttcagtacataagcatatttactgctgttattgttcttaagactttagagaggaataaagccagacaagaacattttaagctgaagtttgaagagtgaagtttccatctctaaaagttttcaggcaaaggccaactcttagggaggtcacagagtcctacttttgtactctgaggctatggaatctagtggggcatcagacaaaccatagtttcatttactatcttgtaacttcaaggaagccactttactttcctgagtctgtttccttggatccaaaaacctacttagtaggatagccatgaaaattcagtgagataaatcatatgaaaccagaacacagctgatacatgcagtgaagcggctcttaaatatgtgcttctttcctcttacttcgcttcctctttattttttcctggtctatgatacagaaaatcgtctgaattaattgcatttgaaacgaacattggttgtaatttaagataaagagaaaattcctaggttgggaattgggatcctggttctgcattttcccagcccttcctctctgcaaatgatcacagaattacatagtctggaccccaaaagcaatatcttctgttacttaggattcaaggcacacatgtttgtaacaattggcttctcaaaacttgtaagaactactgatgggtaaacaagtcatgaatcagttttttatattcaatcaaagttgatggagattacccaattaaataactggtatataactagtttccctatttccttttccctgtttcatagaaaaactagttatacattgcttttctgtaagaaggtggtaaatgtaaattgagaagctcgaggttagcaaaacagaagataatgatcaaaggactccatgtctatgtggttgctttatgataatgctgaatagcagccttgttcatgcagagacaatataaaagcctttccccaacttctccccctcctccaattcgtaaaagtcaacataatgttaaaacaaaacaagaagtttagaattaggatgaaacccatctagtaatacagtaatgtcaggaggacaatatcaaaacaaatatttatttactcaggtggtggttgcggttttcgggctttttctcagctgcggtgcatttgtggcttttatttctgcactgccgcttgttacttggagccattacttcctatctgtgttgtcaatcgtgtcttgaggttattctagcaccttacgaaaagccaccatccacctaattttagagcttttaagataaagcccgggagcactaggaaggtgagtgagttaccgttatcaatctggaatgtgaggtttccagtgcagtagcaccacctcttctaggtcaccatggccagcccttctcagaatacagaatgatgtaataaataatgcctgtgtgaagtgaaagctttgagcaatggaaccagctaacatctagaattttattaggcacaaactttctcagatgttctcagtgctattattaccccctcgttaaagctggtaattcttgtttttaaagcactttggagacactcattgatacatgcctgaaaaaaaaatagatgtttattttttccttaaaaacttcgcatgagactttagaaccgtatacgaataatactctgattactgaagtgggtggattttccagtctttatttttcttccattaatcatcttaagagatccaaactttccctgccatgaaatgccagacttcatgctgcaagattcccctagttgaggggaagggcagagccaaccagagcccctggccctctgtcaggggctgcctcctttagctctcagtaataccatcagctcctggcctccttatcaaagagggaggaggtgacataaaattagagaaatggcccagagaggtggcccctcagagcacccctagctggtgtttaaaggggagcagttatgacgttgttactgcagataattgccagttgagtgtggaggccctgtgttgccagtcccacccactgatcaggaaaagctggtaatcagccatggcatttgtatgctgggaaggaagaacaatgggctacaccagctttatgtcaatcagcattgccctgacatcccctatcagacttctgcttaaatctttttggctagaacaggtcatgcactagctgcagaggaggttgacaaagtgagtattcgtgtccccagccattgtggcagatgaagatcaggggaaggtttttaggaatgggtatggcatggccaacctgaacactgcctaccaacatgtagacatgatattggctgggtattaaaggaaacaaacatgtcagacagccagaaatggcccacagcccatgaatttaaaacctctacctaagagcagcccattgctagctctcgcaccctctctgcccttgacctcaataatataccatatcttgattcactggctccaggtctcctaccaccgaggacttgccttactttttttttgttgttttctccatggagtccatctgttggaacattctgtctacaaactccttttgttaggtaataatgagttttcccattttaaaaaattcagcaaagactagcagagctgccaaccagagcctctgatcaacacaggataaccagcaggagagttggtggaattccagacagtggtaagaaaaaaaataaaaataaaaaagacattttaattagtctgtgcagctttatcttgcataaatggatacattccactaggccagggattcctaactttttctataaaggtccaggtagtaaacattttagactttacaggccacagggtctttgttgcaactattacttcttgccattagtgtgcaaaagcaccctagacaatatttaaaatgaatggacatgacagtgttccagtaaaacgttatttccaaaaaaaaaaaagaaaaaaaaaggccagaagaccattgttttgcagatctcttgcatgaggcttttaaaggtattaaaacattttcgcacccctgtgcctgttttcctgaaagtttagagatcctgagttggaacactgatttgcattataaaccttgccctgaacaattctcagcctgtccagattgctaagttctgcatgacattcttagtaatgatgtccccactttcttccctctgctctgaagctcattcttgttgagcttgatggcattttaggcttgactttctctagaagtcttcactagattcctagaagagggaggcacagaagctcacaagctctaggtacaaaagccttgaagctttcgagaagacagataagccaggaagtgattctagctctgctgtatatctgtgtaaccatagttattcacccaacctctgagcagtgtgaggcatggacaggaggacttcaaccaaactggggttttcatctcagccatgttcatccaggggtatcattggtccattagtgatgaagatgttgtattaatactttactatgtgttttattccagtgtccggttataattgtataagaaaccatcataaacttaccatcttaaagcaataacaatcatttgttttactcacaaatgtgtcatttgtgagggctcaatggggactattcatctctgtttttcacggtgtcagttagggtagcttgaaggctggggtaactcaatagctggaggttgggctcctttattcattccttaatgtgcttggtggttgattctggctgttggccacagtatccacacatggcctctccacgtggctgcttgggcttcctcacaggatggtaggtggtgccaagagtgagcatcccaagggaacaaggtagaaatgagtgatattttatgactgaggcttgactttaccatattttatagcagttggggcagtcatagattcccctgaggtcaaggagacagaaaataaactcctactcacggagagtcatgtcaccattaccttgcatcgtgagcatgagagatgtaatatgatggctattttgggaaaattcagtctcccatacagaatataacttgagctattttcagcccatgttttaccatcttcataatgccttatagttgaagtaatataaggatacctcacgtgagtagaggctgcgggtatttagaagacccaaaacagatgttaaatgttcatatgtgccattttctcttcctataactatttttcttcttctttctctgggaaactccagcttacattttacttttcggcctagaaactgttcctcaagaactcttccctagtaagtgatcccatagaacgccatgtttccccatcatattcctcatcacactgtattgtcattgccagcttatgactttggtcgtgagtgataacaggtaaggaaccatgcctgtgttactcaccgctcagtcctcagcccaggcaccctgcctaacacacagccgatcatcaacaatgtacttattgagtgaatgagtgaccagtgctaatgagttactgaatattgagagaattggttggtacttcataaacaattcttgaacccttcttaaatagcagtcattgtattagatattggggctataagacatggtctagttggggagatatatggttctaataataatttacatttagtagctatgtttttgctgtgtatctctcatgcttttcatgcattgtgatggggatggtgacatgcctctcagcgagagtagcagattgttttatttcagaactatgatcataccatttgtactatttggtcatttttctccattcaataatataaagtaggcagtcgtgtatgtgtgtgtgtgtgtgtgtgtgtgtatgcgtgtgtaatccacataaggctttttgatgactgcatattatttctcatcattgctgtcttctaattcatttgaccagtcctgtaattgatgggcatccaggttgcctctaggttttcacttcttataagcattgcataaatgatatttcttcatgtggacccattgcatgtggcattgaattatagaaatgatactgttgaattgaagataggcccaattaaaattttgacacagaccattaactgtcacacagatttatattgccaccaggagcatttgaaagtgttctattcaattccacacaccagggatactatcatccttactcaatatctgccaatcctttgggcaacatagaatattctactgttgttttcatttgcatttctcttaagaccttatctggagaattatgttttttcaacataaataaataagaattgtccaaggtaagagttgtgtaggctctgtaaaaactccccaagtttcagtaatttacagatttgaatggataaacatccttattgttcttaaatactaaagtaagagcagatgtaagaagagcttacactttttattatatctgacattcaatgggaaaccactggaaaggttggagattggggtgaccagtgtttctgagatgaactgaaaacacttagcctcttttcttcttatgtccattcttctgtgtattgataaagcctccatttttctgacattggaatgggaagagatgtttcagtctcagtctaggttcaatattaccaaagtgcataacattatattcaatttttgcctggcactttctaagagatctctgatttgtagttgtagtgatgactttcataatctatttttggaaccattgtttgtattttttaaatgattagatcacctttaaaaaatatgctatcattccaatcaggttgataccatttgtttttaattgttcactaaagtatagcatatatcatagaaggaatgtttgtgctccccagaattcatattttgaaacctagcttccaatgtgatggtgtctggaggtagggctttcatgaggtggtaaaatcattaggactttactctcaggatattatgagattagtgtctttataaaagagaccccagtgaactcgctcgtccttttctactacatgaggacacaatgaaaagacagccattgcctgtaatcccagcactttgggaggctgaggcggggtggatcacaaggtcaggagatcgagaccatcctggctagatggtctagccaggtgaaaccccgtctctactaaaaatacaaaaaaattagctgggcatggtagtgggcgcctgtagtcccagcgactcgggaggctgaagcaggagaatggcatgaactcgggaggcggagcttgcagtgagcaaacgtcacgccactgcactccagcttgggggacagagtgagactccatctcaaaaaaaaaaaaaaaaaaaaaaaaaaaaaaaagaagacagccgttgatgaacctgaaaagaagccctcacagacaccaaacttgctggtgccttgatcttgtacttccacctccagagctataagaaataaatttctgctgttaaaaagccacccagtcaatcatatcctgttacagcatcccgaagagaccaagaaacatacctgtagaaaggagtagtcataacaaatctatagattgattagttttcacaaaccaaacacatacacataacaacactcagagaaacagagttatgactggccaccggaagccccatgccctctcagtcatattccacaagggaaatcactatcatgacttctaataaaatgcattagtttgtctctttttttttttttttttttttttgagatagagtcttactctgttgcccaggctggagtgtattggtgcaatctcagctcactacaacctctgcctcccaatataacctttgtatttttaagagagatggcattttgccagttggctaggctggtctcgaactcctggccttaagagattcacctgcctctgcctcccaaactgctgggattacaagcatgagccgctacgtccggcctgttctttatgtaaatggaatcatagagagtgtactcttgtgtgtctgtatgggactctctctttttgaatactgtaatagatcaacagctaacatttaacagagatgcaccaggtacttttctaagcactttatatatgttatattaaacataggtgtcttaactatggattatatgggaatgttttaactttttcttgaagtaactttatggtttgtatacggatgccaaatatagatacatatctaatttatctattttatttttttagaaataatttcttagaattaggaacctcttcagagccataattgcaaaaagagctccccgtcagctctctttgcagtcgaggtttgtaattattcttaaaaagaaaacatattaagatgttcttaggactctgagtagttatgccctcagataaatgatattaaactaagcacttaaaattaaagctataaagcattggtgatgcccagatatatcagtactccagttcaccctaggtgagaagggcagtggggattaatagccccctctgtccatttcctttttaggaaatgatgacctatcagagaggacataaatcactcctcttcccaaattagattaaaatcctgagctttaaaacttgcttttacctgcagactctaatgttcgacttgtggctttgtcatttccccacaggggcagcttccgctggttttacaggacagaaaagttctgtttctattactgaagaggttgaaccctctgctgaagctaattccaaacaaagtaggcaccatatcttctttcaaaagatcccttagggaataattgcaaagagatgctgtgattaggtaattacatgtgtgactctgcccaagaaacctgctttctacctaatttatactttgatttccctctctcgtgtcaaaaagcatatctagccttatttatctgactaccctgcacagaattttctcatcatgtaattgaaggtcactagaaaataatacttttttgaaagcgtgtctgataacaaacaaacaaaaaatggttagaatcactgctaaatatgaataattctattttccaatgctaaaaatgcacatctgttccagaaagacttggactcacatcctacttttcaaaatgcttcagccattcaacccttgatgctatgggcataaatgaagtttagaagttctataagcagtggggaagctagaattggaccttgaggtcccccccttttttttttttttgatgtttgttaggaattaagatggccttaggtattagtctgttttcatgctgctgataaagacatacctgagactgggtaatttataaagaaaaagaagtttaatggactcacagttccatgtggctggggaggcctcacaatcatggcagaaggcaaaggcatgacttacatggcagcagacaagagagaaaatgagagccaaatgaaaggaggaaccccttatagaaacatcagatctcatgagacttatttactaccaagagaacagtatggaggaaaccatccccatgattcattatttcccacatggtcccacctacaacatgtgggaattatgggagctacaattcaagatgagatttgggtgaggacacagccaaaccatatcaccttacaagttccatgtctagtacagagcttgaccctaagtggatgttcagaaagcatcttcagaatgaaaaggggggcacagttaagacctctggtaaattgtacgatagcttgtggggggaaaatcactgtagttagtgggaagaatgtggcttctttgcttaggacagttgtggatttactggctgaaggaatcactcacagaagtcattctacattagtggtcaaaagcatatgcttttgagtcatatagatgtaggcaaatcattttaaagattgttgctatatttttagtataagtgtgtcctgcccaacattgacacacacttattctaaaaaattgtttatctgagattcaaatgtagctgggcaccttattattgtatttgtttgtttgctttgaaatcctaactcagtcccactagtcccatttttgtaatgtttagctttcaggcaacaaccgctgaagaggtaaagagattatttttgaagagtcatgtgattttggctgctcctagctgacctactagagaaaaatcttaacattttccacaaacttttccattaaaatagaggataggtcattgctaaagaactggcagagcttcccaagacaaaacttgtggatagagtggaaactatgatctagcccgtccagtgaggtagactcaagatcaggtacataaactttactgaaaaaatgtgttttttctcatgggacgtatttacttgaggaagtatttaatcccttagcatagacctttaggttttcaatgaaaatatgatgagttgaaacatttgatatgctgatggcattctgactgatacttttcataacaaattcagaagtgaaaaataatttggtatgctgaaatggtggcctaaagtgtgaacgattaacttaataggaacaaatgtaagattccgtacttgattctaaacaatgaactttactagtagagaagttgactagtagagaatgaagtttactagtagagaaattgggaagccatgatttagtagaggcataaatgaaagcaagggttagcattttaatttaattttaatatcagtatattgacttaccaatttcatatttttttatatttttatgacatatctttgagaaaggggtttgcatgaatctttaggaaggctgaatcaaatgattcagggttgggggagtgatattggcagttacatgttgtattagtccattctcatgcagccatgaagacatacttcagactgggtcatttataaagaaaagaggttttaattgattcatggttttgcatggctggtgaggcctcaggaaagttacagtatggccgaaggggaagcaaatatgtccttcacatggcagcaggagagagaagtgcagagcaaaggggagaaaagccccctataaaactatcagattttgggagaactcattcactatcatgagaacagcatggggagactgccctcatgatccaatcaccactcatgaggtccctcccccaacacgtggggattacaattcagattaccattcaagatgagatttgggtggggacacagaaccagaccatagcattctgccacttgcccctctcaaatctcatgtttctcacatttcaaaacaaaattatgccttcccaacagtttcccaaagtcgtaactcattttggcattaacccaaaagtccaagtccatagtctgatttgagacaaggcaagtcccttccacctatgagcctgtaaaatcaaaagcaagttaggtacttcctagatacaatggagatacaggcattgggtaaatatgctcattccaaatgggaaaaactggccaaaacataggggctacaggatccgggcaagtctgaaatccaacaaggcagtaattaactcttaaagctccaaaataatctcctttgactctgtgtctcacatccaggtcacattgatgcaggaagtgtgttcccatggccttgggcagctttgtccctgtggctttgcagggtacagccctcctcctggctgctttcatgggctggcagcgtctatgacttttccaggtgctctgtgcaagctgtccatggatctaccatcctggggtctggaggacagtggcccttttctcacagctcaactaggcagtgccccagtggggactatgtgtggtggctctgatcccacattccccttctgcacttccctagcagaggttctgcatgagggctctgcccctgcagcagacttctgcctggacatccaggcatttccatacatcttctgaagtctaggcagatgttcccaaactccaattcttgatttctgtgcatctgcaggctcaacaccacatggaagctgccaaggctcgaggcttgcaccctctgaagccacagtctgagctgtaccttggccccttttatccatggctggagaagctgggacacagagcactaagtccttaggctgcacacagctggggggccctggctccagcccacaaaaccattttttccatctaggcctcagggcctgtgatggcaggggctaccatgaagatctgtgacatgccctgcaatttccccattgtcttggtgattaacatttagctccttgttacttatgcaaatttctgcagcaggcttgaatttctccccagaacatgggtttttcttttctattgcattgtcaggttgcaaattttccaaacttatatgctctgcttcctcttgcaagctttgctgcttagaaatttcttccaccagataccctacatcatctctctcaggtttaagttccacagatctctagggcaagggcaagggcaaaatgccatcagtctctttgctaaagcatagcaagagtgacctttgcttcagttctcaacaagttcctcatctctgtctgagatcacctcagcctggacttcattgtccatatcaccatcagcattttggtcaaagccattcaacaagtatctagtaagttccaaactttaccacattttcctgtgttcttctgagtcctccaaactgttccaacctctgcctgttacacagttccaaagtcacttccacatttttgggtatccttacggcagcaccccgctccctcggtaccaatttgctttattagtctattctcacactgctacaaagacatacctgagactgggtgatttataaagtaaagtggtttaattgactcacagttttgcagggttggggaggcctcatgaacttacaatgatggtggatggggaagcaaatacgttcatcttcacatggcagcaagatggagaagtgcagagtgaagggagagacagctccttataaagccattagatcccatgagaactcactcactatcatgagaacagcatgaggggaaggctcccatgacctaatcacctcccatgaggtccctcccccaacacgtggggattatgatttggattacaattcaagatgagatttgggtggggacataaagccagaccgtatgacatggtgaaatagttacaactgttttcatgaagcttttttggtctcaagatctgtgtgctatttgaataaatgagatgcagctggtttccaacgtgttttcctagcattggggtttaaagaaaaaagtaaaaaggacctaccttggaaatcatttcagaaaactgattcttaagcagtgattctcgaacttgagtgtatatcagaatcacgtatagcaggggtccccaacctctgggctatggaccacagcaggagagtcagcaataaccccctgagctccacctcctgtcagattggtagtgtcattagagtctcatagaaagtggctatgttgcctggggtatataccctggggtttcttgttgtgtaccaggaaaatttaggtcatggacacacacgaggagtttaggagtggaggtttaacacgtagaagagaagagaaagagaaacagcttcctctatagaggaagtggtcttggagcagaaaaagaccagcgggtggcagctgtgctgaattttatagtcaggtttaaagaggcagtgtctgatttgcatagtgctcacccattggttctgtcaggtatgatgtttacacagggcatgggcaaggctggtcaccccaccctaatcttatgcaaatgggctttccagttgattggcaccatcttgtctgcttcttactgtacatgtggctggcagagaaaggaagacggagctgccatcttgaacatgtctagtccttagttcctgccagcattcacctgtgcaagtctccagcttgcttgtctatgtctgcagctcaactttacattttctttgttagaaaattatttggggttgctttttattaaaaagaaaagccttaccaaggattcccatgcccttaccatctgcctgtgtaatttcttcttaactcctgtatcatcaggaacgtgaaccctattgtgaattgtacatgccagggatctagattgtgtgctccttatgagaatgtaatgcctgatgatctgaggtagaacagtttcaacccgaatccaccccacccaccaactttccccatcccatgaaaaaattagcttccacaaaactggtccttggtgctgaaaaggttggaagactgctgatctatagggtttattaaaacagtaggccccccaccttcagcatttttaactcagaagttcagggatgaggactgagaatttgcatttctaactagtcccccgagtggtgatgctactttagatcgtaacgttcatattgaaacatttgtcctacctacggatgccaatgaccaaggcatatgttggacgagcactgtgagaataggtagaatcaactctacttgagtgcattgcccacacaactgcttagtcttgtgtgcgtttagggaaagaacaggtggggagtgggggaggtacacttcgcccaaccatttgcttgtagatcttcatggactcctcccagagttcacctttgaagactaaggtatggtagtgccaagagtggagatactcctttatcagggcctctggggtcatggtcctgggctgtgacctcagcacgacatcagcacaaccaaaacaaaccacaggctggtgtttaggttcttgtcaagacctcatgcatcattaaacagagggcaactgcagagctctccattctgttttaagaaaatagaaatagtaactagcattaaactaaacccacaaacgcctgttccctcttgatagggtggtcacgctactgctgcattgttttgctttttcttttttttctgatgcagctatagtacaagccgtgactcatgctaggtgctagcctcacagatatacataaacattcacaatcaggtttccaaagctgtttccttacttccctttgttgctattttacttttcattggaggttgggcgaggcaatctttaaatgaagctattttttctttgtctctctgtccctctgtgtctctctctgtgtctcacacacatacacatgcacacacacacacacacagacacacacacacacacacacacagtctagctgaatcacgaattccgtgagaacagagtcagcatttgtatattttctcagagatctattcctaaccttaatgccatacctagcacatagcagacacacaaaatttgtgactgactgaatgaataaacatgtatattattgcaagccagttgcaaacagatatattgttgcaaacagaaggttacctgttgatccttcctatgttatctctgaactgcaggaacttcattttttctatgaaccaaatgtaggtcatcatgaatcaagcgtccataatatctgtttgtccacatataacctattttatagcagagcttatattctgatgatttgtagatttaatgttgtttattcatcatatctatcacatttgttttttaaatatttctaaacagctgattaaagtacaattggatggaggtaaaaatatttttaaagacgtataatataaaaggacagtaattggatatagttattcaaatgtaacacttaatttactttgagtttttacttaaccctgtaacaatggaattgtgttagcttacataattttcattgtttaattgaaagaagaagaaaaagaaaaagcagctgcaacagcggtagcaacaacacgccaaaaaacggaaagataatactttttccacttggcatttatttctgggaagaatgtatcttaagagcctttactgaaaagggcattgagttacacaggcaatagctttttcaacagctatttttccagaggtgtaaaaacagcctttgcctggttacattgtatatcttacctcagtaaagtcatgaaaaggaatcgtgataaggtgaatgcactcctacagagcgctaagcttcctggcgatttgacttgattcgggaatagaactcagtaaactgagcagattaaatgatcaatgtttcttttagattagccctctcaaatatcaatggtctctgccagccttagatgagataatgaggtaatttcaatactgagcttttgacagagtgtctgaagtgtaaagagtctgtggtattagaaacatgtctcagcatggcactgcccagcatcagcaggggccttctgagaggccaccgttgtccagagtctaagacactggtccagtggggacacatgagatgacatgggtttgtgtgtgtcttaattgcagtcctcgagaagagacaaggatgtgagtgtgtatagtttatttaaaaggtgcaggaagcatcagtactgcacacaagacaaggaaaaagaaaggagagtcaacgtagggtgcagtattaagctatggtaggcaactaaagtttaatcctgtaagaaaactctggaagtaatgtagaagacacacttcagagttatccatcctgaggagggagggagttcccttcagctggaggtacttatttcagtgctcttggttgaggactactcccagaaaaagggtgttgatttgggaacacttccaaccagaggggcatcacacctgccacatacacaggaagattcatcttctgtggttctgggaaaagccttcaggcacagaactgcacatcctgcaatgggaggttgtctggagcacagtgaagtggggtgcagtctgaggaatttggcaagacactgacagcatctcctctggtgtggaaaatggcattagaaagcagtggtcacaaggctgggtgcagtggctcacgcctgcaatcccagacatttcagaggctgaggcagatggatcacctgagctcaggggtttgagatcagcctgggcaacatggtgaaaccctgttctactagaaatacaaaaattagccaggtgtgctggtgtgcacctgtagttccagctactcaataggctgagacagaaggaatgcttgagccagggagacggaggttgcagtgagctgagatggcaccattgcactccagcctgggtgacagagtaagaccttagctcaaaaaaaattaaataaaagggagcaagggagagggagggagagggagagagggagggagggagggagggaaggagggaggcctgttgacagaacaatgaataattacgcacatacctaaagcgaatactcaggtgagatccccaagtacactctttcaagtatgggttagatattctaactgaagcaaatgtaaaaattgaatgttaacagtgggtctcttctattagtgtggttgtttgctgtcttctccagaatggatgtttttaagaagtcctttctcctcaccggttcccactagctgcaaaggttacccttacatccttgaatctctggattttttaaacccatttctctaatgctgcttataatattgttgataatatttgtcaccccttggcttgttcaaatatatttcattccactataggtatattcgcacgttttcacgctgctgataaagacatgccctcgactgggtaataaggaaaaagaggtttgatggactcacagccctcacaatcatggtggaaggtgaagaggagcaaaatcgtgtctcatgtggcagcagacaggagagaatgagaaccaaatgaaaggggtttccccttataaaaccatcagatttcatgagacttattcactaccatgagaacagtatgggggaaagtgcccccatgattcaattatttcccaccaggtccctcccacaacgtgtgggaattattaattcaagatgagatttgggttggggacgcagccaaaccatatcagtaggtcaaatgcaaagcctgaaatatggagaggaagacatcagtataaatcctggttccgtcacttgaatacgttgccttgagcaaattattcccttgcagaatctcagtttttccacctgtaaaatggagacggcaaaaattaacagtcacctcggggagtaattatgacaccagaatgagctaataaacatcactgttttgctcggtggtgaggttgagtccaaaccttagcagttatgattgtggttgttgctgttgtccttactaattactccatagattgatttgagttttgcaatcagtttgatgccttgttccatagtttcttttttacttccagatttggttcaggtaaagttggcaaagcaaggagagctggattcttcttacctgcttcaccttagctggttcctgcttcatacatctttcaagatgtttgtagaaaactaatcagcgtctacgtttgttttctaattttcttttgctcacacatactgtggccacttgattaccaatcagtgctgtgttggcaggcacatacaggccctattcctactaatcagagatgtgggaagcaaatgctggtgtttaaagggaacccttatttgagctcttgtcccatgactcctaattgttgtatttctcaaactcaacccagctgcaagctttattagggaaacatttattcagataaaagcctcagttatgaaagaggggtaattattttgcaaatgtgtttgaatcactgtatgctgtagtgcaactcatccccaaatggagaaggtgcacatttgggctgaaatgttgctttgtagatggacaatacaacaagcatatgacggggaacttctggcaaacgataggaaaatggtcaaatgaaaagacaccagtaaaatgagagattggatgaaaagtgatcaggaagctctgaaagctgaccagagtgaacaaaatgcctaaattccgttcatccacattcatttatttattcattcattaaccattgaatattttggggctcctatacatagtttgctctcaaagaattttaggttttagttgggagagagcaatgaaaatatgttaactgcatgccaactgggatctcccattcagtgaaatctagatagcgttggaccaaaaccctgttctgtgccttgagaatgctcagtgatatccatgacatttctggaatttcacgggggtgggtgctcacctaccaaaggtcccctcctagctctaagatcagcttctgcttatttcgttgttttgcttcatcatctttacattgcacaatccacgtgtagaaaatagcccttccctttcctttgtgcgccaaaatttacataaagcattgtgtggatagcacactttattgaaattctagaaagttgtatttggagattgtatcaactcccagtggaatattaaacacggctattcttaaatgtcctccaggcaccaggcacattttcttttgttgcttgtaccgagctctctatctctaaccacctccgagttttctttttccatccctgttcccatctctccttctcttaatgttctgcccagtatatgggggctatcacatggcatgattattctatattcttgctccctcattgagttccagtctcaagcacttatattcatacccaggaagttgttctccagaatataacagttctcttccatttaaaagaaacttccctcagtggtaattcaaggagttcttcatatatcctgaatataagtctgtcagatgcatgaattacaagtctcttccctttgtgtcttgtctttcactttcttaatggtgtcgtttgataaacagatgttctgtattttaatgaaggctaattatttatttttcctatcaggcttattgcttcttgtgtcctgtttaagaaatatttgcataccccaaggtcacagacattctccactaggttttctaaaagcttgcttttcgtaggtttcatgattaattttcatcttaagttaattttgtgtatggtgtgaggtagaggtcaagatgtatgatttttccagttgctgccgcaaaatgtattgagaagatcaccctttccgtcactgaattgcagccataaatcaaataaccaatatgtgtgatctatttccgcactgtctttccctggtctttatatttaaccttgtgccaatatgagggtggtaaattttaatcatcttcctttttatgtaggcatttaaaactatcctgttataagtgctctggtaatagaaatacagactataacacacgccagaggatttgacctaagggaagagggtcagagttggctttctgagcggatgtgccatttaggtggagaagtactttgtgcgtctgcattctagggcatgccctgcttggcagttttctcattttatgatgggtcctgtgatgtggccaatgtgaaccatgctgtatgtgcactggcctggaatagataacaacaataaaagaaggaagatgcccaagaagaagtcaaataacctcattgtaaagatgtgaaattgaggtttaaagagaacatgtgatatgcccaaggtcacagagttgatgagttacaatgctgggattggaactcaggtttcccaatagatccaccctcttcccatgaccctgcattgcctgtaggtacaaatgctcaaagttgctgagctataatgtggtgatgcttggactcgtactcagttctgtttaacttcagagtctgtgctctaccccgtatccttgattacctccttggaaaagctgaatttatttgtatgcctaactaagaatgagctaattgattcccattttaatatgacagctctgccttagcactatcaatatgtgtccaaaaaatcttatggtgcatgactaattgcactttggaatcgtatacatttaattatatatttgatttgagagtttagcatttacaattattgtcatctcccacttactgagcttccattcttccattctgattgtctctgttacagactttttttctcatgcatagagaagaaataaaggcacaatttcctttttccatatttatgtgttatatattcctttagcatcatgagccacatatgatagtattgctagatcagttctcataatgtaccctttgcaggatagactgtgaaaatctaattttggcaaaatgactgaaatcccagtgaatgattttttcttttcttatataaacctaagcatccaatagtgaaagtttatatgactcaaatggaagaagaattcatgacaaaaggtgtgattattcgcataagaccctgaaattcctttctgggtgaaataggccctttcttccttccataagaggctctgactgatgagttggcttttattaggcaatgtatgtctgatgcaatatctgtggataaaaccaccagcccctatcaagtcaatcaaatatttactgagcacttattatgtccaagacactttggagaacaaagaaatataacctggccttgcccttcaggctgtatcaattgagatagaatttggactgctgcaatcaattacacagatgtctctcaaggtagtgtcttgatgcttgagggaaacaagacaaaatgctattaataatgacttagttttctttgtcaagcaatcggcttgccacatcattgaggtaacttcacattttcttgcatcttttacaattagcagcttcagctgactctgcaacctgttgagaaagagggcccaggcaatgttgtccttggcatcttattcaggtctggcttccactgcagtgaatgcactcagatagccctttatcagctgagtccccttgagattaagtatttaatgtctcttgatctccagccttaggaaataacccaattcattactcagccattatgtaattcattactgtcattagagatcaggagaatcgtcttaggagaactgagaatacaaggcaaaccacacctttctttgtccagcatgattaacggactgtggaagggccctaatttggagttccattcatgggatttggttttatgacatcctccagtcccaggcttctggtatgacttgcagaggcattggttaacctggtggaaaatggattactactcaacgtgtttaccgatactgtgtgtctgtagtgggctttggtggactcctttatgggattgttgatctctcaacagaacagagaagttggtcaggaaggttattaagggagaatgcataagggagctgctttttctagactggagtgagggtcatggattgcttcccagggaacatttggcaatgtctggagataattttttgttgtgacagtgtggaccaggagtgggaggagaacatgactagcatctagtgggtgaaggccaggggtggtgttaacatcctacaatatacaggactgcctatcatagcagaattatctggcccaaaatttcagcagtaccactgttgagaaaccctgggtacctgcccattactgctcccttctaaaacaacacatatttcttcataggcccttgtgaatttatttgttttatttgatgagagagagaaagagagagagagagacagacagagactgatacatttgtacctatctatctatttacaacttctccattccctacttcatttcacaaggtattaggtaaagcaggtatataaataacactcaataaagtagttaagagaaattttaaaaaaatacacagggggaaatacaaattaaagtaggcagtagcaactgtagaaaatatattatactggtaatctgacagtctgacttataattgctgtcattttctttgagcttcctgagagccaaaacaaaaatagaaacagtcattatactttttgttatccatgaggagaaaacagtgtagagaaagcttttaataacacaaagacatttctcaagtagaacttaatgtaaataagtgttggcaaaggacaagatagtaaatattttcaactttgtgggccatgaagtttctgtggcagtcactcaactgtgcccgtgtagtccccaaagtgtccacagacaatatggaaacaaatgggtgtgactgtgttctaataaaacttaatacaaaaaaacaaagggtcagatttggctcttggaccatagttggtcaagcctcagtgtaggtcttcagaaacactcctggatcaagtacgaaatggatattaagatgatgtttcctaggccactgactgaaaccgagagctttcccttacagggtgctaaacgactttctgcaccatcggtagtttctacgaggatggaagaacaataacaataataacaaaatatcttcttagggcatttactgtggtgcatatcaaggattttgtgttttttttcttcgcggttgtttagttttgctttgggtgacaccccttctcatttgctgtgaagataccgcaggatgataaactccctcttctatactaagtcccatctgcaaggaaaggaaacttcactctgctccttccatcttgctgaatatttaaagggtattgacacaaggcgttttgataggccaaaagtattattatcctaaaaaatatttcctgtgatttaggcacatggagaggcaccgtgttagagagtcaagataaaatacctacctaaagactcttcctctgagtcatttcctagggacactctcagttcctttggtggccacagtttggctgtcatttcctctgtgaattcttctacgactctttggaggaaggatgtggtcttcacctttgtccttccgtatgttttgtaattctgaattttatagcacttctcctggcgtcttataactttatatttctctttcccctgatcaactgagcttcttgaggggacagtataagtctttctgatcttttgccctcccctgtgtcttttgcaacatgtagaacatactagatttccataactatttgttgattaaattaatgactagatggatggatggatggatggatacatggatgaatggagggagggagggaggaagagagggatggataaatggatgtgggagggaagggtggaaggatggaataatggaaagaagaacatcagcagcttctcaaaaatgtaagttctaacataagtagtaatattacttatgaaatattttattgatagtcaagcaccctgattaaacttgtcctatttcatcatataaaattaagcttaatcttcatttaggccaggtgtggtggctgatgcctgtaatcccagcactttgtgaggccaaggcaggcagatcacttgaggccagggagttcaagaccagcctggccaagatggcaaaacctcatctctactaaaagtacaaaaattagcctggcgtggtggcctgtgcctgtaatcccagctgcttaggaggctgaggcgtgaaaattgcttgaaaccaggaggtggaggttgcagtgagccaagatcacaccactgcactccagcgtgggtgacagaatgaaactctgtctcaaaaaaaagaaagaaaaaacatactcattcagtaacaaaacaaaatctcaaggcaacatatctgatttatggttcactaacataaatacatatgcctagaaattcactgaacgtcaaaatgatttatacatacaatcactagagtgaagttgaaagtgttttaagcagaatctgcatttaaaatgcatatatatttattagaaaggatgccataacagattggatacatacaatcaaattgttgctaataacactaggccaaagtctttataagtgcgcacgcctgtgtgtgtgtgtgtgtgtgtgtgtgtgtgtgtgtgtgtgtgtgatgttgtaagaaagtttaaggctatctcccttccttattcctctctctgattactgtcaatgctagctagttgatgtcagtaatgacaagtttgtattttaatttttaagcttgagtgatccatcacacctcaaccagagtaggtggttattcctactacctgcttggatgtcaaatgcatcagttggcaatttgtatttcttcagctttctctccctcctattttctgtgtttattctgtctatctacttatttcttacacaagagtgaccaagagtgtgtacccaggaggtgacggtcaagagtataacgtttcagaattaaaaaatattatagttgcaaactggatattttggataatactggaaaaacggaaatattagatcatgaaatcagatattatccatacttctgtgttaactacgataattatcttaatttgatgtttcggtttttccatttgcttattgtatgtaattttgacacatctgccttaattaataagaatggtacaaaattaagtaaattttacaaaaagacattttaaaagaactctttattcaaggaggaaacttaacaaatttaattttctttgatataaaatatcaaaagccataactagatattttattcaaatattaagcttgcaagtttgggagtaggggtgggaatcccactacagtcaaattattttgatgttactttccaggcttagagtttatcttccatatttccaatgagaatcagttcctcaagtggaattttatgataaactgctgaaagtagtatttaaaatggaaaccctgacaagaatgagtgtcacagggagtaatgaattcatgatggaactagttgggagtgtgtgacattttaagtgcctcatcactctgaattcactgggcatttattgtaatagaaaggaccatattgaattcatttggcattcatgtggacttcacatgtatttatggagatgtaacatggtaatttaatatttattctactaagcattctttaatggacattgaaagatattgtcatacaatgcttagtaaagccggtaactctaacgttattcttctatcaaaacaaagaaatgaaacaccattttgattcccaaagcacccgagtaagttatttggataagccaacattatgtatttactcccccaaatctgctttctaaatttttaagccacaaggttgactctaggaccaagacaataaagcagaagttcagtttaggattctttatattctaaaattgtctgcaaatacattaatctcagtctaaaaatattaggggaagattttcttggaacatcagcagtaaatttaacacatggcatgccttcaatagatttctcttcttccccctttagagttcagtttgctgtcttcatcacagtcccaaaaaatacatttgtgtttcttccttgaagaagaattatttttagaacaaacacatcattatttgggaacaatcaaaagatcaaaggcataagaatctttgctggaaagtgaaggaagagttcttcaaccaaccaaaatgacaatcttttatttttattctaagaacagagttgttccaggacacagcctaatgcaaactctgctactagtcactttcaaaatgttgtctagaatgccttgtttttaaattttctctcagttgccttctttacaccactcaaaagcagaacctttattacaaacacaccaaaaggtaccatataactaatcttcctggtttgaatgtaaccaatgttcaaatatgattgtagagtattaattattttgacatcaatttactgaacacattttaatgaggaccagaaggaaagacaaagtttacttactttcgtgatatatatctggtccagaccttgtaagtaatagcactttcaaacttactatagaaaattcagtgactgtaaacatctttcaactctacattgtgagagagttttcaaatctttggcaaattaccctgtgtaaacctccttatgacccaaagagatattttgaatgaggggatgtattagtttcttagggctgacatgaaaaagtactgggtgacttaaaacagaaactacttgtctcatagctctggaagctagaagtctgaaatcaaagtgctgtcaagggccacactactttcagagtgtctaggggaggattcggcctcaccttttttaggttctggcagccccaggtgttccttggcttgtagctgaatcactgcaatctctgctttgttcctcacacagtgttctccctgcgtctctgtcttcacatggcattttcttatatggaccccacgcatactggaataggtccactctaacggcttcctcttaactcgatgacatgtgcacagattctattcccaaataaggtcacttttgcagattccaggggttaggagttggacgtttcttttagggggacacaattcaacccctaaatggggatctcctgacagttcttaatagggtcaatatttcaatgcgtgcatttgttttttataatgatcttttctatgatactgggtgagataaaaaccaacttatttgcctttaagagcttctttgttttctgccatttgtgctagcaacagtcagagaaaactttttttttatagcaaattgtttttctcaacacattctgtctggaaaagaatgttctctagttaccacctctttggtctaagggcatctccttggtttctgtgttacagcctctttgtgttaattataagttgctttgctttacagactcaaaatgaatgttacagtgactgataaaagccaggatcctgagttcaagatcctgaccaattgggtgcttcatttgaaatcagaatctgtgttcactgtggtttacttggggtatgtgttagatttctcttggttgcaagcaaaaggaattcacaatggttagtatcaagcaggtaagaaaagggaagaaagaagattgttgaggtgtgtcttagttcactagggctcctataacaaagtgccacaaactgggtggcttaaacaaaataaatttcctgtcaatctcttctagaggctggaagtctaaggtcaaggtgtaggtagggctggtttcttctgagggctgtgaggggaatctgttcatgcctctctcagcttctggaggtttgctagaaacctttggcattccttagcttatagccgcatcatcccaatctcaaccttccctttgcatgccagtctccctgtgtctatgtctgcctctgagtccaaatctcccattttttttggtaaggacgtggtatggtttggctgtgtccccacccaaatctcatcttgaattgtagctcccataattcccacgtgttatgggagggactgggtgggagataattgaatcatgggggtggtttctaccatactgttcttgtggtagtgagtaagtctcaggagatctgatggttttagaagtggtctccctattcgcttggttctcattctctttttcacttgctgctgatgtaagatgtgcctttcgcctttcaccatgattgtgaggcctctccagccacgtgtaactgtgagtccattaaacatctttttctttataaacatgtctttatcagcattgtgaaaatggactaatacaggataccagtgatactggattaaggtctacccatgactttattttaacttgattacctctgtaaagaccctatctccaaataaagtcactgagagttagaactcccacatcttttttttttttttttttggtggtggttggcgaggacagtgaaacccacagcagtgagagagttgtatgcacatggacacaaaagagcatctgatcataaagagaaggaaaccaaacctgtctgggcactgcaatgtgtgaatctagaactctccaactgctatgcttcagcttagatgttgcgcatcaccatatttctgtgtcctgaatttcacatcttcgagaagaattttattggtccagttgagcccagataccttcccttggctcaatcttcaatggccagggagtgagggcacaggtcacaatggccatgttttgagggatgtgcaagtttgtgtgtgtgcttgtgtacatgtgtgaggattttgtcctctacaaaagtcagtggaatcattgtgagactgtgagctggcaagaggatatctccttcccccacatccctcaccccatcccaatctctggagaggaaagactgcctgtgctctcaaagaagaagtggcttttcattgattcagaaagaaatgtcagttgatatctgcttcctataaggtgttctgtcctgagctggaggtatagatacaagaaatgggtcctgatattcagctattggcatgggtaagactgaagtaggaaaggacttttcatctcctcccaagccgaggacacagctcaccatgaggtcgttgggtacgctggcttcatctaaaagaaccacatttaggttcttatgcgagaccacggcatgagctcagtccatggcaatgagtcctattttgttgagatgcccaagcaggagtttccttactgccagcatctacagggctgccatgtgctccccacaactctcccaggcttggctcaagtgcagggaggcccaggtaactccaaagagagggtccattcatcatggacccaggctttctctgatgtccataactgtctccccctggggattttgatgaatattcaaggacataaattcacacacgggctcagctgttgtacacccatgggaatcaggaggctcagtatatcttcctaagtgttccatttctttcccaggagccacagaagtgcaacaaagagatgagccccataaaccactgcatgtgtgtgtttgtcatttttctttagtgcaaggtttacaagactccctcccaacagggtcgtcatctcaacacatgtcacttggctatacgcttcactggaacattgtgttgtgctggggctgaattaaatgtgcaattactgcacattttctcgaaaggagttttgacaatgataaatgcatagacatttttccacactcagacaacgtgactccttgctcatcaagtggctcaggattcactttgaagaactggtctcttgttaacaggagaacgtgggtgctgcccgagaagcgcatgggcctgagttcaagtgccacttctacctgtcatgtaccatctgagcgtgggcagctttcttactcctgctagcccgagttttcaatgagcaatcattgcacctctgataaacctcattggctatggtatttctatatgcaaagctgagacaacacttggaaagtaattaccatagtccctggttaatagtaagctttcaatgagtgttggctagcattcatgcccgtaagttatcctcttgcctagagcagtgatggctctaatgtgagttcagatccctacaataggagaaacagtgcttgttgcttttcaaaaagcagagaataaccataacttttctacagatccttgaatataataacagtagctaatatctgtttacttattacctgctaggcaatgtgatcaattttctgtggatcagatgattcaattctcatacaaaccctgtgaactttttggtatttattttacatattaggaatcctggtgggccaactgcagcccactggcccctccaggtccactgtccaccattctctactctctggtgccacaagatgcttatctgtatgaagccttaggaaggaaaccagaagaactgacaccctgtcttgttctccctccacctctgattcctcactagtgcttctaatttactgaagccagctggaaaccagaagacaaggctgccaggtgctctgacaaaggacggagcagggtatagaagggagagtaaattcagaggactaagcaaatgtactcagcacatctgcttgtgaacatactgccagcaagtgccatttgttttaagcgatagagaattagatatcctctttgctgtactgttccaaactgcttatttctttctccttctttttcctcatagactatgatcttttgatattatagcaggaaacttggcgtgggctagcatcttggtgtaatccaacctctcttagatttgtggatatttcattgtgaaaaggtcaagataaaaaatacattactaaatatccatttatcctttattttctcatcatatacagaaaggttattgccaaatatggccataaaggttttattgctccaatttttatagcaaaaacagatacacttcttaatgaattttggtttattagatcaccagtgaccaacatggggtttctagctcttaggagaccctgatggtggcaatgaaggtctgcaagctattttaaatatttcagaaaatctaatataatcttacttttacaaatgataaagcttcacaaacaaaaacatcaagatgttttgcttttgactgaaatgatattagctctgcatggtgaacttagtaatttaattctgatcagcagctctggttggcagttatatgtgcctttgattaataaaacatgggtgagaaaataaattattacttaatctgtgcagtttgctagataaagtctttgaaaacctggagtcaattggatggaaaataatgaactgggtgctcagtggtgaaataataagcacaataccagcttggcatgtctcacatatgtaggaaagccaagacaggcttccagatgggccgagatctgataaacaattccagtcaattatttgtttttagtaataacaacgacaataataatgatgatagtaggtaacaattattaagtggccagacatagtgctgaaatgctctgcatgtaatattttatttcttccttccaatagacctaggaggaatgcactctgattatcccttatttcaggttggtctccttcagaagcagactcagacatttatgggctcagatagtttatttgggaggtaatgccaagaagcactgtagggaatgaagaaagtcagctggggaaggcaaggaaggcaacaccaggatgcactgaatggtagattgtctctgtgggcacctgggatgccaccccccttggcacgtctggggacagtgtagaacacacctttgagttgtaccacacaatcagtgaggaagctgggtattgctcttccgactcctgtttgtaattagttcagagctgctttcagggaagtcgacttcccggaacttccagttcaccctgtggaagggaaggggctgagcatgttctggtggctagagaaagccctcaggtacagagatacaggggtttccagaaagcctctggtgacgcacaaggatgtgagcacacaagaacagtacctgctgcacttccgtcctacaagagaggaagtcaagaattcatgagttgaaataacttatccagagtcacaaagcgcttgtgatggtgtgctcttccaaagaatttttttgctccctgtgtctgaaggctaccaatgtccaataatgtaccaaatgagcccttgttcttagagtttttttaaacaacagctttattgagatataattcacataccatactattcactcttttaaagtgtagcactccatggttttcagtctattcacagaattgtgcaaccgtcgccacaatgaactttagaatattttttaaatctcctggaaaaaaaaaaaaacactatcctgagtcatacctcattttccaccattatatcctcagctcctggcagccacaaaatctcattctgtctctgtttcattcccttttatggacattttatagaaactgaatataatatctgatcttttgtgcctgccttctttcacttaggatagtgttttaaatgttcatccctgttgtagcgtgtatcaatacttcagtctttgcattgccaaataatattccattgcctggatatatcacatttgtttatccacttattgctcaatgaacattttagttgtttccactttggggcgattttgaataacgttgctgtgaaaatatgcctataatctttggtgtggatatgcacctacctaggattagaattgctaggttatcggcaactctatttttaaccttttgaggaactgccagattctttttccaagcagtcttagagtttattgatgattttaatttgctgtttaattaagcaagatgcctgccttacactgtttggcaaaggagaaaaatcagcatcaggcacttgcagacatagatttccagaattcctaaaacattcaagaaggatgttatcggtacatgatcagagttgagtaggttctggattttaatgcctgtacttgctttttacttataaatgattaatactttagcttcataattatccatttagtttatgattatgggttgcctggttaaccctactgggtgtagtgatgcatgctttcatcagaaacatttttggcctgcagtttctaagtagccagattttaaagcatatacaggtggcagttcattaaacatgcattcgtttttgtttttatttggcacctactgtgaatcagtcactgtgttaggtgctgtgaatacagtggggggacaaaaacagatacaattgtgttagagaaaaataaactttgaaggaaactgcactagaagatacagcatttagtcattgctgggattctcttcattgcaagcagctactgcattccgattattcaccctgaatctaaggcaagctctgctctaaaatgtcacacaagaaagaagtggaaaacctcttctccaggaggggtttgcaatgtaaataaagagacaaagaatgccttaggtgtttcctctacctagcataatcaaatactactatgaaatatgcaagagtctgtgtcatcactgacattcagtcttggatttattttttttaactctgtgtactagacactgcctcttggatgtcccatagttcattgaactctccaagtgcaaagttaaactcaatctccccaccaacctctaacctcaacccagccccagacttttttttccagtgtatgctttctattttagcaaatcaagggtgctactcaccgtgctgttgccaaaaccacaaacatgggcatgattctcggtgtttctgtaggcttctctcacctaccctctagtcaggcaggtcttcatcatttaaccttctacttctctctgacagatttgcttctgtctatcctcatcttcatcctagatctaaaccaccattatctcttgcctgcaaccttttattcctaattctagtctttaatatctaatttctgctccaaatggcagctgaaggattattttcaagctcagatgtatcctgccacaccctttggaactcctcatggatcgttattacccccaggtttaagtccattttctttaacatatcagagccttgctccaaatggcagctgaaggattattttcaagctcaggtatatcctgccacaccctttggaactcctcttggatcatcattacccccgagtttaagtccattttctttaatacagcagcgcctgtccttcatgacccagcccctgatgccatctctggttttatctttacccactcccttagcagatgcttgtgttgagcagagccaaaccaaatctcttactatccctagaatgtgccaggttctttcacattggaaagtttgcataagatgagctttgaaaagtactttttcaataacttgtgtctcagtggatttctattaattaggatatgggtttggatgccatagcaaagattcaaatgtcagtggcttcaataagatagatgcatattactctctcaagtgatggttcaggcaggagcagttctagattgacatggtggccccactgtgtcacttagagacaaagtggagacaggggtggagagacataaatctatctgagagatgtgtaggaagctgaatctttaaaacctggcttccctcttattttatggcatttgtggaatgtatcctgtgtcctcatggccccagacaactcaccaccacatccacattctatcccagtcagtgggaaaggggaaaggggagccatatcccttctcttgaaatacacaagtggaaagttgcatctaccacctctcctcatatcttcttggcgagctgttgaccatatgactaaatctagctgcaaggaaaatcaagagctattggtctttctttgggggacaaatagaagtttctggtaattattttatgtaaaactaatccgaagaaataagtacattttccttccaaacatggcaatcctggcagggttgtgggcactggaatcacaccattttttgctaactaaacaaatttccaagtcaacaatgtcagatattggaagttcaagatagataaaggccactagtatgttggcaatagcatgccctctttacaaatgataaaatttagagaagtcaggtgcctcccaagtacccataacatgtacacgcccccctgctatcttctgaatccaccctctgtgctgaacaaacatgcagggcagtatactttagtgattaagaacaccagctttggactcagaaaggtctggatgcataatcacttattattgtgatatttacaaattccctaagttttctgagctttattttcccacaaggatgttatatgcattaaatgggataatatctagaaattacctaggaaatatctggccaatgattagcacttaagaaatgatctctagtataactataatgaatatctcttaaactttttctgctatgaccagttattgcttcttttggagacatgatagctggaaaatgtgcactcataattttgccagtgtttatttcttcataaggcaagacaaaaggagtcctgtggaagacgcctcttcactttcttcttaatgtacttggtctaaggtatccacacttgtctgagagatggcagaggtgggtgaggcaccacagctctgtctttctcttagtaaactcacagattcctaactaagtactcagagtctgctgtgtgccatacctaacctaaaatcccaattctacccattcctggctgtcagatcttggaaaagattcttgacctctcttagcaccaacctctgcttctaaaaatgagaataacttgaatacctacttaacaattgtcctcggaggaatagctgagacgcttcacctagaagtgcttaaaactgtgtctgatatatcgttcatgcttgataaatatgagctgacttaaattcccccatttaagcatgaatttcagcagaggcagtaggggtaaaaaggagaggatgcggtgaagaaaaatttagaaggcataatggaaaggacccagtgatggtccagtgtcagggagatggcccagatagaaatgtagcaaaattatcctgaaaaatttgattatttgatagaatggttcaccaagatggaaaacacagtcggggaggagagggcttgagaggaagacaatgagtaaaacgttaggcatggtcaatttgagtggtcaagggattcaccatggagatattaaacaggcattagatagccaggtctgaagctctgtagagaagtgtaagttcaaaacattcatttaggagtcacttgacccaggaggcaccagccgcaggtcacaggctccattgtcttcagggaccagtagcagtcatgtgaaaagcaggaaagagagacggttaacttggggtcaacaatgcgatgcacgccctgcccaaaggccttcaagtgcattcacctgggtgagtactcagcctgaggtctgaatggaaccttccacctgggaagatgttaaagtggttatgaacgaatgaaatctacccccaaggttttcctggtgcagaaagagaagactgaagatcaaatttacaacgtgcttagacttctacagtgttgctgaaatctacatcagacagtattttggcgaggagcaaggcttccccagcagtgttcatgatctgacagctgtaaccaatacctgacatttcccttttggatataaataattatctttcacagttatggcacatacacaacaagtaaatttccccttttatttggaaagcctctactttacaattcatgtttaccttcctgaatcttttctacatttcaaattcatgttttgtttaaaaagatgacagacacaggaaagcgttggttatggcaatataattaaaggacattcatttcactcaaacctgcatggtgatttttggcaggggagggggctggcaaatgatgttttgcctcctgtattagttttctatttcttctgtaaaaatttatgacaaaatttgtggcttaaagcaacccatggatgtctgaatggctttggttcctttctggaggcccaagggcagaatccactttcttccctctcccagtttctagaggctcacagccccttccttcattttcaaagccacaaaagttggatctctccagccattttctgagtagttacatctcctttgcactcttttcgacctccatctctaattttcaggacccttgtgattgcattgggttcacctgggtaagtgagaagactctttttaaggtcagctgattaacaacccaaattccacctgcataggttctgtttgccatataagtttataagttcctttatatctccgagtagtactgcgtggcatggatgtaccacacggttgttgttgtttttaaccctctacctgctgaaagacatctggtttgcttccagttttagcatttatgagtacggcagctatgcacaattgtgtacagatttttcttttaatggaggttttcattctctgagatgaattcgcccaaaagtgcaatgtctgggttatataattgcatgtgttgttttattttttaaaaaaacattgctaaactgttttccagagcggctataccattttacattctattgaagagttttgagcagtaaggtgatgcaatcctattcatgttttaaaaacattctctggatgatggatcaagaatgccagtagggagggcaaatgcagaagcagggagatcagaagggagcctctgcagtggttcaggtgagaggtgagagagagagtcaaagcatgggtgggtgtggctgagatgatgagaagcagtaggataagggacatatattgatgatataattgacagttgctgcagaattgtttgtggaaattgggagaaaagattcaaggaggatttctgtgctttgggcttgaggatggtggttcatgatggacctatttgtcttgataatgggaggacaggggtgggagctgacatgggaaagagatgagtgcctgttaaattctacagtggaaatcttgagtgggtggttagaaataagagtctggagccaaggggagatgtgggaagctggagagaaagtggaaaaggactatgtctataaatatgcccgatgcaaagcgtggcatagtcacaggcaaaagctatccacttgatctcaagaacaatcttttttcaccttctgggcttcacaaacaaaatagcaccttcagtttccatttcggtatagcaggtacggtaaccacaagaacgtgcaaagcagaaacaaagagcacttggcacccaagtcttatagaggctcatttctgatatcttctagggaacttctttgtataaggacgtcatagagaaggtttgtctttcatttgtctgtagcaaggtcgtaattttttttaatctttaaaaaaaattattgttaatacaaataagtctattgtgatttttaattctaggaagaatgccatacaaatcttttttagtacacgtttctgttttatactgtgatttggaggggtaaaaagggtaatacaaaatatggatagttttttcattgctggaatgttccacattgggttctgccttggcaacgtctcctgtgagctacagttgagggccaaagcagatgctccgtttttatgcatctgtcgatagccacatgactctgcaactgccactgcctccccacaccccctgagctggcgccagcacggagcagctgaatccgactcaggcttcatcccagctcacattccaccttcccgacaaggacactgaggcccagagatgaagtgggacttcccaccacaagtcaatgaggagatggggtagccaggcctaaaaccccggcctttggcttacagccgcccgtcattttcccaggtgcccacctcagaggccatccttggaaaaggaaacgtcactaacctatggttctggggaaatggagacgagagaggaagtaatatgttgttcttcttttctttaggcttctttccactgggtaaatcttctccatacataataaaatgaaggccccagatgatttgtgaaagagttgaaatgaacttcctgcaattgaacaaactattatgaagcccctactgtctttatcagcaattcacagtcttttgtccataagaataagcaggggacttaaaaaaaaaaaaaaaaaaaaaaaactactggtacttgggccttaccccagactaactaaattagaccctctagggtggactttgctctcagtatttttcaaagttacccatgctattccaacgtacagccaggaatgagaacaaactggtctatggtactgtgctaattgatcctgtctttggttctcaagttggggtgatttggcctctgcagaggataaaaggaaatgtctggagacttttggttgtcaccgttgggatgggggctgccgttggcttctagtgggtagaggtcagtgatgctttttaacctcctacaatgcactagacaacctccaccacaaagaattatctggccccaaacatcgatagtgccaaggtggagaaaccctaggcttatggatgccatgggaaacaccagttacctggatgtaaatccatggtaaaataacatagatgctatgacatgtggcccactggaagacacccatgtcaaatcccaggagccagtgaatgtgagcttatttggcaaaagagtctttgcagaggtaattaagttgggggtcttgagatcaaataatcctgaattatctgagcgtatcctaaattgaatttcaagtggccttgtaagagtcatagaggaaaacagatacacaggggagagggtgatataaccatagaggcagaaattacagcaatatggccccaagccaaggattcccagagccaccaggaggtggatgaagcaaggaaggatccttttttagagacttccaaaaaagcgtggccctgctgacaccttgatttaggtcttctggcctccagaggtatgagagaataaatccctattgtttttttgccacaaggtttgtagtaatttggtatggcagcaataggaaaccgatcagatgcctgtgcctttgtttgcaaaattcaacaaagcacattaggagagatggggtccatgagaagggataggatgcatgcaactcataaggctgaagacagacgggagtgggagtaggaaggtctagaagagaatctgacaaagatgcgggtgaaactctgaacccctggccagggcagggaagtcatgaaggccaagcaacacatccagtgatgattcttctgtcgacatttcatttctgaaaactggttgtttcattaaattttttggtttttcagatctcaaggtgtcagtatcttgtaacagtaatgagcttgattcgctgtgaaaagcaagacgtgtgaaatagaaacaaacttaaacttttaataatttcatttactaatggtcactaatgacctagaacccaagacacatatctttaaaaaaattagattagggaaatgatatataagcaaaataataatttagtaaaaggtgtaattatttttcttccttttgtaaaagttatttgtaattaacaaatgatcatttgtatatttttctagtaacacctaaaacttcctgatctttatccgtttaaccaacatgtatggtgttaaagaaacaggccaggtgtggtggctcacacctgtaatcccagcagtttgggaggctgaggcgggcagatcacctgaggtcaggagttgaagaccagcctggccaacatggtgaaaccccatctctactaaaaatacaaaaaaaaaaaaaattgccaggtgtggtggtgggcacctgtaatcccagctactagggaggctgaggcagaagaatcgcttgaacctgagaggcagaagttgtggtggaccaagaatgcaccattgcactccagcctgggcaacaagagtgaaactctgtctcaaagaaaagaaaagaaataactggaaagaaagtaccagcaaggaacgtcctttctcaatacctcttacatgatccctgtcccctacgtcctatggtttcaccgtatcacatcctcacacactcccctctaactccactttttaagtgactctgtttcctcttacattttcccatagtctgtcttccccttatataactgtcattatataactcattctgtaatgatttacttaaacctgacttccccattaggaagtatgctccatggggagagagcgcatatctgcttcgtatttcccccctaaatcctcaacacctgttacaattcccagtgtacagtaagcagtccataaagctggatgattactctgcatgtgttagtgacatgcatgaagtacccatttccccttggcacgggaagcccaggggaacagcattttcctgcctgacttctgaagccctcatactcatgatcctacgggagcaatggcaagggcaccggaaagccaggtcggagaatagagacccccagcctgctctcacagttggactcagcagtgcaacatcagtgactcctttgtgggagtcccacacaccgctgttcacacagggaacaccagtgcccggtggagctgcgggcttttgagacctcccgagtcgctttgtgtgcacaatgccgtgactctggatttgtacagtatgaccctcagacgctggaacaggagcacacgccaaagagaaaaaggagtggagatcactgagatctcataaatccataatgggcctgctctgtattaataaaacaatctcaatggtggagctccataaaagagaggcataggctgatgtaatttccttgaagtcccctgtaaagcattttactctgtaatacagctacatttatgaagtggttttatcttgaaagatcccaaagggcttactagactgaaaaggaaaatatcaagtacacgacatctcaaaacaccaccaatgtacttcggtgataacagttggggattctgtgacagcaggtagccctcttaaaaagcagacagcggcttagcccattaaacctccagggagaagtaaagagaaagaggagataattgtccacattggataagggccacacaggttttctttattaataaaggccatggcttgtttccatccgccacgtggatttaagtgggtgagctttatcaacatcattctccttatttgaaataaaagaaagaaaccaacttataacacttcttcataaagggactgagaaaatatatgtaaagcttccagtggttaatagaggtcaggtgtagccagtgtaatttagaagctgtgcattttaaaaagtaaaatataacctacagttataaaatatatccgacaggaaaaatatcttttcccagccaaattttactgaatccagtcctgtcgaaatgactgatcctgggtttttttcttccttgttgctgtcctggttaggacatggtggcactaacttttagtgaattagccgaggatataggggaatggttggcaggggccagaagtccttcttgattatcctccaagaatatcaccccactgggagctaagaaggaaggtggaagcaccaggtgatgtaagtttagcaatcgctgagtactgtcaaagaaagcagtctgagacttcaaagtaaataaaaagtagctcccctttcttcaaaaatgttaaaactgatccactctctaaccaggaatactgttgtctcacattccctctgcagtttctctcatcccacttctgcttccagcccaaacccctcacccgtctcgttttcccaccagaaagtactccttgtctttttactaatactttgcttcttccctccccacacgatctctccaaagcctgggaactgagctagcaaagagaatgctcttctgagcttggagctgaacaaggagcccctatggaggagacaaagatgcaaaatttttagtttggttttattctcatttaagttttctatggagtatttttcttgtgatttaatctttggatgagactatcaatgtacgtttcttctaattttatttttcaaatattccattgcaaacttatttagcatttataattgaatactgataagtgaatttatttattcatttatttattcatttattttgagatgcagtctcactctgccacccaagctggagtacagtggtgtgatcttggctcactgcaacctctacttccaggttcaagggattctcctgccatggccagtattattttttaaatttttagtagtgacggggtttcaccgtgttggccaggctggtctcaaactactgacctcaagtgatctgccagcctcagtctcccaaagtgctgggattacaggcatgagccactgctcccggccagtaaactttattttattttaaaaacctgttttggagtattagcccactggtttacattgtcttccttacatacatcacacccatatggaggagtactttaaagacaaagttgcaatctggtagcatagctgcccagtggagaaaaagtgcacatgtaaagcctgagtaattcagggcatgaaaatatccctgtcagccaatcagtcaacgagttgaccaagcgtcttggctagcctcagaggtaccttggcaggcaggctcaggcattgtgcagccctgtgtaaaattttcctcatagtaactacgttgtctttacatcaacctgagaagtagatactatttttcctatttttgtttgtttgtttgtttgtttgagacaaagactcggtctgtcgcccaggctggagtgcagtggtgcgatctcggcccatggcaacctccgcctcccgggttgacgccattctcctgcctcagcctcccgagtagctgggactacaggcgcccgccaccacgcccagctaatttttttgtatttttagtagagatggggtttcactgttggctaggatggtctcgatttcctgacctcgtgatccgcccacctccgcctcccaaagtgttgggattacaggcgtgagccagcgcgcctggcctatttttcctattttattaatgagaaaactgaggctcagagatgctaaataacatatctgagttcatcactgccagtcaatctgggctcaaacattccgatccagattgctctgattctagagcctttgttctggaaatctgtcttttataatacacagggattttatttttaaccttttattttgaaatgaattcagacttacaggaaagttgcaaaaagaatgtaggtaattcctttatatttttagttcaaatttttcaaatgttaacatattatcacatttacttaatgattcctccctcccccaactattgaagagaaaattgcagactcgatgccccttttcccctcatcttcagtgtgatatttcccaaaaacaaggatgttttttctctctcatagaatcacagaacaatgatcaaatcagcaaattaacgctattaaaaattatctaatcaacacacttaatttggatttatccaattaccgcactaatgtttttttattgcaaaagaaaatattttggcccaggatctaatccaggatttaatattgcctcagatctcatgtctctttaggttcctttaatctggaaaagttcttcatctttgttctgtctttcgtgaccatgacatagttgaagattataggttggttagtttgttcggtgtctcccatgattagatccaggttaaagaaacagctggaaagaaagtacaagcaaggaacttcctatgtcaacacctaaataatctctgccacccccacccccatggctttaccccatcacatcctcacaaactcccctctacctccacattttaggtgattctctttcctcttacattttctcatagtctgccctccctttatagctctaatcacaacttgaattgtataacaaattctataatgatttttttaaaactgacttccccattagggtgtatgctccctggggactgagctcatacctggttcgtatttgcgcccgctgaatcctcaacacctagtacaattctcagtaagcagtccctaaagctaagtgattactctgtatgtgttagtgaaatgcattaagtgcccatttccccttggcgtgggaagcccacaggaacagcattttcctgccttacttctgaagtccttgaactcacgctcctactggagtgatggcaaggccactggaaagccaggtcggagaacagagacccccccagcctgctttcacagttggttccggcagttgttgcatttgtggcaagaacctcatggcagtattgtgtccttcacagtgctttgtatcaggcagcatgtagcaggcttttgtgtccttactggtgacattaacttggaccacttacagagggtggtgtctgccaggtttctcctatataaacttaatttttcctcctttgtaactaacaagggtcttggaaggagatatttccagactacacaaataccttgtttcttttcatattttcacccactgattctaggcttctttgataatttttgccctcctgccccaccaaaaaatattttaccattatggttaccaaatggcgattctctaatggcatgagtccttctacatttatttgttggcattctattttaaggaaaagctccccccaacttaagaatttatttccaattttaaaagtttcattactatggttttatgggttctttttttattctgtagggtaacaatctgttgctacccttatttattcttgtgcgccaattgtccaccgtttgtccagtgggaagcctaacatgcagtttttatattcaagtatcctagcacgtcaacttttattgcttcacttaaaatctgccaccttccaccttcatgtcctgaatcctttatctagaaaatgtgtaattttccaagaaggcctcagacctagtggtccagttactgtctgtttttgctgactaactcttgaaataagaatttttttaaaagctggtagtagggatgaagggggttaagtgacagttctcctaagaagcatactcatggccctgccagcggcttggagacataagggaggtaaactgaaatctttcctgaacacttcatgctttttggtttctctccactttttaacacactgcagtgtaattccctccactatcctgaaaacatggatttagattccaagacccatctctccttctgtgaagccatcctccctgccccacccaggcaggatgaattattctcttcttggcagctctagaagccctggtataggcttttgttctagcatcagtcatatggtgttataactatttttgacactccgttcccctcaataggctgtgagcctttcacaaatgggtttttacatatatctgtgttaagtaataataaggctgggtgtagtggctcacgcctgtaatcccagcagtttgggaggctgagtggggatgattgcttgagctcaagagttcaagacaagcctggacaacatggaaaaaccccatctctacaaaatatacaaaaattagttgggcatggtaatcccagctgctcaggaggctgaggcaggagaatcgcttgaaccctggaggcagaagttgcagtaagccaagatcgcatcactgcactccagcctgggcaacagaatgagactctctctcaaacgaaaaagaaataataaacatttttaattatttaaaaatgtgttagaatcgatatctaggtcattgtgtaaaccaaaggccagcaaactttcctgcaaagggccaggtaggctttgtaggtgatatagtttctcttataactagtaaactctgctactgtatatctaatggccctatacacgatacataaaagaatgaatgtggctgtgtttcaatagaactttattcatataaatagacgtggggctgaattttaccctagggctataatttcctgacccctgatctctcccacctcaaggtcttcctattagctgaatacctgccttaggaaatccctcattttctctggctattttctgcatattctttttttttttttttttttaagcagctttctagcttctctctggaagagtggaaagatgatggggctagcccatagtttctcaacctgggcaatattgacaatttgaactaggtaatcttttgttgtgagggagtacattatagaatgttagcagcatgcctggcctctacacactggataccactagcagcactgcagtcatgacaatcaaaatgtctccggacatcgtaaaattacccctggttgaggagaatcaggctagtccgtgcacaatatatttttaaatttttctttagttcttcaagagccttccaggtgaaggaatggactgccacagccaaaaacaagatggctagcaaactcttctctccaggaaacgtcttcctaataaggcatattttattattttgtcagaaagtccatttctacacctttcttaatcctccatttagtatttctctttttttttttattatactttaagttctggggtacgtgtgcagaacttgtaggtttcttacgtaggtatacacgtgctatggtggtttgctgcatctgtcaatccgtcatctacattaggtatttctcctaatgctatccctcccctagacccctacccatcgacagtgtggtgtttccctccctgtttccttgtgttcttatcgttcacctcccactcaggaatgagaacatgtggtatttggttttctgttcttgtgttagtttgctgagaatgttggtttccagctacatccgtgatcctgcaaaagacaggaactcatccttttttatggctgcatagtattccctggtatatatgtgccacattttctttatccagtctatcattgatgggcatttgggttggtttcaagtctttgctattgtgaacagtgcatattcttttttttttttttttttttttttttttgagacggagtctcgctctgtcgcccaggccggactgcggactgcagtggcgcaatctcggctcactgcaagctccacttcccgggttcacgccattctcctgcctcagcctcccgagtagctgggactacaggcgcccgccaccgcgcccggctaattttttgtatttttagtagagacggggtttcaccttgttagccaggatggtctcaatctcctgacctcatgatccacccgcctcggcctcccaaagtgccagtgcatattcttaagggctcagcttaaaccttacctgtttgagtgtaaggcagagctccttgatctgcataatagattaagttccagtgctgtatttaccaaagtcccctctattatttccctattagagcattcattagtattaactataatgactataatgacttgttttacctttgaaattttattaaaattattgcaagagcacttttttaccttccaatgcccagtgcttcagtacttactcagagtgcaggcacatttaaaatatttgttgaatgtacaaataaatgtttaaaaggtttcacatagactaggttgcaaaatccatagcagacactgtaggtgctccacctatatcctttccttttaccattctggggcatactggcctaatttacttgcagaagaacaaacacattctgagaacagccaggcctcaaccaaagaccagcaggagcaggtgcataaataccccaactccctcacccttcgaatgcgatgactctaaggcttatgttttaaactggcttccataactcaccagcaggattcagttctagttatccacattgacagctgatttgataacagccgttttgttggctgctttccctgccttatctcatttcctattctcactgtcactctcattcctgttctcttattctcatgtagtgctcccatcaccttccacatcaaccccgcacacttgaatccttgttgcaaggtctgttcctaggacagcaaagcataaggtttccaacaaccctgtgagatgtgtatcatcacctgtattttaaaagtaagaagtgcagggcagagagattatggccatctaccaagtgcatcgaagaataggcatctaacccagacctctggctacaaactctggacatcatccagttcaccatgttgtttctataaggtgttcaactagtgtgcgttaaatgacaagatggctgggtgtagttctgatataaactcttcccaaattcaaccttgaattcaaatggtttctttctagtcgtagtatggtaccaaatagataagtctgtttaggtaagaattaaatgtaaaaaaacacaaacatttaagttcattggattgtttccccttaactgcctgtgccccttaaatgctaccttttcctgatcctatttgaggggggaagtatcttttgaatcccagacttgcagggacggattctgcatggcctgtacccttgtttgcagcgattactctgctcagaggaggatgacctgtgtggggagcctcttcagctacttgaggcactaaccctctagcccaggaagtcccattattgctgggccctgccataagcttatttgtatttcacagcgacttgcacagatgtgccagatatgtacagatggatttttatcagaagagagtctacccaagtgaagcagtgtagggtgaggctaaatcccaaaattgaaatttggggacactgattaggcacagagcaggaccaggggttaaaaccatgtgggaaacagatcaatagaatggaggaaaacagtccctgaggaggaccctatgacagaaatctactatagagaaacggcctgggcagaccaagcataatattcagtggagagtctgggtgtgagagctgtgtttgggtgagaagcagggaatgattgaaaggtaagacaagagaaaacatttccttttgttcattccatttctgcagaggctcttgtatttctgagtcccattttgaaagtcacacagcccagcatctcatctcttctttagccgaaaaacatactgcattagctgagtctccagagcaagttgttgctagccttgggacctggggaggttatttcagctgtgagtacctcacttccctcacatgcaaagtgcagtagtaacagcacttccatcctatggtagctgggacggaaaatgcataactccatgtgaattgccaaggatagtgcctgtcacgtggtaagcatttaacacatagtagctgtttttaatattatgtgtggtagattggcaccattccatgaatccaagccatttgggtatgataactgaactggttgtcaaagcaagaatcagccttgtgtttacaaccactgagaaagagcttgtcaagctcttagctgaaatctgtacaaaatatctgctgcaggtctctacctttttaccatttaaggtccatgaaggaaaccaggtcactcaggcacaacctgattttaatgaaccctcgtaggcgtctaaagaatcaccactttatttttttaaagtgttcaaaaccattactttaatgatttgttctggagtctcgacccagaacaatgtcagtctcgttacagaatctcagaatttactgccactttttgaaatagttggagatactttctatcctctgtctcagcatttctgccactcttctggattggatttatttagaacaattaaatgctgtcttacaatctctttccccaacttggggtttctcttcccttctaccaacgttcactctgcattttcattctgatgctcatttttcttggcattttgtctggagaagtttgaagcagagcagatgctcagacggtctgcatccctcctctttgccgtccttctcctttgctcacctgcaagaatcaggctttacgattcaactttctgttccaaacatagctttaaagcctgtttgggtgtccttagaaatttttctaagtgtcagctcatatgagacacccgctccagatgtcttgttttcccactgttcactgttcaatttaacaaaacacatattaggcacctactgtgaggcaggcattgtgctgctcttgaaagatacaaaggaaaacaaggtgtagtccctactttcaaggcgctcacggtaaagctagaaatgtaaacaaaccaacacaaaacagtgtgcaagaatcctgttaaagacctgccctcactgaactgtgcccctccacctggaggctgcagcgggtcaaggatggcttcactgaagggatgatatttgaacaagacttatttttatttctttttattcttctatcccatgacatttccttttctagtctcctaggcagccatcaacaaggtgcacaaatatgtctttttgcttatacagtagtcatacaaaatgcatgttgcagttttgtactcagctgtttcattgatgtaaatgatcctgtgtcacatactcacacaccttattttttgctttccctctctaagcatttttggtttttggttttttttgaaacagagttacccactgttgtccaggctggagtgcagtggtgtgatagctcactgcaacctctgcctccccggttctagcgattctcctgcctcagcctcccaagtaatccctgggattacgggcacccactaccatgcccagccaactgttttgtttgtttgtttttgtattttcagtagagacagggtttcagcacgttggccaggctgattttgaactcctgacctcaagtgatgctcccacctcggcctcacaaagtgctaggattacaggcgtgagccaccatgcccggcctaagctttctttgtaagatgcattcatgtcagggtgcaaacatccaggctgttatttccattcactgtgtgtccttgcatcttccacatccttcacttttccattgtctccatgtagaatgcccacattgtctctggttcccaacaccctgaataactgcagcaataccctttacgattcacatgcagatgggtgtaaaaggttccttggcttatatttgcccagaaatggaatttctggatcacaggtatgacaggcagaataatgaccccaatgatatccacattctaatacctagaaactgcaaatatgtgaccttgggtggcaaaagggactttgcagatgtaattagattaaaatttttgagattgagagatcatgttggacgatgtaagtgggcccagtataatcacaagggtccttatcagaaaaaggaggaggcagaagatccagagttggagagagatttaaagatgctctattgctgtctttgaagatagaggaaggggccaggagtcaaggaaagtgggcagcatgtagaacatgtaaaagaaaaggaagcagatttgtccctagagccttcaagagtctccatgtcagacttttgacctcaaggactataaaataatacatttgtgttgctttaagccattaagttcctggggatttgttacagcggccgcaggatgcccacacataaactacgcccagactgactttgactgtaatggcgctgggtcagtctcagaatggctgtccaggcccacatttctgatagccgcacatgaagtcctcacgtctgcacaccctcggcatcacttggcccaactcgtctttctgatttctttcagtccgatgggtataaagcataaacaagtcttgaataaagagtcagaattccttccaataaagtagggtggttgaggtgagatgggggatggccttggggccctggctgctgtggttggatggtctggtctttgggagaggatgcacaaatcattaggaaagcagagataaggctcccaaggggctacatggagagtaagtggagacaaaacccgtgcgccttgtgaggacacagggctgtgtggactccatggaagagagggccccagacagtggcaggcagtgtggggtcacagtcgtagtcaggcctgggtgtcagtcacagttctgcagctgccgtgtgaccctaggcatgctcttaacctctctgatccttggcatccttctccctgtgacagggataataatactatctgctcataggactgccatgtggcttacatgagatcatgcatgcaaagcccctaatacagtgaatggtatagagttggcacccaacaaataatcatcgtaatgatactattttcattagcacaataattgtaataataattacagtttcttacattcctcaactccaagaaaattggatttttcttgtaatctgcaggatccattgctgaccttgctcttctatctggagaataatgtattgcaatcagtttccacatatttatatgcaaaggcctttatatattattttcaaggagatcttcccctccttaaccattgcccttgtctatacccccatccctgaaaaatgggggtttccttttagggcttttaacagcataatgcagttgaatacaacttattttactgacatctctcctccaagcgctctcccccagcactttccaggactaaataatgcatgaagggagagaataacagggattgcataaacgacggaaaacagcacggtaaggattctgtgttgtgaagagatgaaagcccctggtcagaaggccagtaacaaagcaaagaagaaatgcaaaggcattgacgagggagacaagaaaagtatttttcaagataagatttgtggagagttaaaaaggagatgactcaggagacagtcaaagactcttcattagacaggaactccagagtgggtacaccagggggcctgggcttttgaagggctggggctctgaagaagttaacaaacaccagctccacttcctgggcctctgaagccttctttgacgtgcccaggtgggggccgattcttcttgcttggtgtcctatgcctccctcttcctacctttattagagaatgtatctcactcaactgtaacggtggattcctatgtcctttttcttcactgtgctggagctccaggcgcttttccagttatcctcatgcttttccatcttagatgcttttccagttatcctcatcatagattaaaataataattgttggtcatttagtctgtccctgtgctaagtgctccatgtgcattagataaattatgcctcaagacagccccagatacccattttacaactgtagaaactgaggcaggaggagattgagacttgcttgcagatgtgcaaatggtggagaatgtaggtgagattggcactgaggggttcagactcccaaatagggctgttgagtttcttttactcccaaaaccaagcacagtgctgagcacgaaaatgcactaagcaagagtttgatttgtgaacacattattctgcctggaactcagctagctagccaggtggtactcggagttggcatttctgttgctcaggccgggctgcatttggtgagttgcgggaaggggatgatgacatcttctccagttgacaaaagacaatggcttgttctgaggagagggcctggaactcttggtccatcagtctggctttgtcctgtctattatacacagtctaatcacccccaacaaatggtgctaggaaaacgaaaacaaaagctatatatttcctcttatagaatttttaaaacaactaaatatacctctggaatacactttacaaatttatgctaaaggcttccacaccaatgtggctcctaagttcccaaaattgagctccattttgaattgcccttggccctgctctctctgggattgctagagagttccagcatggacccagtgtcctttgtgggctgcagagctggacaacactgggatgagtaaggcagccaaccctcagccctgggaggcacagtgagggccagggtattaaccagaagcttagtagtcattttaccatcagcattaagtcacccacatgcacactgatatggtttggctgtgtccccacccaaatctcatcttgaattgtagttcccataatccccacgtgtaatgggaggaacctagtgggaggtaatttaattatgagtgagttctcacgagatgtgatggttttatatggggcttttcccccttttgcttggcacttccccttgctgccaccatgtgaagaaggacatgtttgtttccccatccaccatgattgtaaatttcctgagaactcccagacctgcagaaccgtgagtcaattgaacctctttcctttataaattacccagtctcaggtatgtctttattagcagcataaaaatggactaatacagcaaattggttctgagggagcagggtgctgctctaaagatacccaaaaatgtggaagtgactttggaactgggtaacaggcagaggtaggaacagtttggagggctcagaagaagacaggaaaatgtgggcaattttggaacttcctagagacctggaaggctcagaagacaggaagatgtgggagtttagaacttcctagagatttgttgaatgtctttgaccaaaatgctgatagtgatatggacaatgaagtccaagttggggtggtctcaaatgaagatgaggaacttgttggaaactggagcaaaggtgactctcgttatgttttagcacagggactggtggcattttcccctgccctagagatctctggcactttgaactggagagagatgatttagggtatctggcagaataaatctccaagcagcagagccttcaagaggtggcttgggtgctgttaaaagtattcagttttatgtattcataaagacatggtttggaattggaacttatgtttaaaagggaagcagaacataaaagttcagaaaatttgtagcctgacaatgcaatagaaaagaaaaacctattttatggggagaaattcaaggctgttgcagaaatttgcatcagtaatgaggagcaaaatattaatcaccaagacaacagggaaaatgtctccagggcatgtcaggggtcttcatggcagcccctcccattgcaggcctggaggccttggaggaaaaaatggctttgtgggccaggcccaagtctcccctgctttgtgcagcatgggaacttggtgccctgtgtcccagccactacagccatagctaaaagaggccaaggtacagctcaggttgtggcttcggtgggtgcaagccccaagccttggcagcttccacatagtgttgagcctgcaggtacacagaagtcagtaattgaggtttgggaacctctgtctagatttcagaggatgtgtggaaacacgtgatgtccaggcagaagtttgctgcagggacagaacactcatggagaacctctgctagagcagtgcagaagggaaatatggggttggagcccccacacagagtccccactggggcactgcttagtggagctgtgagaagagggtcaccatcctccataccccaaaatggtagctccaccgacagcttgcaccaccatgcacctggaaaagccacagacactcaaagctagccatgaaagcagccgggaggggggttgtaccctgcaaagccacaggggtggagctgcccaagatcatgggagcccacctctagcatcatcatgccctagatgtgagacatgaagtcaaaggggattatttttgaactttaaggtttaatgactgccctattggattctagacttgcatggggcctgtagctcctttgttttggccagttactcccatttggaacagatgtatttatccaatgcctgtacccccattgtgtctgggaagtatctaactggctttggattttacaggcttgtaggcctcgtctcagatgagactatggacttggagttttcagttaatgctggactgagttatgacttttggggactgttgggagggcagaattgtcttttgaaatgtgagtacacgggattttggagagtaggggcagagtgatatgatttggctgtgtcctcatccaaatttcatcttgaattatagttcctgtaatccctacatgtggtgggagggacgtggggggagacgactggatcatgggggtggttaccctcatgctgttttcatgattgtgaattctcatgggatctgatggttttataaagggcgtttcccccttttgctcagcacttctcctggatgctgccatgtgaaaaaggatgtgtttgcttcctcttccaccatgatcatagtttcctgaggcttcccaagccgtgcagaattgtgagtcaattaaacctctttcctttataaattacccagtcttaggtatgtctctattagcaggatgagaacagacaaatgcacagaccaacaaggagtatgtggtgagctttttcctgccttgcttttttgaaagaggaaaacaataagatcagaacagattatcactaaaattggcagggggaaagtgtggcacagtcattagaaaaaactggactttggagaccattttaggaaatcttggaatactagcattgtttggggccacttccttgggtcatgtttaagtaagatttgcagcagcccatagatgactcactgaaatttaatcattaatggaatattttataaaggggcagtttataaatgcatagttgaagtacagggaaaccacaagggatggcaccacccccaggggctagtgatggcagggacagttatctgccctggtctgaagggttaagaggagaggagggagccctctctgaagtggagacagtgaggtgtgtgtgcagaaggccacctgacgtgtctgagaccttcctttgagagatacagccagccctcagtgacccagcagggaagaagcaaggataaacacctgattccttttctccctgccttccctctgtaatgagttttgtctgttggtcaaaactagagactcacagagtgctttggctgggtccgtaaagaccaatctccagggaccaaagaaaggtggtgaagggaggagctgggtaaacagaagctatccagcctggttttcatctatccagagctgtacacaagatggtggattgaagatgattaaacacaacacagtattataagttttagaggaccaaataatgtactttaaaactaatgcaaatgtgatttttttgaaggctcatttcatggtaacactgtgcggagctcttaagtcaaacatctctttcaatcctcccaacaatctaggaagataagttatggtctccgtgttctctagtagaagaaacagactttaaagattttggtgacattttcaagcaaactaccatatacagagtcagagccctcaaactgtgaactgtatccttttggggttgcctttgtccccaagaacctccttgtcttctctggtcctcatttttcaacacagtcaagaaaatatctgtttgtttcatgactgagcattcatgagagccaaaaggaaacaatgatttattaaagtgtctatgtcaggaagttcttattggctgctcccgttgttaattgagtgtcttgaaacccttctggtgctttgtaattagtgctccaggacaaaacatgctgctgcttttttctcatcccctaaattttgccatttcagcacaaagggagctcaggtgcatcaggagccccagcctcctgcgactggactgcatacatacaaatacccattctaggtggtttccaaaaggactccatttctatgggaatattttccattgagctgtttatgaactttcacttagtgattaaaaaattattcaaaaggagggcaatagtaataaacttccactttccgtttcaccagcatatctcaaaactaaattaattatcagcctgtgtgaataaagtttgtgtcctgataaatgtattccctcaagaatgctcaattcacctttccccaggtctccagctcacacactgcagtccaatttcaaattcttccgtctcaccatgaatctccagtcttgaagccctctccttgaccccctccttggagggtgatgtggtaaatcaagtcagctctctgtgaatgtctcatcattctccacctgccacagcaattttgccccctctgctctcctcctggggtaaagagtctttccttgttagggcttaaccctttaaactagtcttcccctgctggtccaggcaaggagcctgttccagcatttggttctttcttctccatcttcttcaggtgttctccttccttctttaggtcagaaaagaaattcatgaaaaacaccataaaataaaattttaaaaaatccattttctacctttcttgcaagtgcttttatgtttctatgcatctcctcacatgggatgctcacattcagcctttgctgcaacattgtgccttcctttttgaatgttctacccaattttctcccgtaagcccttcaacagctaccagtggcttcctaatgaccattcacagtgtatgcttctcaatctctgcagcttcgaacactgttgactttcttcctttcctaccccagccttgaaataggtatccatggcaaaacattcagtccctactcttaaccttgctgtctgaatgctgttgcttgccattggactattctggaacaggaagtatagcattctaacagcatggtatatgaagccatatttccctgaatcaacttctagttttagcacttattagctaataagtgtatgatcttaggcaatttattaggaaaaaaattaatctcagtttacccaactataaaatggagataataatgctttgtaggaaggtatatgaattaattcatataaaccaatttcacaagctctgtaaaataagaatttcttcttattttataaataatacttatcttataaataataagatgttatttatgccaataatatctacaagttgacattttccaatattctgcttttagaactgtattaggttcctattgttgtattaaaaaattaccccaaacttagtgacttaaaataccacaaatttattatcatacatttctggagctccgaagtcctaaaaaatctaaagtgtcggcagagccatagcggagaatctgcttttttgcctttttcctgtatcccttggcttagggactattcctccatgttcaaagctgcatttgcatggcttcaactatcagttctatgtggaagattttttctgattttcaggccagtctcatatccccagagaaatgcattcttatccccccaactatttgccattgaaagtaatggcaaaaaccaccattagttttgcaccaacctagtagttgcaggtcgtctccctgtggctgcactccacacaaatacaagtaaacgcatcacaatcctataactaattctgttccttgtcctgatgagcttccttctacaaatggccctaatattccctccatttcccagtatttattgagggatgaagagtctttctgtcaactttcagtgagaagaagtaaataaaacagctttgatggatacccccatgaaccggagtgaaagggatactcctttaaatcatagttatttcgtttgctaagcatggtggccctgagaatatgcctcccagagcctccaccacagggaacacgactgacatgtgaccccagatgctgtactctgaagcccatgacagtatttgggctgacgctatggtttttattatctttcctcaccaaagacttcagcaagggagggatactaaggcaaatctgtttctgggaatcttcaaactcattcaacagctgatcttggctccagggcttccatatggccttgcaggacctttcttagactgcagagaagtccagaacactttttacttagccttcctttcctctctccttcactcaaggtcagattttcatctcagtttgatagctctccccgctcctcccagcttcgtccccattttttctcacccggctgtttcccctaatataataattggtcttcaattttaacttgcatttgctcctcaggagatctgaacttatatgtcatagtctgagtttggagggttgaagggtcaagacctgatggtgaagcccacttcctttgagttccctggattccaggaagacagaatttacaactgccagtaagggagcaaccagacgatgcaaactccttggcaccaagaagagaatgtgggaggaaaatgagatgttttagaaacaacagaggaatctgtgagacagggctgctgtgagatgatgtcacacttgacataaattgacagttaattgcctggagatttgggaacagttcaggggtgtgtgtatgagagagattgtgcataccatgaacaatggacacaaatatatatgcctgcttctgtgttgtgtgtctctctgaattagtgttccctggtccacttcataggatatttcaccagcacctgggactgactgtaagggggaaatggatttgctcatggacctttcagcagagggaaaaatgggtagaagcttctaggaagcgggaataatttcatgtaaagagggcttttcctgaagacacctgacagagtgggtagctggaggcatatctgccatagatacaaggactttctgccgtgggtgggaagctggactgggaagcccacaagaccttccacctcagacagttgtagaaattcaaaagtcccagcagttttctaaacctggcaggtcacttgaatcacatgggaggccattaaacacaccccaaatattctaaatttggatttcaagggaagggcttgaaaggaagagcaaggaacctggataaaactctaaaaccttctttcccttgcaattgaattagccagcctaatttgaaaaccacactgctttgttgaacagaattcccggaaccaccccagacttgaagtatcattcagctatgtcttcacatgggaaatgtgttgtgctatcagaagttgaattgcttgtttcaatgtgtttaagacaatgtacctccgaatctggcaggaatgagtttaaattctgactctgctacttatcatctgagtgatcttgaataagatattcaacttctcagaacctcagatttcttcgctgtaaaataaggatggtaatgacacctttttcctaaatttactgaaattatcaagtgggataatgataacagttaacattcattttcaacttgctctgtgccagtcactatttcaactcatgtattagctcatttgtttgtagcaactgtctgaagaaggttcagctatgattcccgctttacagatggaaagattgaggcatcaagaggtcacataacttgctaaggtttgcacaactaaacgggatacagctgatatttaaacctaggcaattcagtcaaaatctacttttcaggatagtatgctttatacacacatactatgctatgtgtgtataaagcacttaacccagagcttggaacacactatgtgctccataactattagctaatgttataatcactgcttttaccctgggacttacagtgaattgtcacaactctccagcatctgcaatattcctacttagctgcttgcaaagccagaacacctgtgtcttcatgccctctcctttttgtgcccagcccctgtctcagtgatgagcaggacagcatgcatggatcattaacttactgagactgagaatgtcaaattcaagacctgttgaataaggtcagtaagtaatagtagttgctgtatttctcataagtgttgaaaaggaatccttacagaaatacattactttaatcctaatgtattttgacttcttcaggatgcacaggtgtccagggaactgtagtgtcagtatctctgagaccttaggagaacttcttttgaatctaaaggagggggagttgaaaggcatctctattatagcaaaaagaaattagagggctgattcatcctattctgtagggaaagcagaactctgctcagagatcttgaagtaagtaaaacatggtagttacttttggaggaaaataaagtaccatcgaatgtagaatctgatggtttcagtgaaggtaataaatggtgctttgatgacaactgtattcattagacatatttgtggctttcctcctcctttctcttgcagataaattctcactcaggccctacagagataggtgcgtggttttagagatcatcagatgtgggtttaagatcacttttgccacttcccatatgcgagatcttgggcaggaccctcaccctctctgaaccttggcctcttctttctgaaatgttggtaattgatatggtttggatatttgtccccatccaaatttcatgttgaattgcaatccccagcattggaggtgggacctggtgggaggtgactggagcatggggacagatttctcctaaatggtttactaccatcttggtactgttctcatgatagtgagtgagttcttatgagatctggtcgtttaaaagcacatagcacctccctctttgctctgtcttgcacctgctctggccatgtgttgtgcctgcctccctttcaccttccaccatgactggaagcttcccgaagcctccccacaagcagagcagacattggcatcatgcttcctgtaaagcctacagaaccatgagccaattacacctttcttctttttaaactaccctgtctcacgtacttctatatagtgacgtaagaatggactaatacagtaatactcttacacttattgtagagatgttgtgggacaacataagacaattgtaaacacagtctgtgcctgcaagttcagccaggcactctgtagagatcaatactgtccctaggatgctgtgaattttcatattggtacgtctgagcctgagtaacacttggcaaccagagtgagccccagaactggctcatgtggaggtcagtgacaaacctttgacatttgatacaatcaaaaccaagccgctttgtttaaaatgctcatcaaatacctaccatgcacactgtgtatataaaagtcattgtcacaaaagccctttttcagaatctctagcttgccatttctctcagatttcttattgtcctctgggtcaaaaacactgcaaaatttcattcctttaccacagcaagcttttatttctggtgtacacacccgagtgttatctggaatgtggctgctctaagctgggcctctgctggatttaactctagactattggttgagctaaggtcttcttcctgtgtctcttatttttctagggatagcagaaatgaaagaggcaagtccaaccacacaaacatatctcaagcctttgcttgaactacatccaatagtacctgctggtcaaaccaagtcacaaggataacccaactgtaagaccatggcaaggtgatgaatgtctacaaataccgcaaatgggtgaagaattgagaccatatctcattctgtcatacctggaactccaaatttcccagttcttttaaacttttatgagttaggtactttcaagttgtgtaggacagactcacctggtttgggtgagttaagtctatggaaagggaacagaaaacatgtgaggaaacacttatcccatctattccatcttatcttgatggaattagaatttagggattcacttttcagggacaaaaagcattcaggaaggtgcctcacacaaaatggctactcaggaaatgtttatggagaggacatgtgaatcagtgaggagcggctgtagcactggtcaccttgccgttttcccagaagtagcctccattgctccctcctctgtggtcttcaatattctcatgattcaacttccctgtcttctttggttcttccagttactgctgtatcccttaaactcgcccaaaaggaaggattgtgttgcattaattagctgtctttctatctactgggcagagatcttatgatatgctgcctcattggcatgaatcagccaatttttgttttgttttgttttgtttgtttgtttgtttgtttttgagactttgagatggagtcttgatctgtctcccaggctggaatacagtgtcacgatcctggctcattgcaacctcctccttctaggttcaagcaattctcctgcctcagcctcctctgtagctggtattacaggcccctaaaaccacgctcagctaatttttggattcttagtagagactgagtttcactatgttgaccaggctggtctcaaactcctgacctcaggtgatctgcccgctttggcctcccaaagtggtaggattacaggcatgagccactgtgccaggccatgaatcagccagttttaaaaggcttctttttaagttgctggtcactggttgaatcgcaaagagtgtaaggaccatgcaaggaattccctatggctgcattcttcagcaagggtctgtgggttttgctattgcttagagactcaaggattttgtgttgggttgccccatctcttgctttgtgattctgcctcttgggatttggaaaggtaacctggatctagcacagagaggtctttctccctttgaagtgttcatcatgatctgatgagtcaacagtgcctcgtctcattgtttgctacactagctggctggaacactaccctcccagcagagcactccctgccagagcatgatactgccactgccaattgaagcacggctatgtttttacatcttgtagcaataaccctccttcctcaatcattgaagactgatcagctgggccaaaaccaaagcaatataacccagggtcgtgtgtgtacatgcatatgtggtgtgtgtatgtgcacatatgcatgtagtgtatatgtatgcacatgtatgtaagagcacgcacacacgtgttctttttaatataaagaaatgcctttagagaatgaaatgcactgggggcatccaaggtgaggagacttgagggaatgttttttgttttttttcttggcaaatcagtgaaagatgggcagataagtatggtgaacccctagtgtgaagtagagaaattggaggctggagttatagaggcagatgttgaagaacgtggaagcttctagaagagctgaaaacgtccatagactgagtaatcggccaggcacagtggctcacacatgtaatcccagcagtttgggaggctgaggcgggcagatcacctgaggtcaggagttcgagacctgcctggccaacatggtgaaaccccgtctctacaaaaatacaaaaattagctgggcatgttggtgggtgcctgtaatcccagctactctggaggcccgagacaggagaattgcttgaacccggctggcggaggttgcagtgagccaagatcgcaccactgcactccagcctgggagacagagtgaaactccaactcaaaaaaaaaaaaaaaaatgcgagtaatgaagggcagattcaggaccgggactggatgctcactcagtaggttgctgtgtcccgcaaggtaggaggtgttctgtgggtgaaaggcaaagacagagaggacatcaggtcagaacattccaagtgagactctacgttccttgaagactccattgtctcatttctttttatatctccagtgccaaagacctaagtgagccctctggatattagataaataaattaacttattaaaggatgaaagagtgaactactaagttaatttgaaattgaaatatagggtaaggcctgcacttacacagagaaaatgaactttcaaaaatgtacaaagcagacaaaggggagacggagagagagaatgaagactgaatgggtatccaactgatacctggaacatggcagtgtgagtagctgaaaaaggaaaagacctcaaggaatggggctgtctgtggggcctatatttatgttgacatcactcacaagtacaagtctgcatccctgggtgtcctcagacaagcatatagtttgcatatcgtattaccttttgtgttagtaatcactgattttgaatcttagctgactgtggaggtgctgttctgcctttgacatggcagtgtgagctggagagggatggggagatgaagaagccacatgtcccaggaatatcaggatcctataaacttattctgggtaaggcagtggcaagggtgaccagcaaagtggtgcctgaaggctgggaatccagtcatgtcaattttcttgtttgtttctctctggcaccttctctaggcccagagcctagatgaggctgtgtggaccagtgatacaatggagactttaattttctcgattagtgcagaggatgaagaaatctcagcagtcatgctgtattcaaggtgcagggtattgcctgcttctgttctcaatgctggctctcgtagcttaacccacctatacagaagtgacttgttttcatccccgtcctggccagtgactctttaaccaggcaatgtgatttacgtttagatgttagtttaatccctttgtttcttaatgaagctgcccttgttaaaatccctgggacctaatcatagaaattctctctagccccacgtctccgttcaacaactgcttagcaaatttctcatcagtcccatttttttttttaccagctcccctcaatagccatttcttgtctccaaggttttttgaagcccagaggcttttcttgtcaggcaattctcttatttcagccctgcagtgaactatccatatactgtatcacatcatgattttttttttctctgcaacctctcccttccccttgaaacaacttacctttatctgtgttccaaccccaatctgttgcgtctagaagtcagagagccaactgccaatcattctagaattcagcattttcaaagttcatctttgaaatggatagcctcttgttctgcagaaaagcaaggatcctagaaaaaacatgcaaactgcatttcaaggaggatggcatcatctttttgtttctcttggaatgactcaggagtgaggaaacaggaatacattactgtggttcccactcatcttggcctaccaatctctcccatctttctaggtacagcccatcttgtgatgggctgggacctgggcccctcctggacttacgttcaggatttcaaataacttggatggcagtctagccaaggaagccaaaagcttccatctcttccttgtcgtttgtgtgggttttttggtttgggttttttttttttttttagagacagagtctcactttatcatccaggctggagtgcagtggcacaatcacggctcactgccgccttgaactcctgggctcaagtgattctcccacctcagcctcctgagtagctagaattacaggtgcatgccaccaggaccagctatttatttatttattgtagaggtggggtcttgctatgttgcctaggctgattttgaactcctggtctgaagtgatccatcttggcctccaaagtactgggattacaggtgtgagccactgtgccccacagtatatctttttaaaatgaagactttcttatcagatttcagcaccaaggctcatacatatgttgactcaagaattaaagggctttagtttcatgtgctggcactaatcaatggctctggtttgagaacaattttgaaaccatactcgtctcattggaaaagagggcagtagtggtgcctaccagagatagggcatgaggaagcagtagtagcatccctgccatgcacctgccatccttgatttgataaagtccagaagcacatctgatcacaccatcttgcacaatggccttctcccaagcaacagtgacaacttagatggcctggaaaactatttcaaactaatagcaacatgtctaccaagagtgcattattaatgacacattcaactgaaaaattgatcacacgctcttaggtattacatgggtcacatttgcaataattttggtttttactgctgaaaggcaaatttaaggtaaaaatcaaatactttaaaagtatatatcttaatatgccttcctcttaacattcatctagtaaggggggagatgtagaattttgatataaattggccagccttatgttgatttatctttaacacagatttcaactccttcacttcagttgccatgaactgcaaggcccttgttcagtctggcttttcatctctttcctgcccaagtccaatttagctcttataaaacaaccagactactgcaatccctcatctcacggcaacctccaggacataatatataaaacttacccttgacatgtgggtgggtcaaataagtgatcaaagggcaagtcatgatctgaaagcatggtaatctcaagcaaccgctgatgtgaacattgcgtgtggcacagtgaaactcaaaggactcctgattttggcaataaaaacgattgtgtctataaactgagagaattatagaagtttgagcacagctgatcttagccttgaacatagttgaggaagagggaaggagaaatttaaaactttaattctgccaatttaacaaaaccgcttcacatcattatctaggatgagagtgatataaagaaatttaccagaactttttccattaatcaaaaagaaggtagtgaatgagatggaggatcaatcatgtcaaaaatttcagaaagggatgaggaaataatttctagcaaattatataataaaagtatgtttccactgaaaggagcattgaggaagaagaagagtatttcgtagaagtgaaacggcactgattaacctcattaaggacatgacttcctcatactttaataggaagtggtaaacttcagaatgagaccagcactatgttgaagtatgtcctagtccagcctctgttgtgagctagctgggaaagcatggccttatctgtttcagtatccttatttgtgaaatgaagagcttggcctgaaatcagcagctctcaaattttcgtgggcatcagaatcaccaaggatgtttgtaaatgtttttaaaagtcaattttcaagactccattaaatggagattttgatatatacaatcagagttaaatatgtgtatatataaaaaatatctttaagctagagtctcttatcagtgagactttgggctctacgtgcagagagactggtttacaaccagtcaaggggcagggtggggatagaattcagaactttagagataatctaacattctcagagactagaattctgcagtgttctggaacaataccccaaggtcaaaaagctttaactaaatgtttgtatgatcaataaattggtctgatttaaaattagcctataaagacattttttaaaagcaaatgcttaacttcaatactacatgacaagagggtgatatacaaaaaaaagttactatgtggttcttggcatcaagcagattaaagtctactttgaaataaagaccataataagtagttgaccccataaaaattaagcaataatgggaagaagttcagaggaacagaaaatcaattcatgctgagatgataatcaaattattggtaaaaatgaagatgctggttaggcatgtccttggctagagaagggctcaggcttgcaggtttaatgacctttagctgagaccaccccacgtgtccatctgcctcaggatactctaagtctcgtggctgaagcaaagtcttccttaaacagggcttccattgggccatgccagctattttgtttgtttgtttcctcaagacttaccaggccctatcttctgattccacctttgatcttaggtaggttaattcagttaatatattactaataactgtctacactctttctgccctcgatatctgtttccttctgctaacattttatgactattctttgtgggttaatttcacattttatctcccaaaggcagcccaagttccctcctttccagatgtcttgggctctcccaccgtagagcattggtgctgcctatactgttgttcttgatttcagagaacgttctacatcatacagatgcttacgcttattaaactactgatttaagttgttgcaggttttgagttaccactggcttttgactcagttgaaaaaaaacaaagaatggtccagggtgagagaggtgtgtaaattgactccgtgaggactctaggaactgatctttgacttcctcgccagcctctttgccaagcccaaattcatcatcattgtgaagtagcattgggccatgtttaagaagttttctataagaatttattttggattaatagcaaataattgcagctgagtcagcattaaagacatgttatatcagactgtgtctgctagttcagaggatgctgcttctcggatgggacttagctgaacacgtgttacacctctggggaagtgtctacagcattgtaccaaaaaacacagaaaacaggccactgaaacaaacaccagcagacatagcattggcaggatctaacaagcaggttttcctgaaacgtcattttgacagggttatagtcaggtggaatctcttaactgcagtggtcacctggtgcttcgttctttggtgcacagagagggggctgcagaggattaacatggaagaagcaagcactccccctccgttgttacccctccctgcaagatcctgaagccctgattctttccccatcattatatcccttttcaggaacggaaatgtcttctgcagagccagcccattccctctggtgctggtctcaggggaagtacagcatctggctcccaccctccatctaattacccatctgtttgtggggagggaagggatgttctattccccttctcttcccaaacattttaatgtgctgatgcatgaagacgacagcagctgcacctcagaacccatcctttgtgcatcacactcactggcttagcttttctgttcagttcttggatgggcctctttatagctagagacccacgtctctaactcctcctcatcctgacttagtacaaccctggcccttgcattagactgctccagattccatgttgctctctgattcagcatcatcaagcctcagcggggtgcctgagaccccctacctttagggaggggcagggatttccctgctctgctcttggcctagggcttctatcagctccagcaaagagaccatggagagcgtagcctttcatcgtaatctcccaacctttactcagctaatggcccctttggttatttctctctcactctggaagccatgtttagaaagagctgatatactgaacaaattgcacttaataaatattcacttattttccctctttttaaaaattaatcaagttctttgtaaggaagaaaaacgtattagtctttgacaaatgaaactaccaatctccattgatacctacgttgatagtattcaagccccaaacaaacacttcttagctggctcagatgatctggttaaggggaactttgtcagtttagttcagctttgtgaaatactgaaggatttcagaccactattaatacctgagtaaagtggttaagagaataactttggacatagagacagatgggtttcatttggccacatactagctacatgacctcgggcaagtttctgaacttgatgcggctccatttcttcatgggtaaaattggggtaattatactattgatcctgtaggattatcctgaagatagaatgcataatgtttacaaagcacttggtacaaagaggcataaagcaagaagtgagtaaatgttaactgctgctatctttattcccgtcattttaatcatcactatcaattatcatcacaacccaagtggctcagggatggagagaccccaactaggaccctctctccattctaggggaaacatttattcaactcaactgtggccagaactcatagtgaatctcgctatagtcatcctccgttttgcaacagcagattttgctgggctcgtggtcactcagctaaagactactttctccagccaccttgcatctaggtatgaccatggaactgggtgatggccactaagacatgagtgagcgtgatgttagcacattaatccatgcctttgaaaggcaagaagtctattttcccttcctgtttttcccttcttcagctgaaacgcaaacgtggtggtgaatcatcttgaattaagctgaaaagggtaacatggaagagatggcatggcaacaggatgcatccccaataccatcaagccaccattccaattctggactgccaacctagactcttaaataagggagaaaaaaagtcctttttgctttaaactactgaatctgatatcacctattataacaccatggtgtatcgtaaaaacacaccaaacaactattttcaaaatagatgtgatacttctccccagttatacaacttctggaagcaggaagccactgcattcccccacccagcttgtcatggtttacttctgattggatataactagatgataacagggatcacgctgcatccattgaggagaaagatgattcaaccctctcgcgggctgctggggaatcgatatcgtttaattatgagaaagtaaactgtgtttacattttacacagtggcaagaggaaggtcaaatcacaatcctcataccctttatcaaaaccatgcatcgctgtttgtcaagtgagattcaaaatgggatgaacttggagagttgccatcttcctgttttctcccttgtttgttcatatggctgtgctttacaagattaaaaggcttaccgggcaaaagcatagcagaaggaagtaaaaccttcgggcagatgaaataattcttccattttaggaaaaaaaggcaattagttatttgaggttttctgggtggggcagtgagtagaaggtcattatgttcctttcctgttgtatatcgaaaatcagttgagaagtaatgaaaatggtaagaaaaagaaaaaaaaagagtaaaccctcttcctctcccagtggcctctaccccatgactcatcagcttcctgaactggaacaacactgagctttatgactacagaaatgtcagctctgagcacagtgcatacttctttgtgtgaagatcttaggcggttgtgcaaaagccagcccaggacccagcatggtcctgctttatctctctgccgggctagtctccatgttcattagaaatgtgtgatttcttgacaagcactctttggatttgctgcagagtcaggtgatacattgaaatcagcaaaaacattaatgatagcaacaacaaaaacgaccttgtttaagttttacgccttataagggggcaatgttagccttgtaataaaaatgaggtaactgcaacttggaaatattaggaaatttatttaggatatcttagaaaatcataatgagagtgatgatgatgatgatggtagtgatgatgattatggtaatgataactatagtgatggtgatgacgatggtgatggtgggggtaatggtgatggtgatggtggtgatgatgatagtgatggtgatggtggtgatagtaatgattacggtggtggtgatgatgattctagtgatggtgatgctgatggcggtgatggtgatgttgattattatggtaatgataattacgatggtgttgttgatgatggtggtggtggtggtaatgatgatggtgatggtggtgatgatgatgatagtgatggtgatggtgatgatggtgatggtggtgatgatgatgatgatgatagtgatggtgatggtggtgatggtaatgacggtggtgatgatggtgatggtagtggtggtgatgctgatggtggtgatggtggtgatgatggtgatgatggtgatgatagtgatggtgatgatggtggtgatgttgatggtagtgatgatgataatgatggtaatgggtggtaaagatgataatgccttactctaggctagatattgtgctaaatatttcactgacaagcaaatgtgtaaactcacagtgctcagtattgtgattgaccctaatacgttttcactaattgttggcttcagggctaggactagagtgaggtgaatgaggtactctctttgggtccaaatttaaagggatacgaaaaatctcagtaattaaagtaaataatatttaatgcaatattttataaaaataaaaattagtgcaaaaatccatggtaaacaaaatgtcaacattttaaataaaggttctgtacatgcacaatatattctatttaccttcccctaatcccacccagttgtctcagctaatggcaatcttattttatacttgatgaaacaagcctgagcccaggttgttcttatccctgttctataggtgaaaatactgggcacaagagatttttccacaatcacatagctaatatatggaaaagctgggatttgagctcagctatatctaacatagaagttcagcagtctatctggcttctaaggtaagtttctgtcacaacattaaatattcagtatcattttctgggctatttttaaatggtagggagtcaaagagattaactaccagttgcagctcttatcaggccaacaatatcagctaaggtgaatctgatactagtagaactctaagaatgtgcatttattaagtcactcatataaataatatatttaacctacttagaaactctgtatagaagatatcagtgttgtatttcataaatagagaaagagaatctcagagttgagcactcacagtcatggtcaattcatggcagagttggtgaccagctcaaattttctaggttgacataatcctgtcctttctatggcttcaaagccatccacgtttgtctcttgatcctggaactttttatatttcgtcatacagaccttcctaagatcctcactttgcttgtatcattttccctagaataactattttctaaaacgcattaatgcattgattttaataacatcttgtgtcttatgtaattttaaaaatcagcatatattgactgaagacattttgacaaaagagaaagaaagaacatagcaaaaaagcatttccaactttcataaataagcaagagtatcactttcgtgaagttcttttctattttgttttgtcctgtttttttatagtgacatgtaactttttctttttctggacagcctgtcctcttggtgataataaagcatgatgataaaacaaatgagatctcactactagacttttctgtccaggaaatactcttgacttcatctgtcctcacctctgcttggaccttgtttcatccaatacctcatgccactctcagctttccaatttagatccttctcttgggtcattctcctctgctatgaattagcagacattgatcttgtcctctgacaagtagttatcagcagttattcataaatggatttagtatgttccatatccttagaataacatatacatataagcaaaaattaaatataatcttaggggtttcacaggctcccctaaatctcattcatgtacgccttaagcctgacttaagaaacgctgccatgtaatttccccttgatcctttttttttttttttttgcagatactgccccttctcatttttaactttcaccaacacttttcttgttaaagaagctttcattctctgccgctgtaattttccttacgcacatgaatatttatcttaatcaagtttctcctcccaagaacatcccttcagacaccaaaacgcgtattcttccacgttccatcagcagaaactttccttcatttgatacttgaagtccatcgctctggtgaaagcatccctcttcttgtttttcattatgttacattctttggacttgtcctcttatctatgtaccttgtaacttccatttagccctcttttctctttcaacttccttattgtagatactccttaatgttactagcatttaagttgtttttttcccccctcctttgtcagtcccaaagctcctatggctcaactgttggtgcacataaccttagggaggtgatttgaagaaattttaccgaaatgttgtatgacaaactcccaataacaggatttaagagaataccacttgttcttaccccttcagttctcttaacagggaagaaatatcataaccacataacacatgtttatatatatagatatgcccttacatcaaaataaattcttgatgataccaagatacgtgttcaaggcaaccataaaacactggaaaaaaatcaatcagaggtgaattttttcttatcttatggtcaggcagagtttaagcatgacaccaaaagttaaaataagctgaaaattgatatcattggctacataaaattttaatgcttctgtacaataaaaactgtataagtattaaacaaatgacatgtttaaaaacacagtttgcactatatattccgaagggcaaggacccctctccagcagctgtcgtccagcacatatttaacgtttccatatatctctgtcctcatcaataagatgaggctaatgacgctgcctctgcggtccttctaagaagcagatgggataaaagagtgtgcaccagtagctctaaacccgggacaatttcaccccctgagggcatttggcagtgtctaatgacatttttggtggtcatgctgggggatgctgctggcatcttgtgggtagaattcagagatgctgttaaacatcttgcaatgcttaagacatccatgcagaacaacaacaacaaaaaaatatcctgcccaaaatgtcaatagtgctgtggctgaaaaaccctggtctatacagggtggaggatgttgcggagcgtttggtacctggtaagtgctcagtaaatgtcagtcatttttacatcttattgggcaattctatgtaaatgccttgtccctaggaatatccacaggtttagcttatttttttttttttttttttttttttttttttttttttttttgagacagagtttttcctcttgttgcccagactgtagtgcaaagctgcgatctcggctcgctgcaacctccacctcccaggttcaagcaattgtcttgcctcagcctcgcgagtagctgggattacaggcgcccgccaccacgcccagctaattttttgtatttgtcgtagagacacggtttcaccatgttggccaggttggtctcactactgacctcaggtgatccactcaccttgggctcccaaagtgctaggattacaggtgtgagccacctcacccgaccccaaggttgtctcttttttcttttctcttttttttttttttttgttttgttttgttttttgagagggagtctcgttctgttgcccaggctagagtgcagtggcgcaactgcaagctccgcctcctgggttcacgccattctcctgcctcagcttcccaggtagctgggattacaggtacccgccaccatgcccggctaattttttgtatttttagtagagacagggtttcaccgtgttagccaagatgatctcaatctcctgcccgcatgatccgcccgcctcggcctcccaaggttctgggattaccggcgtgagccaccgcgcctggccatttatctgttaaggacagaacatgacttgagggacagcttactcattctatgcctatttgcttttctctctttcctcagcgcttttcactctcagctaccccttccaaacctcagctgattttactaccattcagatgtatcacttgtctcctgaaaaacacatagagcttcctttgtgaattcttactgctctacttacctgcttttaatctgtttatgtgagaatgttgtcaagatcttctagtagatcgtaagtcccttgaagaaaaagatgactttatatttattccaaaaaacccctgtggtgaccacacagcatagaaatctgcacagagcaggcaagtaacttacgtttgcttcgcaattccatcttcttaagtcgttcttgcaattgagaatgcatttctagccttctattggagctgcttagcacaagtagtgttgcattggtgtgaattcctccaacccatttaaatgagtttattgtgcattcaagtgagggttattcagcatgttcaagcaaatagtgaccaataatgataatggatattttttcatctcttcctgctccaatgggccagtattcaaaatgccattgctcacatgaaaacagagctgccagaccgtgtccagggcctcagccagggagctgccactttcattttaatttaagaaaaagagaaattgactgggaggtatttatgtaaatcagtagagttctaaggagttatctggcagccatgttaatggatgtgccactctgagaagcgaatctcgcattttgcttctcttgtcagaaggggttctgtgtgaccatttacacctacggatgattggctgtgacccagaggacatttgatgtaaaggatattttgtgcatgtcaatgagtcctgtccaggtggtgggatacaggctcgagacacatgttggagaagatcacttttgactgctggggagctatgggaagcccttccaaatgggcagaatgtgcaattactatctcagtaaatttgtctcaggagagctgtacacctcaggaacatcatatcatagaaaagggaagacaaaaaaggagctcaccttaaaagttccaaccacattccagggactgtttgtatttgactcattcatttattcaacaaatgtgaactgagcacttcaacgtgccatactgtcttctaggcactgaagatacaacagtggatatgatgggttgaatgtcggccccaaaaagatatgtccacatcctaatccctagaacctgtgattgtgaccttctttggaaaaagggtctttgaagatgtagttaagaatctgataatgagaggagcctggattatctgggtgagccctaaatccattgacatgtgtgcttttaagagacacacagaggaacaacactgcaggaggaggagaaggccatatgaatacggaggcaactcttggagtgatgtggcctcaagccaagaaacacctggagccacaggaagctgaaaaaggcaaggggtggaatctcctctagaacctatggaggaagtgtggtcccatcaacatcttgattttgcagcttccagaactgctagagaaaaatttctgttgttttaagccacaaagcttatagtttgttatagcagccacaggaaattaatacaataggctaaacagacaaaaatccctgccattgtgatgtgttcattctcgcttggtgcagacaggcaataaacaaataaaatgtattcaatgttgggttgtgatcaatgtaacacagtaacgaagcagaataagcggggaagaggtttgcttgtgagtggcatgatcatcaggaaagatgctactgagaaggggcgttcagagactgggaggaggtgagggaatgtgccgtgtaggtatgtggaggaaaagctgtctagacagaagggaatgaaactgcaaaggccgtgacactggagtgtgcctagtgtattggaggagatataaggcagcaaaggctgacaagaccagattatttagggcttttacttcaatttacccattgacttaacacttatctattgagcatgtaccaaatatattgttttacgacattcttgcaaaagcctggagaggtaggtaacaaaattcccactttaaagaggaaaacactgaatactggtccagcatgactcagctcatatgtggtggtactagaataggaatcttaatttgatgccaaccccagtgtcctttccccaacactggaatgacttatgtaaatatttatctcatttgtaatttgtctgtgtgttcagtcccatatgacagtcttgataagcccagctggcctctgaggccaatgcaaatatattttgagctgagaattgctcttgggcggtgagaggactgtagtttggaaaaggtcaagggctgtggattgccatctctcatggtgtcttcagaatgtttcagtagctttgtgactccaggtagcattgcattgataatttatctatttaactggcttaagtgggtttttttttttaattttctatctcaaaaatccaggctcataaatagggacagtatggaaaatgctgtatagggagaataaataaatgtataatcaggttagtaacatattatcattgatgcagctactgagcaaggaaaagcaaacaaagaaggagctttatttcatacccaagcaagtatagctcaattgcaaacctctcagacttgaatatatcacattggtcagtgcatatcatgtcctggaatgttacagaaagcagtaatggagagacaggtggatgaactaaaacttaacttacctctctcttcacatagcattagagcacagagaagattactacgacccttgggcatctgtgactactccattcaaaggttccttagaatgtttgctggaagcagttacagaaatgtgaacagggcttaaccagtgtactccataccctaaataattctgtataaataagagcttacatatctatgatgcctctctgtcacttcttttatattctcctttagtttgttttggggaaaattctaagtggatttgctccatgtaaatactgtacttccttatcgtattaacaaaggaagaggtaggagaatcaagacaatcgaatgtgtcagactaaagtagataataaatgctctttgggaaaaaaatattctcagtcaatgacagggaattctgatttgataaggaaattttcttgggttaatgaatgcaactgtagaatactgagtccgaccagcagaaacctacagccccaggccagctgaatcccattccttataccgtgagtatctgtgttcccttgcagcgggttttgtaggagtcagggataaagatagggaagcaggaggaaagggtcatagaatgctgccaaaggctctggaggctcaaaaggaagaactttgaattcacaaaacactatgccagctcagacctgggcatccaaatcagttaggatattggctaacagctgtaataaagaatgctacaaaaacagaagcttaaaccaaatagaattatacttcttcctcataaaccactccagggcagcaaggtaactcttcttttgaatgtcatgcaaggacccctgttttgttttgttttgttttgtttttttcccaagactgagtctcattctgtcacccaggctggagtgtattggtgtgctcactgcaacgtgtgcctcccaggttcaagcgattctcgtgcctcagcttcccaagcagctaggactacaggtgcccgccaccacacccagcaaattttttgtctctttagtagagtttgtctgtgttagtcaggctggcctcaaactcctgacctcaagtgatccgcccacctcagcctcccaaagggctgggattacaggagtgagctactgtgccacccagccaaggactcatgttttgaaaaggctgtggattatcatctcacattatgtctccagcaagttacagcagctttgtgattccaagtagcatggatggagatggcacttgtcatccccagggtggtatcctcattcctacctcctgcaccatagccaggctgtaggaaacagactgggaggaacaggagaagagcatcttccttttaaaggacattgactagaagtttctcctaatgctccctttcattccctgttgagcagagctgagtcacatggctatggcccgctgcaatggaggctgggaagtgtagtttctaactaagtagccaggtacctgaataaaacccagagggtaggagatgagattctattattacaagaagacacaatttctgccagggctttaaccggtggctctacccttcacagctggacattgctggatttttggatgattatttcattgtctccactcaaagattaagtttggaaaatagggaatttttctaccaaagcataggaactccaggccccagcccctcctcactctttctccctgttcattctcatctctttccagttccttacctcctgtaacctgtgggcatactaaagtaccaaggtaggcttagctgcaggcacggtacttccatgattcagtgccccgcccccaccactgagctaggccactcccaccaacaacctcaggccttcagatgcccaatttctgtgtagagctttgagcagtgttttccagttgtgaagggcaaaggaaattctccaattatttgtgtgttcatcttctctacctcccaggtaaaaaggagttgtctcaccattatagcttgtttcagaaacagtgtcaaattctcatcacagctcatgcatgccttctcaccagaagtaccctaattggttctctgactccaacaagagagctaggctttttgtttcttttgctttgttttgttttgatttgctcctttaaaaatgtttatggtgagctcagttatttaaaacaattcctggcagaggatttaagaggcctggcagaaattatgtaagcttgtacagtcatcttcactgataatgagtaaatcagatagcagacattaaaagattaagcactggtgtttggttttttggttggttggttttgttcacttgtttttaatgttgcaaaagtccttcatatgtcattgacaatagaatttaagtatttttgaaatgtactcagttcagattcaccattacatttcatgtccttaaggttggtagcttaagatagcttgtgcttcagttgcacaatactggcgtcagctctcctttaactcaaagctttctggtaattttcatctactggcagctcagtgggggcattttcaagtctcaatcacatcactttaatacataaacaaaaaagacccaacacaatagcaaatgaccatgagcttagtgccatcttgagtgtatgcttttagaccccagtgatgatacaacctttccttaatacagagaggaaaacaattttgatccgagaggctttctcccaggtgcatctgaaaaaacgttcagatatgtctcctgaatggttttgactaacacaacttactttcccccagaatagctcctctctaaaaaatgccaaagcttgcctttcagggacaaatcaaaggctaagcctgaggatgatggggtgacttgaaaaagactagccaagcgcttgactgctcagtgcagcctcgataacaccattcttggtggtgccatttgctccttgtccacagcccatatcccaatgagggttattcacttttgtaaccactggtttccctctgatagtgtctaaagaagcaaataatgatgaagtgagctgtacctccaacagagtttgaagctagccaggagcccttactgatgtttaaaaactggttcttttcaaaattgtggcaactttattttcagaaacaggtttcatcccaataagttatttggatgttttagaatagaataacgccatttgttgaaattcactgaagtaaggaacaatgtaatttgccactaaaattttgcacatttcatttttcttcaaaacacccagttttgattttttttgtttgtttgtttgtttgtttgtttgttttttttgagacagagtttcactcttattgcccaggctggagtgcaatggcatgatctcggctcatcacaacctctgcctcccgggctcaggcgattttcctgcctcaacttcccaagtagctgggattacaggcatgcaccacgcccagctaattttttgtatttgtggtagagacggggtttctccatgttggtcaggctggtcttgaactctcgacctaaggtgatctgcccacctcggcctcccagagtgctgggattacaggcatgagccaccgcgcccagcatgatgacttaaattctaatcatagtgatgttatgttcattgacacattactctgtgctaggcaccgtgacaggtgatctatgaatgctgtctcatgtagtcttcactataatccatgaattatatatattaacatgaaacccatttcacacgtgaggaaactatggttcaaaatggcagttagcttctccaaggttatataactcttcaggttttatccagaatcaaatctgagctctgattccagagttcttgctctgaactctattgctttcatgataaatttccctaagggctaaaaaatacctcgtaagaaaaatgtcttaaggccgggctcagtggctcatgcctgtaaccccagcactttgggaggctggggcaggtggattgcttgagtccaggagtttgagaccagcctaggcagcatggcaaaaccctgtatctactaaaaatattagctgggcagggtggcttgtgcctgtagtcccagtaacttgggaggctgagatgggaggatcacttgaacccaggaggcgggggtggcagtgagctaagatcacaccactgcactctagtctgggcaacagagcaagacgactctgtcaaaaaaaaaaaaagagagaaaagaaaaatgccttaaaattattatgcatgcaactttttctttctttcttttatccatagctatacttggccaaacaacattaagtcaggttatatttgtccttttcctcaattgttcctacctacctaccgacttacttggctattttcattcatcattaagtgattgatggatcatagttgctaagagaagacacggaaatgaaggaaatcaacccattccttcattgattcattatgtttagagagctaccatgtatgaggtattttccaggactttatgataccttaagcttacattctcgtgaaagaggcagacaataaatagtataaataacaaaaacatactatgggatacgttttaataataagaagtgctaaggagaaaaaaaatagcagagaaatgtcagggtaaacatgtattgaaatgttagatgggctgtccaggaaggggcagataacaaaggtgacctttgagtagatgccagaaggaagttaggaagttatgcaggggagccttggaaatgtgggggaattgcactgtaggcagaaagtacagcagatgcaaaggccctgaggcggagaatgcctgggggattgaggaagaactaggagaccagtggggccgagtgactgagtgagggtgagagtagcacaaaatgcgtacaacaaagtatgttatggagaaggctgtaggttagaacaggaactttaactcctaattaggtggttttcagtagacgagtgacacaaacataatgttatacttggacctttgctgtgttgagaccactgggtgtgggagatgggtggatgagggattgggaaatcagtgaggagcttaccaccgtaacccaggcagaagatcatggtggcctgtgccagaacgaggccttcctctctttctccctccttcctttcatcttcacagattattctatattagtccattctgacactgctaataaagacatgcccaagactgagtaatttatggaagaaagaggtttcattgactcacagttcagcatggctggggaggtctcaggaaaggtagaattatggtggaaggggaagcaaacacgtccatcttcacttggtggcaggaggaagaatgagagctgagtgaagcgggaagccccttataaaaccatcagatctcgtgagaactcactatcatgacaacagcatgggggaaactactgccattattcaattccacccccaccgggtcctttctaccccatgtggggattatggaaagtataattcaagatgaaatatgggtgaagacacagccaaaccagatcatagtccatgtctacttcattcaagagaatgaatgactgaatgacacttaattgggtcttttgatattagcatccagtattttgtcatcttctgagaggggctacttctggagacagtgacacagaaaaccagtgctcttgatttaagcagagtggatcagtaagaggtgtctctttcatttgtttagattatgatatttattcaaagagaggagcagtgaactgtggttgagtttgttattttaatgaaattacacttgcaactattgtaggtgtctttctatgtaatggatgctttacattctctcactttttttcctccagacaattctagacagcaggcatcatgattcccattttatagatcatcaaattgaggatcagagataccctgcaaagtctcatatggctgagtagcagtactctttacatctgaacccaggaccactctgactccaaagccaatattctctctgcatatttaatagctgttctttttaaaaaattgtatctattagtgcatatttgatggtggataatgtatatttaataaacccactgagtcatgtagctgtacaagcatttaggagattatgccatctaggaaattaaatattatcaagtgttgtcacacttgagcatgaacaaatacagactgctgggctctatccccaaagattctgattagaatggctcaggccgggtgcagtggctcacgcctgtaatctcagcactttgggaggccaaggcaggtggatcacctgaggtcgggagttcttgaccagcctggccaacatggtgaaaccctgtctctactaaaaatacaaaaaattagctgggcatggcggcacacgcctgtaatcccagctactcaggaggctgaggcaggagaatcacttcaacccaggaggtggaggttgcagtgagctgagatcacaccattgcactccaggctgggcaacaagagcaaaactctgtctcaaaaaaaaaaaaaaaaaaaaaaaaaaacaagaatggctcaggtaggggccaaaaatctgcatttctaacaagctcctaaggctgctcatgctgctgatcctggcacagcactttgagaatccttggtccacgccaatcccatcatttttgcaagaacaaattggaggtcagagaggttaacactattttcaatgatcagttaatacccctcccacctgcattaactgtaagagaaagcttgaatgacagagatgcacgactgtcagaaatggaaatgtagggtttttttggcccctttgcttgttttaattcaagagtataaaccataggtaatgttgtgctctcactttctcctgatttatctccttttgagcacttaatgaagaggaaccccactcattcacacacacacattttatttctcctgccctttttctttcctttccactttgaaatttctgttgcactttgtagttgtccagaatattttcagaaatacctccttgtgggtgaatctgctgcaaacagggctgatgaagtccctaatggttgttacccagagccctactgaatcaaaagaaatacttattttttctaaaaaaggaatcagtggtgggtttgtgaacctatgattagaaacatcctgcggggacatctacttgttcatatttaatgtcatttactagtagtggagcttacgtgcagttggttgtagcaaacagctctttggttctccccattctttaaggcgaaacttaaatgtaatttcttagcattttgtggctgaagctcaaaccagatggctccttcttttctttccagagcacttagttcacacttctaatgcgtagaacatgcaacatcgtcgcctaattttaaatggcttactcactggccagagtcatgataaataaagatggtgtggaacgtttcttctgtttcatgctcatggaacacagcacaatctttggggctcagtttactgagtatgagacagcaggacaaagtagtaaggggtgtgagcttcgaagccaagcaggttgtttggagactaggtttttctacatctaccacacagcttcactgtaggctcagtttctccctctattaagtggagaaataatagtaatatcacacagagttgtaaaaagctcttaaaatgatgacgtcatgcttgcaaagtcttagcacactgttcagctcatggaaagggctgaataaatattaaatataaaccagacctcatgagcacattcaatccccagggaattagtctgaaagaaggtgagccctcaacttctacaagtagtgcaaatcgaaagcccttcctctcacatatggtaatccccaggggcttgtactgtcatgacccatgttgcttctgggtcctgtgcttgaaaggctgtctctttccccatctgagtcaaccgggcggtaaaacgtggctcctgtaccaggttgcacaagaaacatgcatacacacatatcactgagcaaggtgaatgccactgagggttcggggaccaggggacacctgtgtgatcttctaccacctttccggccctttcctttcttcccttcttcttctactcccagttaagctttcattttccaatgctcttcagcaatcgctattttactctcccaaacttctacagccaaacccagcaagtgttcagttcagcagaacaaagggtcttgctctttgctggatctacctttctttcttagaggggagttggggttgaacaactgtttcgttcattacagctattattaatattttcaaagttattattaatgaaagagtgagtaacgctgccttattctccttttatttctcacccactctttttgtgttcagatcactagattttaattttacgccctttccccagcccaggactaggtctgtgttacccaggaccatttgaaagttgaaagaggaactcattggtgatacactggcttaaaaaactttaggaattcagaaaactatccaagaataacttataaaattacagatgaaatatgtgttatagtttaaacacaatatttttctgagttctttggatttttaagtacttaaaatacacagtgactatctcttttcaattttccaaatatagcatctaaatttagagagatgttaaaacaatttgggggttgtttggtttctttcctttttttttttttttttttggcccctttgctcaaagaaatagtgctttgctttcttctaatgaagtaagccctggtccaaggaaaatataaaataaaatcgctattttcctaccacctttgggctatgtaattcccatttcattttccaagaggctaaattttcaaatggtttcacttacacagtgcagaaaaattagacatcttcgtcatttgggggaaaataatgacagactctctacaagaaaaaactatatatatatgacaaatcatattaaaagataacggatcactttaagtatgggaaacagaccttgaagacaaacagttttgcacccgaacttgatctaagcatgattcccagctaattgtttggttctaaattaaattattccttttgataccgaaattatagatacagttccatttggcacttcagggtatatttattttctctgtaagtgcttgtccatatatttaaagactacagataatggatttttaagtgtatttaaaaagttaagcctcttgagaatttattttaaatggaaaatatctcccagcagattgtaatttaaaaaattaaaggcaatacaatacacatgcatagagataacattcaggtgtttgtgaatcattttccccactctgctgattgtctttgtggttaatcatggaactgatggtgcagaatacactgtggatgagtttacttgcctgagcacttaggtggcttagagcagatctcttgcaaaatgcgagaaaaaatatgaccttggcctacagcagtgatcaacaaacttattttgaaaaggattagaaagtaaatatttaaggcttatgagcgagatattctgttgcaactatccaactctgctgttgcagttcaaaagcagccatatacatgtaggtgaatagtgtggctgtattccaataaaactttatttacaaaaacagtagtgggccggatttgacatgcaggttgtagattccagactcctggtttggaggcctgacttcacaactttgtgtcatcctataggagtatgagttcagctcctggattcagcatctcagttaggcccactctagtgagttagcagagcagccttctttacgcagctgccataaacaaaccaagcaagccatgaagcccacgcttcagtgtcataatcacatttcccttccacatgatctgtacacacctcaaaccccaatcctcacaagtgggattaagagcctcaggaagagctccaaataaatcctcttctcctgtccatctcaccacagaaaagcagatgaacagaaaatcagaaagtcagtaacttgtctattcctcagagttagatgtcagtgtgatacctgacatagagacaatctgacagatcacaaaagtctgattcatttataaaatatctggtgagtggctactgtttgtcaagctctgtgctagtgcgagagatacaagggttgctgggatggcccggtctctgcaagaatggaggttttattctagtgagagagacacaacatagggaggaatccaaaagacagaaggagggtttgccctgagtttcctgttggaaattgggactctggtaagcagctgtgtgataacagaaagaaacatcagcctcatctgtataagcacgtcttcattcaataaaacacatataacaggcctttgctaaacactcgaggtaaaatggcaaacaagacactttcttccctcaagaagttcacagtctgataaggaaaaaagcaaaaagaacaagtaatgacaagttgaactcctgaatattctgacagatcaggcaattcacacacacaaaaaaaggaaatagaattgccgatattataaaacaatctctaaccttcccattcattgaaaaattttcaaactaatactacactctcttccaaccatcagattggccaacaaaaataaacattgtattatcaaccgttagcgtgaggagacaactcttagagcccaaatcgataaaaaaaaaaaaaaaaaaaaaaaacttagcatctaactaaattttaactgacgtttcatttgaatcagcactttcagaatggctctgaactacttaaatatatgtataaaagccaggtataaaggtatttgtggccgaccatggtggcttatgcctgtaatctcagcactttgggaggccaagacggatagatcacttgaggtcaggagttgaagaccagcctggccaacatggtgaaaccctgtctctactaaaaataaaaaattagccgagtggtggcccatgcctgtaattctagctacttgggaggctgaggcaggagaattgcttgaacctgggaggcagaggttgcagtgagctgagattgcaccactgcactccagcttgggcaacagagggagactccatctaaaaaaaaaaaaaaatatatatatatatatatatatatatatatatgtatatatatatatttgtatatatatatgtatatatatttgtatatatatatttgtatatatatttgtatatatatatttgtatatatatatgtatatatatatgtttgtgtatatatatatgtatatttacatttactactacacagttggtaattaatgaaacggaaaacctcagtgttcagcaatagggaactgctttaatgagagcagatagatccatactaagagataatatgcagtcataaaaaagcaatctatataaactgatgtaaaaagtatttaatagctattaagagaaaacctacctactgaactgtttaagtgtatatatagcttgcaaatttggtagaataatttaataatcaaaatgtgtggctaatcggggaagtcagggcttgttgagatagtaacaggctgcatctcctatttcacttcagttgattccatttttaattatttttgtattttaaaatgactattaaataatatgagttaaaggatgtatacctatttaaagactatccactgagaaatctcacccttaattctaaagggcgctgcaattcagtgatcaatagaatgaccaaatctccaccctcaaagttccttggttattttgaaaaccgtactgctaaaaagagaaaaaaaaaagtgtcattcttttctgcctgatatcttcccagcatatgtaaagtagtattcctggtgatagtatctgaaaatcaacataatccaaaggtcctcactttgtaatgtttgcagtaagattccagcatcttagcatttaactgttttcagattacatccatttaaacatctgtgattcattatcgtaaatatcacagttgtggggaccatatgcttcagcttgcagcatatatgtgtgtgtgtgtgtgtatgtatatatatatatatatatatatatatatatatatatatatatataaagaaaaagcacgagcaataaatctcaggaaccttagacttgccgtgggtatgtgcaaaaagaacatttccaaacacatggggctgtctataatcacagtaatgtacttgagatcccatgtaagaattattcaattgcaaaagttgccacttgtgatggaaagctatgatttacatttggcttgtgcacttcccatgataattcaaatagggtggaaagcagcacaaaagccttctgctgcattggcttttacttcttaaggaaatatgtgagcgctattgttgtcgagtggagaaatcacagaaaaatgagatacctttaacaagtggcaaggcactcttggcaggcatccttcattcccatgagactggagctagagatgatgccatatggcctaagggatgtaataaaaatcacttggccactggaggatgaataggcatggcctacagggctgattattttcttgcttacaccagaaaacccacgtatgcacacaagaattaattgtgcttcatgtattgtaagccaaatcattgtcttttaatttcctgataaagtcttgtcaactagacagaaccaatctgtaatcacagctgatgagtatctcacacactgcaattagggaggaggtaaatgaattaattggttacaaccaaaaggagtctgctaatattttttgattgccaactctcttctagggctagcaccaagcctagccagagatatggagataaaactgtaggaagctcttgccctcaaggatcttccagattaccaaagggcaggttaggtcaggagaaaattttcaaggtgtggaagctggccttctgcagtctgctgcagtttgattggcatccctgctggttattatcaagccaccaaccttgtcaaagccttgtgcattccctttaggaaggagatccattgttgccttagatggtgttcttgagcccctaaacactaccctgccatctagaaacatttctggaccctgtcctggaatcaaggtagcacaaggccatctctgcttagaagcattctagatatccacaaggaaggaaggatggggtgtttaaaatgcttttggatctttttgtacaaaagatgctcatctacatactggctacacgtcatttatgacatttatgaaaaccaaaattgacattctgaagtccttggatcaaatttctgtgctgttcttttctcctccatggtgttttatttgatgcgatcttgggatgtgtgatgacttcgtagtggaatagcaggtgttgatccgtaggaacttcaaatctcaagagttatttgataaaagttatagacagatcaatgatagcaaatttcaaacttatgtttccccagtcattgaagaaagaacactagtaacagctcttgactacatttaggtgttcttgactatctttaatgggtgcataaggatttgcctgggccccattcattcattttccttgaccctcttcagagcttgagtgtttcctaagctttgacacacagggtcttctggcatctgctgtctggatttttgctgatggatttaattactgacttcaagattctactcaattccattttgacaccttttttagctcaagacacagactctttgactccctgttatgtcctgtgctgctaagctgtagaataacttcgaacatttactttggataccatcatttgaaggaatccactctctttcccaaggacctggaactggattctatattagttgtaaaaagcaatccagctttcctacttacagatgtgtgaccttaagaaatgttcttactctctgagcttcaggttttctcccctaccttcatgatactgttggagaattgaaagaaataatgtttatcaagtatttagtccacggactgacatatagaaaatgcttcataaatggtaggtattatatatgatagacatcaaacatgaaatactattagggctctgtactattagcactattagggttttgtagagtgacttgaatatatagggaaacaattcatgtaatccccaaggtgtgttcatatgaaccaacacgctttgatgccacagccatttataccagctggaagagtgcagaactaacataaatgatgtcctgctagcatctgcagctgggtcataaaccaaagcttaatgttttacaaagttttgatatgcagtagtcaatttatccatttttgtgaatcaagtaggttgggaaacaagcccagcaaaacacagtttggtaaattttatgtgaaaaaactctcttctttttcactcagtaatttttgcattttaaaaaaatacagtaatcaaaagaaatatgatgggccagtgaaaagcctggcctttggagtgtggtgaacctgagttcaaaccccagttctacaagtaaacctttgcactatgggtggctcagtctctcccagcttatctcattttgcctctgtaaaatggttgaaatatcggattatggggattggagtgaaatggaacactgacccttcaacatgacagccctgccaataattatggggtctaagcttctagacgctaagtatcatgaaaatagatgctattccacattcacctttagttgccgtttatcccttactgcctactgtcttgtacattgtaagtgaaaaaatgatgtttttaatgggttaatggatgagtatgttgaactttagaataacagaatttcccagttgtaagagacatcattcaatgctggaattgcttccacaatattcctgatgaagtcatataggttccacttgaaagtacccagtgacaagcacattatttcacccagaaggaactagatcttccaaatggtaacctgaattgctttaggcccctccagtatggtcatgcattgtttaaccatagggatatgctctgagaatgcaccactgggtaatttaatcattgttggaacatcacagagtagacttacacaaacctagagggtatagcctattacacacctaggtgatctcttacaacctatggctcctcggctactaacatatatagcacggtgctgtactgagtgctataggcaattgtaacacaatggcaagtggttgtgtatctaaacatatctaaacacagaaaaggtataataaaaatatagtctaaaaggtaaaattggcacacctgtatagggcacttactacgaatagaggtggtaggattggaagatgctctgggtgagtcagtgagtgagtggtgagtgaatgtgaaggcctaggacattactgtgcaggactatagactttataaacactgtacacttaggctatactaagtttataagaaaaagctttctttcttcaatcataaattaactttagcttactgtaacttttttactttataaactttaattttttaactttttggctcttgtggtaacacttagcttacaacacaaacacattgtacagctatagaaaatattttctttatatccttattttatagacctttctatttttaaatgttttctctttttctttttcacttgttgaacttctttgttaaaagctgagacatgaacacatacatttgcctaggcctacacaaggtcagaatcatgaatatcactgtattctgcctccacattttgtctcactgaaaggtctttaggggttataacacgcatggagccatctcctatgatatcaatgccttcttctggatacctcctgaaggacttgcctgaggctgttttacagttaacattttcttttttttttttttttttgagacagggtctcgctctgtcacccaggctagagtaccgtggcccgatctcagctcactacagcctctgcctcctgggttcaagtgatcctcctgcccaagcatcccggttagttgggaccacaggcaccagccaccccacccagctaatttttgcatgttttgtagatatggagtcttgccatgttgcccagtatggtctcaaactcctgggctcaagcgatctgcctacctgggcctcccaaagtgctgggattacaagcgtgagccaccatgcccggccagtaaaccttttcttaatgggtagaaggaggagtacactctaaaaaaaaaaaaaaaaaacaataaaaacgatagtatattaaatatataaaccagtagcatagttgtttattatcattaccaaatattacatatggcacataattttatgtgcttgacttttatgactgaaagtgctataggtttgtttacaccagcatcaccacaaacacatgagtaatgcattgcactctgacgttatgacagctacctcactaggcaataggactttttcagctccgttatcatcttacgggattgctatcatatatgtgttcctctgtagatcagaacatcgctatgtggcacatgaccgaatttggacaaatgtgacgtcatgcaaatatgaatatttgcattgttctggcttgtagccccacacctgcatagctgtaggacctcaatgtattctccttcctggccttttattctggttatttctggaagacctcagggcatctgtcacatgaattcacaaattcttcttccatgtcctctcattctggcctctttaattattaacattcctgggaaactcttggaggaagggcctccccactgccctctgtgggaaaagtccatctccaggatccccaaagccatgtacccctcaaggtgccaacagaccctatgactgctctagtgttctctctaccagaacaaagccaagctgtactccactcaaaaatggggccaccctgctgctcagcataacagtttgctattaggaaacaaaataacagtgcttgaaaatacctaagttgtctgtggtttgtgaatctttgagttgtgtatgtagctttcttttctctgaactatggatccatggggctggcctaggaaaccaatattgtgttcctctctctctttctcctggttctgcctccctctctaggtgctcatgcagaagtagtcctcctcagaggcccccttcctccccaggtatatctgctcttgcaatagagaggtaactgggaaatcacgagactgtcaaggcatcaaaacacaatcagggtctgaatcccaatttaggcttagccaggacactttgtcacatgtccctagacaaccccaactgcaaggccaaacaccctgaaagttgcagtggagtaaagctctcttcacattaatttacccttgagatgcacattcagaaggagacttttacacataattgctataaagtttaaaaactaagggccttgtcagagacgtgtgccagtcatgaaaataccaagaagggatctctgtaaatccgagatttggtgattctcaaacttgctgaatccatgatttttctttcgcttaatgggtgactttcaaatccacttactcaaatcttcacttgagttgatgccatcattctcagttgtgtttggggagtttcaaatctgcttagctgccaagttgcagttctgctatttattcattcaacaaacagggttgagtatgtactgtgtcaagcactgtgctatatataaagtaattccaatttgaaacacaaattcgtagtgattataaccaccatgggatagatgatgcatagcattctatcaggaaacaacctgccatgttttaaggaatccacggcaagaggagaacgtaagactgacacacatacaaaacaaagattcaaagctaacggctcagtttttaatggtaggtggagaaaatcccctgaaagcagatgtggcctctgtctttttccaagaggaagcccttaagggttacatggcaaaaataggtttctgctgaagattgttggactgtatcattcattatgatatcttctgctgacatgatagaattgaaactctattttatcaaagttggaactgaagcatggaatggaattaagactgttttatgtttgttctgcacttaccaaattctataaagcctttggaagtgaaattcactcctgggtcaaccagtcatggctagaatactcccagaaccttatagaagctctgcaatgtcagtgctgactctaggccaaacatggaacacggaagcccaatacgcatgttcaggaagcagaagagtagaaataatcaagtctgtagggtgtgcttcttgattcactcatggatctgacccaatgtgggtggaattgaacgtatgttaatgaaggcttgagtgactagaatgctggtgaaatgagagtattcaggaaagtcaaaagaaatgcttcctgtttcttccatttggaccagtctaaagagactctggactaagccctgtgagtgctttaaaaggaaggtggtgcctctggatgccagtggcatactgagggatatgaaaagcaattaagtgatggcctgtatcctggaaagagtctgtctgatatttctgaattaaatgctactttagttgtcagaaagacattgtcatgccccagcaaaggctttgcagattaaccaatatgcaggaccttcatgctgaggaagaattgaattctgtttttccaagtaggcaaggaataccaggatagctgggtctctccatctcaggcaaaacagacaatctacattcttatgctctggggcagttcctatctgtgtcatgtccttgagacagctagtataggtacttctgagagctggtaaaaattttagaaaagttgcaagccaactgaaggcacattggtaccttgaaataaacaacgtgtagagcatttaaaccacagaaatcggcagatgctacaactcgagactttttccaagactagcacatcactgcaagtccttctcttctgtgtgtgcgtatgaagatcctggaggtggatctgtgcatatctgtctgggggagggctacaacttccagggtgactgattcagagcctgtaattctgattcatatgcatccttgcacacatgtacaagtggaatctgaccatccactctgaaagggccccacaacttatgtgcagacacatttgcaaagcctctacaaatacatgcaaactctaggacaatttacccatataagatgtgagtgtataaatcacagattggcccaagcacgcttataagaatagcacaaaattcatatattagttcatacctagctctgcaagcaggactgttctatatttggcagataagtttaaatccatctgcatttcattttttctgggatcataacagagcttaattttctcccttatccatttttagatggtaggaaatctatgccttttggattttcatccccaagaaccaccttcaaaagaaagaaatggaaaagcataaaatcaaggtcgggaagattaagccccttaattcacatgtcaaacttgccatttcaattgtggttttgtctcccagctgaagtttgtctttttgtgacatttgcattaagcccaggggacattttgagtggaaaagcgctgaaagcataattgaaactctgagtgttgccttttgtctaatttgcaatttcccccaggtggggtgttttcactaccccccgactccaccccgccctcccagggtgttctaagattatctcaaagaatgatgttatgcaatttattccaataaatctccatgtacagtatcttatatgtgtatattttttgccttccagaagttatttcaaatccgtgagaaactatgtagggaagtcattcataggttcagaagagtacagatagttcatttcccctttcagatagaggttttgagtatttgttcacaagtttaattgtttagtcacatctttcagttatccacatggtgtcattctgagccacccaggaagttgtctctatagaaacaagcattttttaaatggacataaactgttcagttttgtccttaaatatgtctttgaactctgtgctcaattcacatatggtcttgatatctacttaaaagtttgagaatcactgacactttggtggcatcaacaaagtcaataacatgaaacacaatgcagggctgatgtcatcacatgcaccctttaataggaaatttaggatatgattataattggtgagaatgtagagtctgttttctccaggagaaagaagaaaacgtaaaagaaaatgttgtggcttgtttttcttttgagtcaatgtcttcctgtttatcagagctgtcctttagatattgccaaagctatggcaacaggagcaatttagattttgccctttctagaatttctgtttttatcaagacttcattatttatattaaataaattatttcttatctgatatttggatatcatagccttcctggattatatacctgagtagagtggatgcaggcatgaatttgtctaactgagggttggatggcaaggaatgtagtaccagccagcatttccagagggtacaacaaacgtcactgtggaggttttagtggatacaaggacaaacttttttagtggatacaaggacacacttacttcttttgaatttggctctttagatttattttaatatttatttgaaaaaatacctggcatattcaacaggtattataaatactacattcaaataattttataatttaaagggtcagtcagttaaaaaatattaagtaaataatcgatgtggtatgagaggtggcaatgaaattgtgagtctggaagctgaatgactaaaggaaagaacacattcatctagaaagactggcatagccctcaggagtgtgggctctagaaccagaaaccacactcccgagtttggatttgacctcggttcatataatgacttcgtggcctcggataactcatgcaacctcactaagtctcagtttccacagaacaccaaaagttcctacctcaaattgatgatgtgaagaagacgacatgaagatttattgcaatcattagtgtaaagctcacagtgtaatgtaatgtcattactttaggaaaactcttgccttacatttgtacgaagttgtcttcaccaacaatccgtttggagaatatcgaacaaaactttgttgattctattttgagcagggctctgtaatttcactcctttaatatcgtttttccttcacaactgttcacatgaagtacgtagggcttcaccaaaacaagtgaagggattcaacaatgggcaagcctgaatcagaatcatcagccccacccctttaaccctagcagtgatgcctgtagtaaccatttccatggcaacagcctgagactagcaaggtacctgactagaaggaatgacagaggaggaggtagaaaaatcagctggaagaaggaagctgtgtaggaaaaggaaaaggtagcttccttagtgcccagaattatggcaataatggtgatcattctcattcatggagcaacaagctctgtcctaagtgctttctgtgtgtaggcatgcattatcttgtttacacatgccataaggattatagtacctttcaggaggatgcccactctatggataaagatgtcgaggattaaagaatataggtggtatattagtccattctcatgctactaataaagacatacctgggacagggtaatttataaagaaaagaggtgtaattgactcacagttcagcatggctggggaggcctcaggaaacttacaatcttggcagaagggaaagcaaacacatccttcttcacatggcagcagcaaggagaaatgcagagagaaggggaagaatgcccatcagatctcgccagaactcactgtcacaagaatagcatggaggtaaccactcctgtgattaaattacctcccatcggcttcctcccatgacacacgggagttataggaactacaattcaagatgagattttggtggggacacagccaaaccatatcaggtggtttgcccaacgtcacagggctcctacacacaagccaggattagaaaagggcttagaaacctacccttaaaacttccctttcttggggcacggaaataacagttgctggcatgccagtccccaacctctactcttttccaggaatggctgggaaatgtggagacctggcaccttgacaaagagtttataatgtaaggtcctggttcctggctctgtctgcattagattaatcagggggagcttttaagagatactagtgcacacagaccgcaactcagcacagttgtatcataatcttgggagagagtgggggcaggtattgctattctttttaatgctccttcagcatttcttagatggccagccttgagaaagaaccatggcctaaagcacctactcctgagttggtaagtggtatcaaaaatatacaaagacccaattatgcaactgttagctatttgatttagaaagtattgagtgccggtgatgtgccaggtcctgaaactgcagttgttctcagtgtgacctcacttggtacctctgatgatcccaaaggggtttgtgagatgcccaagggggccatgttggggcaactgtcctttctccacttgcccatctattcctaggaagcagatgtgcccagagcttgggctgtagaggcagaatgaacagatcagagaaggttctcgctctaggcctttctggatatgggaccacgagctagtcagtcaatctctctgagactcagtctcttctcctgtaaaatataatatgatgcttatatatttatagactgtgcattctcattggggctatatttcccccacaggggtgaaataggttcgagggtggggggacaaaaattgcacttacaaatgtaaagtatagatatacttgtagtacctaaacagatataagtatatctgtgatattaaaattttacaggaatagtggcaattagaaaaaaatacttaaaagagcccttaggggagtagataatgaaaaaaacaaaagttaagcaaccctgctatagaattgctatgaggctgaaaggaggtatggacttgtacagtcctttgcatagagcgtagcactcagggaccactcaataaatagtagtgccatgactgttgtctgtccaagcatcacttcattcaaaatgcacacactgattccaaccattctttggggctatgcaagttttactggcatctttgggacagataaggcaccacctctgacttcaccaatgagctaggtcagagctaagcagagcggctgagtgccattctaaatggatacacacggggtccaggggccaaggggagagcatagctgagttcttcatttccttgtactccctgctgctgggttcaatgaaatcaagaggtcactacgggcctcttatcccaattcacagccttgtcggcagcctcttgctcacagcacagaagggagaccccccccccccaccgccccgcctccaatcctctaccattactaaatcatcattttgctctggagagtaactgagcaaagtggaattattactgatggcctcccatgtggaaaaacatgctgttcattgctgaagatgtaaagatgaatgaaagaacaagactcaatttctgctcttggttctggtgcaaaaaacaaatacataatatggacagattgatataatataaaaggttctatgggaaggaaattctggaacacaaagagaatgcttgaagaagttgcttgagttgaatcttgaagagtaagcaagagttaacagggtgaagaaggtgagaaatgccttctgcagagagggagcactatacacaaagggtgggacagtagagtagggagatgcaagagtgggtgaggtgtgagctatgcagtgaagacaaaggcagaggggaggctgatggacagcctagtcatggaggaccttgagtgctaagtattgttttgcaatgaagatccataattatatgagactcaggtggagaaaagctggtcttatagttgcaacaggagaatccaaggcttcctccagggagcagagctgtgtggcccccagtaccccacattgcctgggcttagcttatctccattctaacttccttcaattctcccttgctgtctgtgccaatctaactgcttacatccagttcggtagatgccgcaggactttgcatatgttatggttttctctgcctaagtaataggtccccaattatttataagagtagtaaattgatgtctgtcttccacattagacttcaaactagggactgtgcctgtctttgttcaacattataacctcagcatctagcataatgtaggttctcagtaaatatttatggtaggaagaaagggtgggaagaagaaacttagctgggaatccagaacccccacaaactttcatatgccttttcctctaccccattcactccccagctgagactgtcttctgtgatcctgttcgagggttaagtctggaacctcatgctggcgattgaagcagtcatttcctgtgaggccttgtcatttgagtaatttgcctccagtggatgaatactaattgatgataacagtgaaagcaaccttggtgtcacttcttcatagttcacttccaaaaactgaaactaagcatgttcaattcatctgggctaccaacatggttagagaaagtgagcaagtgtctgagaaccgcagggtcctgagagtccacttgtgtgtccatgcaaagatggctctaaagctgacttaaccacggaaagccttagaacctttgcagagcgatcaaaaggcaccgcagcgtgcagtgctcttcaggactgggcaggaacatgaaaacaggactgagcagggcaatcacagctctctacagtagtccctgcttgtcctcaggggatgtgtcacaagacctacgtagatacctcagtccgtggatactacccaaccctatatatgctaatttgtcctatacatacatagctatgttaaagtttaatttacaaattgggcacagtaaaatattaacaacaataactaatgataaaatagaacaattataacaataatgaaaatggcacacaatttgaaacttatgaattgtttatttctggaatttcccatttaatattttcagacctgtgttgaccatgggtatctggaattgaagaaagccaagccatggagatgggggaactactgtattcaggttttgataggatttcagaagggttgtattctccatggggtattgtctttattgaaaatgtgcagtggtgacaggcaaatggtccagggttcaaatcctggctcatcatttacaacctgtgtgtactgggcaccaactttgcactccatgagcctcagtttccttatctagaaactgtaggagaaggggatcaaaatagtactttatttgttgtcattgtaaagattaactaaggtgatgtgtgcaaagtgtgtagcacctacccttgaatgtggaaagtgctcaatctgcattatccactattattatcagttaatatgattattatcaccctaagtatcatcttcccagagtagaaatatcagtttagattttcagatatttatatggctttcacagtgtgctaggacctatgtagatgagcttagattctcagatatttatttggctttaacagtgtgctaggatctatgtagctgttgttaccaaaagatgtacacaagaaagttcctagcaacaatatttggagccccaaagtggaaatagtccagataccagtcgagagtaggatagataaagagactcaatacagccacataatggaatactctatgatgattaagataaagataaatatagtaacctggatactatacagtgatcagtgattattgttatagtgattagaataaactaccacaactcacagccacatgatgaatctcgtggcatgtaatgtcgaatgaagaagccaaataggagagagtgcatactgtatgaccacattagatgccatgcaaatgcaggtaaaaccaatctgtggtattagaggctagaataatgtagcctctggggaagaggttaggaattttactcaggaagggaggggactggtaatgtgtcatgttatggcctggttgctggacagttggttgtgcttactttgtaaaaattcattgggttgtatgttctgatttatgtgcttatatgtgtctacattatgcttcaattaaaggtttactaaacaaataagcctgttcagcagagaccaaaaagcacgtagtacaattctatgcttacccacaaggggcctcaaagtttacaggaggaggcagacaggcaaatgcatgcacagataatgagttgtgatacccataataatagaattgtgtaccacatgcagaatcaccattgaggggagcatgatcagccgtcacagcctctgcttgtgtcaatgccctgtgctccatttgttcatgcagggggcccatcttccctattccttcccacacatgaataaggtattccatggcaggaactttgctcacatctgtccactctccatatcagcaccactgccttcattttgtacagccatctttgatgcaacactgaactcgttggaactgggtctcttggcctctcttcctgcccttctttaaatcacttgctataacccagatctgccaaattataatcattgtattgggtcctctggattcttaaaaagtaccctgtgggccgggtacagtggctcacgcctgtaatcccagttctttgggaggcctgaggtcgggagttcgagaccagtctggccaacatggtgaaacccccatctctactaaaaatacaaaaattagccaggcatgatggcatgcatctgtaatcccagctacccaggaggctgagacaggagaatcactggaacccgggaggcagaggctgcagtcagccaagatcgcgccactgcactccagtctggatgacagagcaagactctgttaaaaaaaaaaaaaaaaaaaaaaagcaccctgtgtgattctgatgcaccccaatccttgagaagcactcctcttcactggaagcagagcacacacctgatcttgactctctccacacaacaaatcgtccagggctaccagaaagcaccataacttactggcttttcccaacttgtttcccagagacattttcagcctcatttccacccttcccttctagatccccaccattctagattcccaccatccctgccccgttttaagtttgcctctattcacctaaaaacatatggactattccatatggactgagcatgaaagaaatatagttcctcaaagtaaattaaggagctgttttcagaggaaaggaaatggatggtggataggcaagaaaatgtggcccactagaattctatatggtgctgcatattgtgctgtatacatatatggtgcatgcgtatgtgtacatatgtgtacatgtatacattacatgcacatataccatatgtgtgtatatggtgctgtaggtatatacatgcgcatgtatacaccatatacatgcgcatgtatacaccatatacatgcgcatgtatacaccatatacatgcgcatgtatacaccatatacatgcgcatgtatacaccatatacatgcgcatgtatccatgcgcatgcataggcatgtatatatatgtatatgtatacacgtatatggtatatacatgtacatgtatatgtatacacgtatatgtatatacatatacatgtatatgtatacacgtatatggtatatacatgtacatgtatatgcatacacgtatatggtatatacatgtacatgtatatgcacatcgttaattctcattccctgaatctgttttgctatttagccctcatccctgtgcctttgaatagcctataatgtcttccacattcttaagggccttctcatctcctacttatcttcaatacccagctcaaatattgactctgtgcagctctcctcaatggtcctgagcaccctgtggttctgctcagtcacccacacatgccaggattagatcacttccctcaaatgtcactctgccagatctgactcttcactccactgagaaggcactcaagtgtgcacactcagagcttagcacctgcctggaacatgcgagttcgtcaaggacatgtcttgattgagtgaagtccatcagcacaaagtcacttgggcacaggcatcttgctgtgggataaaacgtaacatttgtgaactctgggttgggaaactatgtggtaattcacacttaataggtcagagatatctcagagataagctgcccaacctactcatgctccttctgttgtttcgtttgtttcccagtgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggtaacacatctgtttgagataacttgggttcaaggaggacattaggttctgtctgtcttatgtggaaaatgggtctttaatttattatgttggctaagattccttttgttattgttgttgcaaatgacagaaatccaactctaaaaatgtagatgaggggcagcgggaattaattgattcatgtaactaattgaggcatagttcgtggattaattcatggaactattttagggatacttctgccttcaggcgtggctgaagctgtccaaatcagctttaatccctgtgcatctcgtggctccattttccttttattagatgtattgagacagtcacatctctccctgcctcccaaggtggaggtctcagcaactaccctctttctgctggtctgaagtcgcctgagaaagcatctcttcaagacgatgctagcaaaaccttggaattcagtctcgtaggttagatcatgtgtccacccctgaactaaacatggtgtccattgggttgtgatgttctggttggccacgtctcggtcacatttcttttcctgaagccagggcagagtcagccctattcacctgaaaactcatggactgagagtgaaagaaatgtagttcctcaaagtaaattaaggagctgttttcagaggaaaggaaatggatggtggatagaccagaaaaggtgacccactagaattgtatatggtgctgcatattgtgctgtatacatatacggtgtatgtgtatgtgtacatatgtgtacatgtatatattacatgcacatataccacatgtatgtatatggtgctgtatgtgtatatgttgtacatgtatgtgtataccatatacaggcatatgtaccatatacttatgtgtatatgtacacatacatatggtatatgtgcatgtaatgtatacacatatgtatacatccacatttaatatatcaaagatatctcaaagctaacctgcccaacctactcatgctcctcctgttgttttgttttgtttcccattgaccttcagtgacttcagtatatctatgtgtgtatatgtatatatgtatatgtaattgtttacggttctgtatatatatacggtgtatatgtatgtctatatgtatacatttgcatttaacaggtcataggtatctcagagataagctgcccaacctactcatggtccttctgttgttttgttttgtttcccaatgacttttggtgacttcagtatatatatgtgtgtatatgtgtatacgtatgtacaggcatacacatactatatatgcgcatatactgtgtatatgtatgtgtgtatatacatacacatggtatatctgtattatatgtgtgtgtaattgcatatcgtgcttctcgtttgccaggcagcagtgcttgttcccttccacaggcacatgcatgcagatccctgcactcccacacatatgcatacactttataagtgtcacaaactgccattcaggcttcccgattgtgccattcggagactttttgctactactgactcctgccttcttcaccaggagctcagggactccaccttcgtgagaaaaggagggcaagacacacagcaggattccagccaaacaatgacttaatgatggcatgcccctgcttggcatgcctagccttctctcctacctgcgagcttggtcttcctcgatttttcacagcccctaattcacatcccttttctccacctgccatattagccacatccctgcttgatctactcattttgttcagtggtggagcgagtgtgggtcacacagctgggagcagagacagtacaactggcaatgtgagagttaccttcccgccagtgctgtctgtgtgatcttgagagcatcatatagcttctttatctgcagaatagcgaggttaaacagcctgcagtggcaaataagtggctcatgtgccaccctactgtcaccgtgctcgtggcagatattgctaataacccctggcttagcctgagtatccttctcactgcaatgcttctggaacctactatcaattgatcatttagtggtgtttctgagggtggaacctatctgccattcctgggctggatgaacttcacaattccccttcagcatctgtgaagctgtgagttaaggatagatggcaacctaaaaacgaatgtacggcacgtcagtcatgtttcagaggaaactggatattggtgaattcataccagtgtggaaatccattgacaccacaaaggcaagcttttctcttacttagccatgaccaatggtcacagcatctcactaatctgtgatataaattatgtggcaaatatctaaagcaacaaagttgccaggatatacagcaaaaacaatgttccatagaaacatggaaatggtatggtgagggggtttgcccatgggcttgaatgcatttagatggcgattgttcttcgtgaatggtggctcatctttctatctggaaaagatactgtcatcgtattttgcttcaaagagagcagaagatcttctgggcaggttctcgggaccaaccccaccttgagggcctgggagagctgggttcattatgaaaactcagccacgcattgtttgtacctcaagtttctgtgagatgccatccagagacaaagctcccctgagtcctggctgtttctcgcttgctgctgtctgtacgcattttcgacaaaacttgcctgtgattgtttttgcttcttataaagggggcggaggctgccgtgtccttcagtttgccagacttcagcagaatggggcattcatctcccacgtccagtaattttatgagatttgaaaaaaggctttgtgaagatgtgtagctgtgtccttcataaaaacgcctcaaaaaaggaaaaaaaaataaaaagaaaatgaaggaaaacaaaatagatagcaaaagaatccctctgaagagagcacatacctcaatggatatgcacgtggtatgtttgcaggtcctactgtgtgcagccaagtgggccagctgctagagaagaaaatcagtgagtgcctgagtcagctcagctcctgttggggagggaatacgaatgtgtgcattgatgcttgggtaccaggcggggagctaacagtgatggatgatctctgcatttggagaggggagaggtcaaggggagctgggctggtcctcaaagcaccaaccatgtgccaggtgttgctccatgggctacaaatgctgactcacgtaacctccttagcaactggaggcagatgctactgtgttctgcctcatagtgagtttttactgattttactgatggaggaactgaggcacaaagagccaagtgacatttccaaggtctaaaaatgaataacaagctggatggaagtgagacttgagcctgggcagcctggcccctgagtccgtgcctccaacccctgcatgagctggactttgaaggacgggtcattgtgcatagttgggagggtctacgagggaaatgttggcctgtcttcatggtgtttctcttctaagctgtgttaccttcagtcaattgctttacctcctgagcctctatgtagttttgattttttcgtctgtaacatagggataatagacttgtttggatcttcctgtggattcaatgagacgatacatgtagcagtaatgtatagcactcagctgatgctacagcaatgaccaacactgatgcttacgtaatacttactatgtgctaaaccctgggtttattcaagtctttcatcctcacaacagtatgctaagggaagctgttactgttactggtgctgttatcatttgcatctactgggtgaggagactgagacacaatggggctgtttcttgctctggacacttagctagtaggtggcggaagagggcctcagaccttagcagcatggctctggctctggagctctcctctttttttttttttttttttttttgagatagggtctcagtcctgtctcacaggctggagtgcaatggtacaatctcagctcactgcaacctccacctcctgggttcaagtgattctcctgcctcagccttctgagtggctgagattacaggcacccaccaccacacctggctactttttgtatctttagtagagatgggatttcaccgtgttggccaggctggtgttgaattcctgaccttaagtgatcctcctgcctcagcctcccaaagtgctgggattataggtgtgagccgcagtgcccaacctggagctctctgctttaacagtaggttctattggctcaccatctggaacagagtaaacctgcacaatgttcactcccacaaatgcagttacaacagaggcaagcaaggcctgcaacccagaatgccagattgtcaggaccagctcagtgcccttcccactttccctcttcccgtggctgaacctgatagaacactcctgtggctgcctgtaaattctgacccttgatatctggctcccactctgcatccctctcccttgcaccctgtgttctgcttcttcccagccctttggttggtgatcttgtcgtgcagcctagatgcaattcatcttctcattctcaggcaggaaatctgcagttcccggagatgatttggctccacctcaaggattagcctgcacacccatacaccccacacaagccagggtccagcatcccagggtccacttttcttggccagaggaagctggaacagaaagggaatgctaaataaaagcatgggaacatgtgggcagacaggatggagacagcatctgaagaccaggaggagggattctagattgatatgacaggagctatggagccactgtaggttcttaagcagagaaacaggcaggataaaaatagtccttggtggtgttcatccaggagccttgactggagtagggagagactagagctactagttgaaataatagctactactattttttgagaattgatttcatggagctttcttacggtcatgcatcttagtctatgtttagcctatgttatttctaattctcacaacctccctgtggggttaccgagattaccccttcctgcagatatgggaaccttgccaagagactctaacttgaaactgacaaaaatgagattgaaattctggcctctgcctaaatacccattctccttcctgccactttgctgctagaaggctgtgccactggggaggctgctgccattgcccatgggtctaggagatgagagcatcagttagagcaacatgggagcaatggagggaaaccagaagcaagatttgccagaaaggaagaaagagccaggatcccgtatctggatgattccagattgtctagcctggaggatggagatgaattggaccagtcaggaaagaaatgttagggaaagacgtctagtcaggcttgagtgtgttgatttatatgctcctagggacatctttatagagatgtccaggagtcaatggacaatgtgggactggctgctagagtacaaatttgaaggaagaacagcatagtggtgggagttttggcttatgttggacatgagtgggttcaaatttctgctatgccacttactcattgtgtgacttgggcaagtgactcaattatctgaatcccaatatcctcatctatcaaatagggataagaacagtctgtgtcacagagttgttctcctgggcatagcaccagacatcaagggacagttcccatcaatggtataattttggaacctcaggaggaaggataaggaactgagggctaagtgtattcactgaggccctgagacagaagccagagatggggaacaggaagagaaagtaaagccaatgaaaagaaagggaaggcatgctcagagaggtaggtgggaccgccagcctaaccaaaacaggggcgatttcacacttgctcatttcatgtcactgtgttttggaaggaaagattctctaaggcaaatataatcacagttaagcctattttagctgtggtaactggagcctggctcttctttaataaaaggagcctggcctctcttatttttacctgctacttatgaccctgtctcacctgcaaaacatataccccaaatctgtgaggtctgattgttaatgacttaattatagactcacaagctatttctgcatttttaatgggcttcccagaatctagtacctgcctggcttatgtaagatcaccttagatctgagtaggcagaagagcagtttaattccaagtcttttgacaggctctgacaaattgttatggaagatagtgaggttaaccttccgtgcacaaaagggctctcctgtctgtggaaggtcatgatgaacttgacacaccaagttatgtctggacagaatcatgacttttccccaccaaatctgctgtttctcatggcccaacaaggatgaaacgaaaaacagtggatgaggggtctgcgtgtgtgtgtttgtgtgcacacatgcgtgttcgccttgtatgtagtttcaaaagtttacacagaaaagctccatgcttcgttcctcacgcagaaatgtctttatctgccatataaatgggattcaacaacttcattttctggcctggccaacgaaaacactcacaaagtaaaaacaccatacttactctttctttctgagttaagaacttgtagcttgcctgattatagatcatggcaagtaattctgacatcagttaacgaacttgatgaagtcaggttgggaagtgacatcaaggggcttagaggaatttattctgacattgggtttgggaactaaagatactgtacctccaggcttcgtcttgaaacatggaagcccacacactaaacagtggtagaatttagatgcctacggccaggcagctggtccttatgaacaaagcaaaagtctcccatggcccaggttcccacggagagttatgagggccacaggctatatacgcttggatccagcttcactgctcccagtctggagttattcctcaaatgcacctgatcacttcgctcctctgcttaataggctctcacttcctgatcagctcacctggccttggggataaattctaaagacagcatatgtctgaaaaggtcctttgtggtttagcctgactgatctctgcagccttctttcaagtctcattcctgctcatctctaagtggcttgacctgcggaattgtcaccttctccaagagccttcccttcctgtcaccctcgcctcttgtccccatcccaagaaaggatctcccctactggtctcactcttggcatcagtgcttttccttcctaggcttcttctcaatttgtaattatgtatttactttcttgttcaggtgtttaatgtccgccttggatgaatataggaacagtctcttccctgcctccctcccttccttgtttctttcccttcttccttcctgtgtgttcaccactctatcctcagcaccctgcccagtgcctggcgcagagtattcagtggatgccttttgaatacatggatgagtggagcgagttacccctctcacaccctacattgaactctccctccttcaataccaaatcacttgtggtttcttgaattggccaagctttcccatcccttcacactggctactcctctgtctggacattgttccttccactgaggttccacctaccctatggtcagcaccattgatgcttcagaaccagccaagattttccttctttgggaacagctctctgaatatcccccagctggctaggtgttctttctccaggctcctgtagacacctgcctggctctctctactcatagtactaaacaaaacagtctgctttcttctgcttgtgcctgtcttaatgctgagctcctgagctgaaggccctcgctcccatgcagcacactaagatcactctggggccagaccaccttggcatgaatcccagtgctgcatttactacctctgctccaggttcctcagctggaaaaggggttcataattgtgtgaacctcatggggatgctgtgaggattcaatgaatcaacacgtgtgtattagtcaaggttctttaaagacacagaactaatgtgatagatgaatatatgaaggggagtttattaggagaattgactcacatcatcacaaggtaaagtcccatcgtaggccatctgcaggctgagaagccaggaagtcagtctgagtcacaaaacctcaaaagtagggaaggtgatggtgcagccttcagtctgtggccgaaggccccagagcttctggcaaatctctggtgtaagtccaacagtccaaaagctgaagaacttggagtgtgatgttcgaggccaggaagcatccaacatgggagaaagatggaggccagagactcagccagtctgctctttccatgcctggttttatgctggcagctgattagttgatgcccacccagactgagggtgggtctgcctctcccagtctactgactcacatgttaatatcctttggcaacaccctcacagaaacaccggggaacaatattttgcatccttcaatccaatcgagttgacaatcaatattagccatcacagcatccaaagtacttgggacagtcagtgtctcacaacaaactggagttattcatagtgattgcattgttaaatccagacctatgataaatgttcagctaatgaacgaggcaaactgaggtgacccagtcctccatccatgcccaacatgaccaaattctatgatttctgtaacctgtatatattcaggattatgggcgaacttacaccatcaccactcttattcctcaggtgctcactgtataggaagcactgactaaacttcctagagaagaaattatttctacaggtccacttaacaaactccaaaagacctggcagtatttaaaagttcattatgaacaatttacccttcttaactggaagtcaatacaagttgcctcaataaagggaaactggtctcttaatcaagttgcttcaattaaatgcaaaaaaatatttttcccttttttgtcattacaagaatttcttaaaaataaaacaaagaagaaaagttatgacagaagctgaaaaggctaaatttaaggctcgtttatcatgcttgttcatcatcgttgcaaacatgcaatttaaaagacgtaattttggctcctaatccagtttcaagaatcaggatggaaatggttccaaaaaaaaaataaaaggagcaatcagtagaaggagccacttgggagaaacagttgtttttgtttttaatttttttaataaaaatataaaatatatcgtcaattgcccaaaagccaacgaccctgctaatacgtctcttactgcattgggtggttacaacttttaaatccactacctatcagaatctcaggaattatttggtaagtaccttgaggaaaacctggagctaattgccccctgtttctacacacatacattcatggggatatttagcgaaaatttttgtggatgatactaagaggtacctgaaatgaccaaaaatcagaaacgaatcacacatttttcagccacatgatactgaaaagttacgtaacttctctgaggttcagttttctcatctgtacaatggacataatactctggccttgtgtggatgccatcatgagacacatttaataaaacaaatgtcatgcttcattcagtgccttgctaatggatgattcttaatcactgatcaattattcttaagtgaagtagccagtaagttgctatcacttctatacatttttcccctctttcctgatctcacacgttctagacaaaaatacttttgcacatttgttactgatgtaaactgcaatttttttctactctgagccaactgtttgaatcctctgtttgttttggccatgatgccatctaaccttcaagacacccgacacgctgcagacatgtgactttactttatttctttaaaacaagagtgtcccccacccacctgtctgagtaccagtccgtggcctgttagaaaccgggctgcactgcaagaagtgagtggcaggtgagcaagcaaagcttcatctgtatttatagccactccccattccccacattactgcctgagcactgcctgctgtcagatcagtagcagcatcagattctcataggagtgtgaaccctattgtaaattgcacatgcaagagatctaggttgcaccctccttatgagaatctaatgcctgatgatctgtcactgtctcccatcaccccgagacaggaccatgtagtcgcaggaaaacaagctgagggctcccatggattctacattatggtgcgttgtatacttatctcattgtatattacaattaactaataatagaaataaagtgcatgataaatgtaatgcacttgaatcatcccaaaaccgccaccatgaacaccctcagtccatggaaaaattgtcttccatgaaacgggtctgtggtgccgaaaaaggctggggactgctgctctaaataattcctgaaaatgagagcaacaagctcgtggtaaattaattaccttgtctctaaaccgtctcacattgactgggagtgacatggaatctgttgacttgggtgattatatcgatcctgcttacatgaaatatgttttacaacaatcccagtggagaatgaatctgcacatttgctgtgaccataaagaaatgatgagttaaagatgtggacacttaatatgccctgatttaacaagtgtgataacttcaaaaaacctgtgaagtaccatgctccatggcaaaagcctccccaggtactgttaaggaaagttagtatccatttaactgtcacctaaagtggagaaaatatatagcttgaaaattattgtacggatccaagaattgggcctagaattcaataataggctgttacatcttgacacatgcctaaattgttatgtttatgtggctcttagctccaggatactattcatatatagataaaaagacatccttcaattcattaatttaaatagataacagattactttaaggatcagaatctaagaaaactatattctggagattaattttaattgaaattcttgggggaaaaactgatcccatagaaagtatagataactaaaaatggcttctttttggcttttgaaaattctaaattttattttatacaggagcatggtccaatagaaatgtaatgaaagccacgtatgtcatttaaagttttcttatagtcatgttaaaaaacgaaaccagtgaaattaactttaataatttatataataactgtatatatgagtgtgtgtgtgtgtgtgtgtgtgtgtgtgtgtgtgtgtatgtataacagatatatctaacatattatcatttcaacaagtaatcaaggccaggcacaatggctcacacctgtaatcccagcactttaagaggccaaggcaggcggatcacttgaggcccggagtttgagaccagcctggccaggatggtgaaaccacatctctactaaaaatacaaaaattagctgggcatggtggtgcatgcctgtaatcccagctactcaggaggctgaggcaggggaactgctaggtcatgccattgcactctagtctgggcaacggagcaagtgtgactctatctcaaaaaaaaaaaaaaatcaatatgaacattattcataagatacctttttacattcttcttttcatattaagtcattgaaatgtagtatatattttatgcttaaggcacatctcaatttagagtatttaatttttaagtacttaataagcacaagcagtgaatagctaaggattagataggatgctctacagttctacaggaatattgcattttttgaaaggatggaaaggatcattcactgagttcctaccacatgttagaacattgcctttggccttagagcccctcacacatccatctgtttttctcctatagctagcctgttcctatattccagatgcagaagtagctcaggctcagaaaagttaagtaacttaaccagtgccatcatccatcagtaagtggcaggactggaagttgagctgggccttctgattttgtggagtcattgctattttgctaatactgacatttatggcagaactattgtgcttttctatttttcagtaaatttcctgaaatagcataggaaattaaaaagttgttagtaataaaaaataaatccagagctgagcaaaactcctaaagaaattttaggaaggtgggcaagccctgtattgtcatgacacattttaaaaacttttcctgtgaatagaacctttacaaaaagaaccttgtggaaacagcacgaggtgtctaaatgtaaatttctcccaggccagggacctgatctcattcatcttcatagtcccataggctagagaaaacgtcttgcgtttatatttttaaaactataatttacaactttgtttatatatgcattacccgatttaagctcacaacaatgcctggatgcagatggtgtgtttttcgttttctgagtgaggacagtgagactcagaggtgggtcttaggtcgcggtcgtggagttggttgagtggcagccagtgcggccatccacaggctttcccaagtgcatcgctgcagccatagttagctccccagcagctgctcggggctttcacatagatggaatatagtgttgtcagaggtaaatttccagctagtatataggatagaacaagataatgtaataaaatgtacattttctaggctctctgatatgcttctaccctcctatctcttgttattaccataaatcaaatactagtcaattctaaatgtaaatatagggatgataacctctttttacaattcctctcttatctgcaactcccagagagattcacatggagatacttggtcactgccggctttgcggtcggcatgactcctattagagattaaatgacatagagtaatctcaaagtagttagcaataaaaattaatacaaaactatgcaaaactcccagagaaattttaggcaagtagacaagtcctgtgtcatcatgacccattaataaaactttcctcgtgaacagaacctttggaagtagaatctcatggaaatagcatgagatttccaaatgtaaatgtctgccaagtctctctgtaagagatgggttggctgggggcgatggctcaaacctgtaatcctagcactttgggagactgaggcaggtggatcacgatatcaggagttcaagaccagcctggccaagatggtgaaaccctatctctactaaaaatacaaaaattatccaggcgtggtggcaggtgcctgtaatcccagctacttgggaggctgaggcaggagaatcgctcgaactcaggaggcagaggtcacagtgatccaagatcacgccactgcagtgtagtctgggcgacagatcaagattcctttaaaaaaaaaaaaaaaaaaaaaaaaagatgggtctgcatttctcaagggaaaaaaacatctccaatgatgagaaaatacagtgtttgataaagaccatggattttctctatttgattctctgttctcaacacccaaaacttaggcagtaaagaaacaggggaagaggtaccatttattcagtctttttccacccagcacatgggatgatcaaattacatggtctcatccaaagttttcaggcagaagcctgaatgtttgtagaaaaattagcctatttggccctagccaaatacatcctccagtctacccatgttgggcagatgcctgtggacttttggaccctttggcctgggagtgatgtgtgatagttgccagggtggcatctgctgttgggccagactgttggtgctgtttgattctcagcccaattgcttgtttaagcaaagccaagtctagtctcaaggcctaatctcatcatagttgatgttgtctttttttgatggcttctaataaataaatagaaacctcttttcctctggtccataccccttagaagtgccacatttaaaaaataagaggaaagccttcatctcactggggcccatagcagtggcagatattgttatttgctgaattgcttctatctttcttaattaggtaggaagtagcaaccatcaaaaaacaaatattgtatgtaggcggccatcaaaacataagacaactgtttttcttccagcagaaaaccaatttggcaaacacttatttttctttctctatcacacaaagaaagtcaattctctaagaaaaaggatagaaaaagaaaagaaaagaaaacttttaaataatatcccatatatgttttgagaattttatacatcaatacattaaaacataggcaggaaaatttcaaatgcaaacaaaaatcacatcttatagctcttagcaattccttgtcttcaaagactggaggaaatagcccactgggaaggcctttaacagagcaggtgcttccctaggggaaggagtaactacagatatttgagggctactcagaggcaaaagggctcaaaaaacttcagactgtcttccaagcaacagccccagaatgcctcctagatagtgaggctgccttcagttggcctgagattgttgctctgaccctggtgccacccttcctctccaaccttgttacaaacaattcagaagggaggattgtgaaatccttcctgctgctctttctgtcttctgccaatcagagaagactggacatgagatccaagagagggctttccctttccccgatggctacactgtgtctcctgcctcccagctgtttatggaaatcagatggtttcctcaactgtctatctttctgcagcaaatcctttgacagagaatgtgcactgtcaaccaaccccttcatcgagtcaggcaaattaggattcctttgacagcaactttttacaacttccttcctttgaagatataaagctttaaacagtagtagttctccgtgagacccaaggaaaggtctgcagactataagcagactttatctgaagaccacctcctgcccctcactcttactccagaggcctgtgtatttatttatttatttatttttttggtaaaggcctctgctgtgaatttaagtcatctaatcaaaatgcattatttctgtccttgcattgtccattctcgtaaaccgtggttaacacagataattgagacttgagtgcttttttattccaagtcccttattcgatttggcccttgttaacaaagcctagtctgtaagagcgtgaccaccagtcttatttaccttgttatctgtaatttcctctttccctcaggcctttgcgtaatattttctctgcatggaaggggaggataagaaagaagacctaaaaactgaatttttaaaatacaaacagaaaaaaagctccctgtattttcccaaattctgcataaataaaataatatgctccataatggcagagatttgactgacttgttcgttgctataaatctagcacttacaatatctggctgtgaataaataatttcttaatgacttagcaaatgctggagacagaatgaatattgatattaataatgcagatcgtagtcaatttatttagctcaaacgttgtgcggggcaccactttaagtgcatttcttacattaagtcatataatctttataataactctataatataggtcctattttatcttcattttacaggtgaataaaggaagacggggagactatgtgtgaccagcacagggtcatacatctagaatattttggagacatatttttgcactcagactcctcaaaaaaacatttaacaaaatatgttatcttttttgtcacaatagaaaaatatgaactgaatattattacagtaaagtagattcaggttggttgaatagctgtatccaaaagggttaaaatataatctgtgtcgtcctggagaatgatttccgcatgcagaaatctaattgaatttaattgctttcatctcagtgatggagaccaagatatgaacacaagttggttactttgaaactttcataactcaggtattcccattgtacaatagccttgagttttgaaaagaactcaagcatgtataaggattgactgaaattaataaattgatactcagcaggtataaatatgaagcccaatagatgggcaaaagaatttctgaaacacaggatgggggtgatacgaaaatgacttggttgatgaggtattcacgctcctggacctgtgccaactccctctctgcaggttcctgcccttattgctaccctgtaattattcatctttaatttattgctcttcaccttgagcaccactctaaggcttttccatttacctaaagcagtaagttgtactctagtgcctacagttttctgtagctggccttgcgggttcctctgctgagaaaagttcataccatccatttcagttcccttttccatctctgagtacccctaactcctttcctccctctcagagaaagaccgattcttcctccttttcatgacatatcccttcacttgtacccttgaactcactcttttctgcctctttcttcatttcgcatttcccctcacactcttacatcttaaattttccctcctctgtgaatcctcccccagcctccaaacgtggtcaaatcttcccaggcgaaaccaaattatttctccttcaaatcgctgcctcccttccccagtcttgttgaaagccatcttcactcaacatctctatttccttgcaagttcataccttaatactccgaaatggagctcctgtcctcaacattttggtgaaaattctctcttttgaaggtcgtggaaactgaacagctgatttccctcaactgtttcttagtcctgaggctgcttgaagtctctgaagcaattaatttttaattttaattttattgaggtaaaatttacataacataaaattaagcaagcgatacttaattactttctaatgttgtgcaaccactacctttatctagttccaaaatggttctgttaacccaaaaggaaactgtatacctgttaagcatgttctcccttccccagctcctggctttatgtatcacctatttttatatataatataaatgaaatcatacaatacttgggcatttatgactggcctctttttttttttttttttttttgagacagagtctcactctgtcgcccaggttggggttggagtgcagtggtgcgatctctattcactgcaagctccacctcctgggttcaggccattctcctgcctcatcctcccgagtagctgggactacaggtgcccaccaccacacccagctaattttttgtattttttagtagagaccgggtttcaccgtgttagccaggatggtgtcaatctcctgacctcgtgatccgcctgcctcagcctcccagagtgctgggattacaggcgtgaatgactggcctcttttactttgcataatgttgcaaggttcatccacattatagcatgtatcactacttcattcctttttagggataagcaatattcctttatgtggatggaccacaaattgtttacccattcatctgttgatggccatttgggcttttttgactgttatgaacaacactgctaccaacctgtgtgcaaatgtatttgagtactaattttttatttgtaaatacagtgacaataatgccacaaaaacattgcatacttacaagatttatgagttacataatttacaatgattgagtgtgggcagctctattatctggatttcattaagatgatgctacaaaaatagtaattgttagtaataataatgctacaaaaacgttgtatacttgcaagatttacaaattacataatttatgatgattgaatgggggtggctctcttatctggatttcattaagatactcaggattctttacaaacatgctaggtttccacttagagcaagatctcttaaaaaaaaccctgcttattgaccacagcagccagacccgggcctccttctgcctactgtcgccataactctagttataacttgcttttgggtttatacctaggagtggaattgctggctcaaatgataattctatgttcaactctttgagaaaccacccaactgtcccctaggagtggaattgctggctcatatgataattctatattcaactctttgagaagtcacccaactgtcttctacagcagctgaaccactttaattcccagcagagcattggcagtccttgaaatgctcttccgtttgctgtttaagacaccatactgtccttgttctcccactctttctgtatagaaacccatatattttcttcctctagttcttcttcttattcctcctgccattggaagtgcctgtccatttcctgtcttgattttcctttgctgttttctaccatcctcaacaattttatccaacctagcagctttaaagatctcttcttcagcatgtctccaaatttatagcttcatttctgacctcaggtccatcgtgtctacagcgcatctccacccgtacatttcacttgcctctcggggttaactgtgtgtttctgaacgctcatactggggttaactgtgtgagtctgaacacctgtacctcattacctcattacttccttacctcatcttcctaagtgcacggtttcttgcagtgccatcctcgtcttcccatgcacctgaacccaccaccttgtatttgtctttagttcctcaccacctgggaggtcagtggtacttcttatcctttctctctctcccatgtggtttctacctgcaaactcttcattacagtggtcacaactggtttgaacatcatttcctcttatccagccaagacagggccactttcttttaagtttatctttctcccttttcctgtgatccaatctgcgtgcctgttactatctaattgacttcccaaagaataactgtgatcatatcatgccctcttcaaaggctgtcagtcttcccatgcttactgagccacaacgaaatgagtcccaacctgctttgtcactttcagccctcacaattccctgtcattcatgtgattctcctaccaaagtaagctgcttatcttctatgttcactgaaaatggtatgtttccttccacatctatctctaagggatggcataagtgggttgcaataggtttacaggaatgaggatcagattaagagctgtggcatcagtaaaaccaataactcttgatttattatgtaacaatgtatatttttagccaaacaaatgctagataccaataggtaaacctggtactaggaatttcttttcatttttgctttctttgagatctgtaattaatcatggtgaaaataatgctacagaaacatcatatacttacaagatttgcaaattccataatttacaatgattgcatgtgggtggctctgttatctggatttcattaagacactccggattcttcacaaacatgccaagttcccacttagagcaagatctcttaagtaaacctctgcttatggaccacagcagccagatctgaacctcctgctaccatccctgtaactctagttatgacttgtattatccatcacattatttgttgtcttatgaaggatgaagtgttcaaatccctgtaggaaacagaccgaaaactttgagtctgttacccctaagagacacagccctcttttctgaggcgtctttctttccttgatttatttggactatggtttctttggccaaccatttaattttttttttgttgttaactttgtccttgttaacattaattctctcatgtcatgtggaaatgagaataattcagatattgtaagagaaggaaaatggttagataaattagaagcatgaataattgatagagaaataattcaagcagctaactatatcatgcattctctgcttacttcatgaatgatccgtatgccatgtccatacgacttaatatttatttttagaaacctttaccaaaatgagcaagaagtagtaaatgcctcattatcctttcagagcacctaatgatacattattttctgttataaaacttcaaggtttttgaatgcattgttataaatccagactgtcaacatttctttggcaagaagcagcacaccatcctatagaaataagatgtaagattaacaattcaggttcatatattttcatctgtccctgaattccaccatacatggcagaaaaccacaatcatgttttcatagcaaatatgttatgacaaactatacaacatttaagaacatttagaaaagccaaaatggaactttcagaaataaaaccttggctgttgtggtggctcacgcctgtaatcccaacagtttgggaggccaaggcgggcagatcacctggggtcacgagttgaagaccagccaggccaacatggcgaaaccctgtctctactaaaaatacaaaaattagccaggcatggtggtgcgcgcctttaatcccagctactcgggaggctgaggcagaattgcttgaacccagaagacagagactgcagtgagccaagatcgcaccattgcactccagcctgggtgacagggcgagactttatctcaaaaaaaaaaaaaaaaaaaaaaaaaaaagaaagaaattaaaccttaaatagcaaaatagaaaagacagatcatcagcaatgattaataaaaaagctattttataaagcggtgattgggaaagtaaaataggttgtacagattgggccaaagcctaaagatattctggtgattctttccacgatagaagaccgtgaaagaggcaatgcagtgagaccataagccttgtggtttgggacacattcttttcgaaggcctaactttttctgttggtgaaatgggaataaaaatagtacgaatttccaggagttaaattagagttgaatgagataattcatgtgaggctcttagaaagatgcctggaacatagtaagaattaaataatatcatctaataaagtgagaatgaccacagaatatgtctttatatggtattcattgttaaaatgcctagggatggagagttctggctttagctgtaacttaatataggagttaaaaaggtatcataaccttaatattaggtctcgggaggtgtcactaggactctgttatcctttcttcccttctttcttttttggctttctatatgtcttcattttcagacaacctctctcctggggtatcagaagacacactcacattaggataatgcagataagatcaattcacagtaagaagatttatcaaggtaaagtgaagtataggagaagcacatgagaacccaggagcataaattgataaacacaccaattgaaaacagattggctgaattttaaagcaatagatatatgtttcttaaattagatagaccttgaatggaagggtacagaaaaatagaaaatgaaaaaaagtaagaaaatatatcctgtaaatattaaccaagagaaagttgatagagctatgctattatcagaggaaatagactttaaggagagaagtatcgctacagataaagaacgctatatcatatttatagaactatacagcaggcagatataataattccaaattaggatgcatccagtaacatatacagcagccccccttatctatgggaaacacatttcgagaccccgaccgggtacctgaaacctctgatagtagcaaagtctgtgtatgtatatagtcacgtgtgacataacaacgttttggtcaatgacggaccacatatgtgatggtgatctcataaaattataataccatatttttactgtactttttgtgtttagatatgtttaaatacacaaataccattgtgttacaactgcatacagtattcagcacagtaacatactgtacgggtttatagcctaggaacaataggctataccgtatttcctaggtgtgtagtaagctataccatctaggtttatataagtgcactgtgtattgtttgcacaatgccagaatcaactaacaatgcatttctcagaacatatccttgttaagtaacgcatgactatagtatgcttttcctatacatatgcaaatatgacaaagtttaatttataaattggacacaatcagagattaaaaacaataacgaatagtaaaatagaacaattacagtaatatgccagcatcactaatcttgaactttggggccattaagtaaaataaagcttacttgcatacaagcactgatatctcagcagttgacataactacacagctactgagtaactaatgggatagtatgtacagtgtggatacaccggacaaagccatgattcatgtccagaacaggacagcaggatatttagtcacactactcagaatggctcagaatttaaaacttacaaattatttctttctgaagttttccatgtaatattttcagactgcaattgactataggtaactaaaactacagaaagcaaaactacagataagagggtgactggtgtataaaataaaactaatatatataatagaagtagtcaaaatagaaaaacccatcatcatagctgaaaactttaacacatttctacatagctgatataacaagtagtctaaatataaaaaagagtaataaaaatttcactaaaatctgtaatatagattttactaaacaaaatttggttctaacaaaatttacaaaaactaagggtatgcattctgcagtgttcacgtggaatacttatcaatatattgtaggctggtcatagagtacatccaaacaagtttcaaaagatagaaatcatacagattgtatattctgaccattttaaatttaaaacagaaattaataacaaaaaaactaaaggatccccacatatttagaaactatgcaatatatgttgaaatattccatgggtaaaataagaaataatagtaagaagtagaaaatagtttgaatggaatataatggaaatacaacataacaaaacttgagaatccagataaagtagaggaaagatttacaaccttgaatgcatatataaatcagagaacaccaaatttaactctaataaaatggagggaaggaaataacaaaaatacaatttataacatagaaagtagacatgcaagaggataagtcaataaagtttgttctttgaaagttctgtaacttgatatcaatagtccctagtaagggtaattaagaaaaaaaaaagaaaagacactatggctaattaaacaaatggagacagcactagagatctttcaagaataagaaaaaagaagaaggcattgttaatacatttataaaaattaatttgaaaattaaaactggcaaattctgtaaaataaataaaaaatcagtgtaccaaagcataccaaaaaaaaagaaatataaaatctggtaagttctacatttattaaatgaaaactctgtagcctaagataattccaagtccagatggcttcatggtaaattccaccaaacttttaaagaagaaaatacactaatcttatgcaaactcttctgtaaaatagaaaaaaaatgaaacgctttccagcttctttctgaaggccaacataatcttctttgcaataactgacataaacattgaaagaaggaaaaattataagccagtctctctaatgaatgtatatgagaaggtagataaatttgacttcaataaaagtaaaaacctgtgctcatcaaaatacatcattgagaaagtgaaaaggcaggctatacagtggaaaaaaaatctttgtaatatatgggtctattacaggacatttatctaggacatgttaacaactcctacaaaaatataacaaaagggcagagaacccaactaacaatggaggaaatatttaacaggcttttaacaaaagaggatatctacatgaccactaaacatattaaaaggtttttagcatcactagtcatcaaggaaatgcaaaggaaaactacacggaaattattcagatactattatacacacatgtgaaaattaattagaatttaaaaagtaagtataataacaatagcaaggacgtgtggcaatcagaattctcacacactgtaaagctgaacattcttgacctagaaatcctacttccagatctataactaaaacaaatgtatacacatgtacactaaaggctcttacaagaaagtccagaataacactttgtaatagctaaaaactggaaacaactcaaaagtccatcaagggacaaatggataaattttggcacatatatcatatgtatataccaaatacatagcaaaaaaaaaagcaactgttattatgctcaaaaatatggataaacttaataggcataacattgcatgaaagaagccagatagggaagggaatatcctatggaaatgaagttcaacagcaggcagaactaactaatctctgttgagctatagatggtgatgtgaactaatctatattgagccaggatggtggtgatatggtttggccgtgtcaccatccaagtctcatcttgaagtgcagctcccataatccccacatgtcacgggagggatccagtggcaggtaattgaatcacgggggtgggtttttcccatgctgttctcgtgatagtgaataagtctcacgagatttgatggttttatagaagagagttccctacacacgctctcttgcctgctgccgtgtaggatgtgcctttgctcatccttcaccttctgccatgattgtgagtcctccccggctatgtggaactgtgagtccattaaaccttttttactcttttttgtttgtttgtttgttttttgagatggagtctcactctgtcgccagtctggagtgcagtggtgcattctcagctcactgcaacctctgactccctggttcaagtgattctcctgcctcagcctcctaagtagctgggattacaggcacgtgccaccacacccagctaatttttatatttttaggagaaatggggtttcaccatgttggccaggatggtcttgatctcctgacctcgtgatccacctgcctgggcctcccaaagtactggcattacaggtgtaagccactgcaccccagtctcaggtatgtctttattagcaacctgagaacagactaatacttgtggttacctttgaaaaggtgatgactggaaggggcctgagggaggtttctgagatcatgacagagttgtatgtcttcatctttatggtggtgacataggtgtgttcactcaaaaaaaattcaccaaactgtacacttacacttttgcagtttaatatatgaatgatacatgttatgctttaattagaaagttaaaagtaagtttttttcaaaagtagtaattggatgactcccgcttttattgagttagcaagtatcttttactgccactttctattgttaaaaaaaaaaaaaggctcaccactgaggctgtaaggctaaatccttagcatgacacacaaaaccatctataaaccagtttctagcctttcttcctggccattccctttgacctgagctgtcttgaatattcttaagacttgacaatactaattttaaaccgtctaagataagatcacctcccactccagaaaaggggtgagggtagatgttaagaccagagtgtgcttccagcacacttgtattttttatggtactaagaaagaaaaatgctgacgcttaaacctgcacacagtaattccttaacatcaatggtaaggttcctccctaattttgaaggcattaaaatggggtcggggaaatgtcttacaaatgatattttttaaaaaaataaaataaaacaaagataatcatgtcttggattatcatgactcacagcaactttactttcaaaagtaagaatatttacttctaaaactatgaaatcttcactatattcttaaaaatataaatcgttaaatgtcattctttagctctaaatacaaagttagtttgttgaacttcatgagttacgtcttttatcgggcttggggtgtgaccttagcccctctcctttgtgaggggagatggcagaactctcagaagctttttctattctcatctttgttggttactggggaaaaactggatttcgctgcactcatcaaataaagaggcccaggtagcagcgcctccacgttttgttcaagtggggttttctgcgtgtgccgctggccaattcttcaagaaaagtgtttgttcttctctggcggtttggtgttcctatgtttcaacatgggggtaccaaataattcatttccccttttcccaacagatgcattcttgtgacctcactgatgacaggggcgtcgtttattctaacaaatgctcttgtccaaattccaaccatgttgccaagagatggcatagctggtgagggctggactttaggggccaatctccactcctgagctcccctgaccacacaggaagaaaacattaatgatgttcccatactgatgttgtggtgtaagtgtctcctgtgtaaatagaactaaatatttaggaaagaaaacagaagagtcttatgtagtgcattacaaactagaaagcttttgaagtcagcatctgggatggtcttaaaaacaaacgtgcagtctgagagaaagaattactgctgacacacgctgacctcacagaaactatctggtgatgagattatctctcttccaggactctaacaaggctttgcaaggatattttcttgctttgctttgctttttttaatcttcttaactggtggaacctcttgttatgtgcaaatctaatccattctcattcaaagatggatgtcccggttttactgtatctgccttagttggagattcccgggaagaaaagcccaggacaagtggtcaggtgcaggaacttgatctgagaggtggtcccaggaagcagaagtgagttcatggggacattgagaagaggaaggaggccaatcaaaaaagagcatttctgaggttgcttctgtacacaggggcttcatttcttcaattctcccagatcctctgggaaccctatgaaatgcttttcagaattctcagagtcatccacctgaaaaatagagggactggagccttttttcctagtctccctactgtccatggattgagagttgcctgggagcagggagagcgggtgttaactgccttctgtttagaacaagttcctgtatgtgtcagagatctggggcaggatgatttgcagtcatgtaagcttaggttgaactctgggagagccaggtgagtgtgtgctcaaaaagaactgtccagtgcagctgctgctgaaatcagaggtgactgcaaggatgtaacactggcgctcgggtgtctgccatggcctaggtttcttatgagagattgaactcttcggagattccatcattcagagcaggcacaagacggtttggccaccaatctgggtagagccaggctgttgcatgacaagtcagtcaggagaaaactgaggctagcaggctgactttctggttccatgacacacatcacatctgcaatagagcttaaagacagggtgcttatccctcaaacctccctgtatcactaactttcttaatccagacttttgcctttgtttttttttttgtttgttttttttttttttttttttagaaggagtctcgctctgtcacccaggctggagtgcagtggcaggatcttggctcactgcaaactccacctcctggttctcgccattctcctgcctcagcctcccgagtagctgggactacaggtgcccgccagcacacccagctaatatttttgtatttagagtagagacggggtttcaccgtgttagccagggtggtcttgatctcctgaccttgtgatccgcaagcctcggcctcccaaattgctgggattacaaacgtgagccaccgcacccggcctacttttacgtctcataacccaaaagctctatggcttcaaaaattcccaactcctcaaaaagctgattttctgttttatcagtgcccctttgattgataaacaatatattaatataagatggatataaagcagatgtattttgttgccacaacttctttggttcaaattaaagaatataggtcatttgtcccagagagtcagtccagctgaaaaattgtggatgttgataaatgcgtaggtctccattcttaaaaatccagcatttttgtataggaacaaaactttacttggattataaattgcaggccttctttgaaaagacaaagtgtgaaagggaagagaactgtagagtcttcctgatgtttactgagcccttactccaaaccaggacttaggcttgttgcatcccctccattaactcatgtcatattgcctaattcataaagaggcccagagaggcagtcgaggtgtagaaaggttaagtaacattcccactgcctcataacttgtaagtaatgaaactctccggaaaagttgagctcagatctgaatccagagcctgcatgcctaaccgcagtgcaatgctatcctcacctcactgtgcaaatacatctcagatctctgcattaggatgcacaggtttacattttttaaaagcaggtaataactgtcttattctgtacctattgtctgttttcacagtctgctgtgaacccttgctttcagctgggacactgttgccttccactgccttccacagcctctttacttccccttaaacaacctattccaactggtactacttgataatagtcattttctctcacctgaaagcatgcctctgtcaaccaggctcttcccctcaatggctaatgactctcactcctacactcctgcagagggcctggcacatagtgggtgcttaatacaagttccttggcacaaagaatataggaataaatacggggactaaggtattgcgctctccattttacaaaggagaaatctagccttggtctctctgataccacagtctttcccaaagttgcacagcacagtggaggagagttggacctagggcccaggtttccaggatcctggtctagtgtaatgtcagtttctaattatgtggtccacacacatgaatatttaaatcagcatctcctggagataactcaagaggtgactctaatggtagacaattgaggctgtacatcagggttgcaaaggggctttgtccggatgagtggattttttgtgtcccttacaccatgtgaattcccagcatcatggtttatgctaatcctctttccaaaatagtttcctggtgaccttctccctgtgccaaccccggaatacaatgggatgagtaactggcaggtccagatacagaaaatgagtgagcaatgcctttcccagctaaaaattcttccagctcacccatggtgtgctagggaagatgttctcctatgtcctgaatgaccagcagcagaggattcagggcacccaatgcaaaattgtcaccaaatgactgtgacactgaagtggctcatgctgctctttgcactgcattaagtgaaaccagacgcctccagttaaactccagtgagctaaaaagtatagtgataaatatatgaaatgagtagaaagaacaaaaataaagaagcctcaccccagatacggcacttatgaagaatctgtgtctcagtctcccagcaaaattgaaacgtaattcaacttcagatggtcaatgcctgccttaatgccccatgctaatgtcagccctgagatgtcacaatagtccaggagatgcttacctgaaggagaggccctctagagaggctgtgagaactgtgatttggagctcgaaactgagatagtgagctgggcagggtgacaatttatggagaatgggaaaaggaagagggaagtattttagcaaaacggatgctatcaggatggctgaggctttagaaccagatggagtgctgtggcctctcttggatggatgctgtttctgagctttgcatctggaaagacagagcctgctctaggaataatgatgtcaaagatctttctcattttactgtctggttaaatatcacctcttcagagaagccttcccttatcaacttacttaaattgagtaccccctgtcagttttctatcacagtacctcacttgtgtgtgttttccattcatagcatttgttacactttcacatttttaaaagcgttgtttctttttttgttttttgtccatctccagttcctatcagtgccctaccatgtccttaacatttagcttagtgcctgacacgtagtgcttcagtaagaagtatcaatgtggtaagtgaatttctaatcgaatagcagttacatcataaatagtcaatgattcttgtgatgtctcatggtcccagggatcatgagatacagagtgacagaggatggaagttcagttttcttctctatgtaacaggaagcaaggaagtgatcgtcagaataactgcaagatgaccctgctggctgctgtgtgacaggggattagaacagtcataaaagcaggtagagaggtgtttcagttagctatggctgtgtaacaaactactccaaacttagagacttgaaataatcattctatgtggtcatgtttctgtgggtcaagaattccagcaggattcagctggttgtcaactgggtctttcacatagcttttttcacctggtaacttagctaggctggaaaatccaagaaagcttcactcatacacctggcaccttggtgattctttgcatgcaccttggtgattctatgtgctgttttgtctccctcatagctaatcagatgtcttatgtggtggttggcattttttttttttttttttgagtcagagtattgctctattacccaggctggagttcagggtgcgatctcggctcactgcaacctctgacttccaggttcaagtgagtctcctgcatcagcctccctaatagctgagactacaggcacgtgccagcacgtctggctaatttttgtatttttagtagagacagggtttcaccatgttggccaggctggccttgaactcttgaactcaggtgatccacccacctcagcctcccaaagtgctggaattacaggtgtgagctatcacgcccagcctggtggttggcttttaaagggagcaggtcaaccatatgaaaacagaagctatggctctcttgaggcccagccccagaagttacacaccatcagttcccctgtgttctgttcgtcaaagcagcccaagattatctcaaaatcaagaggaagggaaatagattcagctcttcatgaagattggcaaggaatgtgcagccattttcaaaccaccccgcagagagaatggttaggacattgttatgataaacccagcctaaggttatagcaatagagatggacagagatgatttagctgaagatatagctgtagttagcatgaccagacttgccaatggttgtaatagggtgtctggattagggagatgttgtttatctctactagtttcctgttaattactctatgaacaaattagcacaaactttgtggcttaaaacaacacaaatttattctgttttagttttggaggccaaaagttcaaaatgagtttcacaaggccaaaatcaaggtgtcagcagaactggttccttctggaggctccaaggagcatttgttccttgtctcttcagtctctggaggcagtcgtgaccccttcttacaacttcaaaggcaattgtgtaacatttttgcagggagagtcctgggaacagtgagacaagttggggagaggcaagtggaagggacagaatcaagattgaagcaggctaagtatgaaaaatttgtaagatgtccaagcggagatgccagaaaaagtcagatgagtgtatgagtctcacatttcagagctaaaaatatacactctggatttatcaatataaagttagatgagggccaggtgcggtggctcatgcctgtaatcccagcactttgggaggccgaggtgggcagaccatgaggtcaggagctcaagaacagtctggcccacatgatgaaaccccatctgtatcaaaaatacaaaaattagctgggtgtggtggcatgcacctgtgatcccagctattcaagaggctgagataggaaaatcgcttgaacccgggaggtggaggtcgcagtgagctgagatggtgccattgcactccagcctgggtgacaaagtgagactgtctcaaaaaaaagaaagttatatgagtattgttgaagtcatttaggaacagattttttagcaacatcatccagtagaaatgtaatgtgagccagaaatgtaaatgtaaatgttctgctagccatatttaaaaagtaaaaagaaaaaggaaaattaatattagcaatatcttctttaacctgattattatataatgatcattccatcatttaagcaacataaaaagcaatgagatattttagataactttttccatactaagttttagaaatccagtatgttagctcactttccaattcagactagccaatttctttttgatggagaaaatgtatttaattaaaagaattattcttactattatttttgattggcaagtcataattgtatgcatttatgaggtacaatattatgttttgatacatgtataaaatggtataattaaatcaagctaattaacatgtccatcacctcagttacctatcctttttttgctgagacatttgaaattgactctcttagttattttgaaatatataatacattattattgactgtagtcatcatgctgtgcaatagtctcaaaacctctttctcttgtctatctgaaactttgcactcttagctaaaaaaaatctccccagtccctcccctgcacccccagccccaggtaatcaccatcctactgcttctaggagtttagctttatttgatttcccatacaagtgagatcatgtggtatttgtcttctgtgccttagccatatttgtattatccactggccacctttgtctcctggtgatatactggacagcacagctttagaaagaagagattctagaagttatccctgaggaatcccagcatttaatggtcggatatagaaaaagcttgaaggtagaagaaaaaccaggacagtgtagtattgcacaggtaggaaaagccttaagaagtgagttgatcagctatgttgaatgctggtacaaagatgggtaagatgggatggagaagtttctacaaaactgctgctaattcaaagaaacagatatagaccacttccaggctgggcgtggtggctcgtgcctgtaatcccaacactttggaaggccaaggtggacagatcacttgagatcaggagttcaaaaccagcctggccaacatgctgaaaccccgtctctactaaaaatatgaaaattagccaggtgtggtggtgcacgcctgtaattccagctagtcgggaggctaaggcaagagaatcagttaagcccagggggcagaggttgcagtgagccaagatcgtgccactgcattctagcctgggtgacagaacgagatttgtctcaaaaaaaaacaaaaaaacaaaaaaacaaaaaaaaaaaaacaagactacttttaggttctcgctctttggatgtgttgctgtttcctgcactctcttcctactgtctttgggtggtagatggaagggtgccacaggacacacagctggggaaacttcctcttgcaaagcctctactaaaccatgccacaccactgtataataactggaaaatggctttgggacttaaaagcaacttcatccaagaagaattgcagtttggatgcagtccaggtataaaacaaccaccttcactcctgtgtgttactgtaaagcttgccttctgtaaaatgtcttaagcataagagctgtaaaggaaaatactcatggattatattgtgatttgaaatcaggatgtaatacgatagtgacagcttaaagattcttctaaaactagatatgaaatttgaatgtggcacctgtctataatttgtaaagcactttggctttttctcagctacatggtgatgatgagttcttctcaacaagtgactaagctctaggggaatcagtttctcaatttgcatgagatacgggagcttcctaagacatgagactttcagttttaaaaccaggatagtcttgagagagctgcccttgtttttcggagacatgcaggcttcccaagatgtgagactttcagtgctaatcccaggaaaagtcctaaacaaaaggcaacgagttggttgcccaaccaagctgggaggccttctgaccgaggacctcctgaagtcatcaacccaaagagaagaactgcctcttagggctgactgatgcttacaaaagggattataaagcctgaataccaatttcttaatttgcaaagagaaatgatgtgacaaggaccaggaaactcaaagtccatatggtcagcattttctgtctctgtataaagccaatctattaatttaaagaacagaatgattatcacatgcattgaaatacacaaagtccaaacgatcagcaaattctcgcccggtgtgaagtcagtcttttaatttacaaagaaaaattactgtcacagagactggaatgctcaaagtccacatggtcagcacattttctgcttctactctacccttcatggaagaccaattcataatcagaaggctgcttagtgagcatgaagtgttggttagagtgagtgcttaaaggcactggactaagaaagcctaactttaccaaggggttcagactgtctttgtcaccaaatgctgaagtctttgcttcagcaatttttcctgcctctaggatgagtactgcaaagttgcctccaggaggcatcttattttccaagctgccatggatgactgaccgttttaagcgtccttcattcttcagatgtgctaataccatcaattaggtagtagagtttcacttccctaggagccattttgtctttgctacatttatctttgctcttattccaaagagcagccttcattctcttcctatcaaatctttcagcagcagaaggcaactgactgtatctctgagtaatgttgataagtattgtgttgtggaggctctgcatagtacagtggttaacggcacgggctgagaactgaggaatacctactgtctacttgtctactaccatgcagaactatagtaagtcactatatccctttgagccatagtttccagttctataaaatgggaaccatccatagttggttgtatcaaggactcaatgacagcaaacaagtaaaagaacccatatagtgtttgagacatgattgtgctcaagaaatgataggaaacaaacgtacaaacgacaagcattttttgctgcagtttggaagtattaatgttttacaacctccacaaactaaggttcatgatcgaagaacctcactgaatatttaactttagggataaaatgcacaacctataataattttagtgcaattgatttattatagtcaagggaaacatgactgaataacaaaagtaggttaggaaaatactgaaacagaataggatgaagaaaagcattttaatgaaaaaggaaaagcagagagcagagtagtaatctctcttggttcctctccttccgtcagcctgctgttcctgcccctctcttcttctctctggcctctagataccggaatgtctcaggcctcccatcccctctatcctccatttcgccacctgctctggccaaaaagtttgaaggaggacctatgaaaaatatccctggcctgggcttaagaagccttcaccctcattctcaactctgaggctaccagagcatgatcagttcatcatctcagtcaatcctcccagctcctctattagatccatatgactgccactttgtgaaagatacaaggaggacttggcaaaacaagggccccacctgaaatggatagctgagagcattaccacagtcggatctgctgggttgaattgtacacagcagatgccaacttccaatgaaattagaatcatatttctatacattttcttaagtgccagacatcattctaatcattttataggcattatctcacttagtgtctaaaaaaccctaaggttttgccatataactttcatccccactttattatctatctagaataactgaggcttatggaggaaaactgactgactcattgctgcttggctattaagtggaacttcccaagactctgtaactttggagactagtcacatatgaaatatgctaccctctcacttgtgtgatgacgttcagggtttggcgaatgttgagcaagccaataaggtaaggctgtatgcggtacaattctcacactcgttgctctttttgttgtaaccagcctctttaaacactatggcctgaccctctgaaccagccacctgaccattcttctgacttcccaataagcctttgccatcaccaaacatactggcctccatggtcttcatctttaatgccattaattaaaaaaatatgccccacagctctgcaagaagaattcagcaggcagttggcataaaaaggttgggaatggtttacatctttgagcttcagtattttaagtctgcaagttcatggagtgcaagggctgtggacaccctgcttgccaatttttctgccttaaccgttccctgcccccttgttgttcaatttctggccaatgtctaaattttccaaaaggaagtatggtcttttgcattatgacacatgattgccacccactggttaagaatgttttcactatgaaggtttagaaggtttgctgttgaggcaaaagttacccatttcccatgcccccagttcagttgtctggatatcccagaacaagaagcattaactgcttcaatttaagtcagattctcaaaatcccaaaggcatgtctttcacttatcccataaaacatctaattaaattatttcatttaattgtacatcttgaattatttgtttgcatcttgaattatttttgtcaatgcgcattttccaataaaggagtaatcagtggtctcaatgtcattcagatgaggccacccttatttatcagagttctaacaccaatcagtattcatccacagggctctttagtggaactgtggcactctttagtggaaatgtgagtttcagatttctgattaataaaaataatttgtaaatatgatcacataatttttgcaataccgttttcttttctaagaatcacctatagaaacacctactacgtgccaggcattgttttatgtgaacatttcatgtatgtaacagccccccctaaggtagaaattgttattgtcattcttattttgaagatgaaaagctgaggcatgaagagggtaagtcaccatccaaagtcacctatctaaaaaatgcaaagccaagattcaaactcaggaaatgtgttactagaatcttatctactatgccatgctgcctctcagaaagactatcactgcttcctccagcctcatcctcttgtcttttcctgggctggggccatcctcaccctgattggctctccccaaaggctcactctgacacccattccagtgctaaccctgttcagagtggacaggaactggtccatgcatctccttagatttaacacgataggctctgtctctcacaagggcaggcagcaagcaattgtcttttagaggaaaacaaaccatttgaactaaatgttgattcttgctctctctagaaatgcagacagaaatcggcaatcagtgtagttgatggataccagaaaaagaaataaaagtaaggaaatgaagaaaaattgggccaatggcactttaaaaatttcccaaaattttgaggacaacttccctttttttcaaggcacttgatgcttctctagatagaaaaattgttttcacctaaaatatcacactagctgttctgaaatcctcttgcttcttggcatgcttattaagaaattctgctcttgcagcaacaaatctcagctttctttgcttctagagaactttaaaatcattaactatcctttaaaaactcactcttggaaatacatgtggtctctttccctataactaaatatttgatacaagccactatcaacttgatactgacagtttaagggtgttgggtacgatgacctttgaggtgccttctggccataagtaccaaggaattcataaagttggattaaatgataacaaaaattggaactttccctttatcttcttttcttcttaaagaataagttaagatacattgatttcatttcacaacttgcacggaaatgagtgttttactgttgatgtttttatgatctgtagtttccattctttttaatagccttggtgcagtattaaaaaaactatcttggtgataaaagttattttagaagtaaaagttgctttagaaaagcaaacatgactaatataatccaagttttctcaggaaggaaagcgctagtgtgactggacaatgctgagacgcccaagaagatgattgaccttcaattacattgaagggaatgactgaactatttatctgtgagggattgtaaatcaggagccaagggaaagccttggaaattcaaatgtaaaaacctagttcagcaaaggagttgtcttaagcaatagtatataaatcaggcagggttaggttatactacagtaataaacagcccccccccccccaaatatcaatgacctaaacaacaggagtttatttattgctcatgatatacaaccaatttaagttaggaggggagttatgcttcacgcagtcatgccacatgaggtcatgatagcaccgtcttaacatgatgcacctgagttctcctggcaaaggaaaagaacattccagattctgcattcacaactgaaggctctcctaggcatgagacaccatgcctcttactgtgatttattgatcataataatgtatagcctcatttaattgcaaagggatcaggaaagtgtcattctgaacattctcagaaaagcagagacctgattatacatgagtgttagaagcctctacaacacagcaattgtggactgaatgcttcattcaggcaataagcaaaagcctccttcagcagcgtattatttaatcctcacataaccctgcaaggtgtgggctttcatgatccccctttctcggataaggagactgggaatcaaggaggttaaatagtctgcccagagatgctccccttcctattaagagcccagttgtaaacctgtgctcctgactaccatgtagctcttccctgagagctcctccaagccttggttaaagggccagaccctttgctctctgagcaggaggagagcaacgtctgccctcactgacccattaatagacacctgtcagtgaggaagggaggcttgttcacttcagggagctgtggtcgcttcccctgtgccactggaaaactaataattcatgaagttggctttcaggtacgagcaagctggactgaatagttgtttcaagtcataaacatagaaaagtaagttgataggagaagactatgtggagaaaatttaaccatgttaaatatttgaataaacatttaaaaatacatagcatatataggtgcatatataataaatttgagacagtaggcatgacagagttctgaaatagtttataagtatgtgagttgtaaatatcccatttatattatgcatagattataagtaaaatacacagaattgattctatgctccatcatctatgtggtcatctaatcatccatctctctaaactaacgtcaaagagacatataatttaaagcacatatgcaattctaaattttcttggataagcttttaaaaactaaaaataaatatataaaattaatttaatagtatattttatttaacccagtgcatgcaaatatgattatttcaacatttagtcaagtcgaaaattgttccatctttttggtacttagtttctgaaattgtgcatgtattttacccttaaagctaatctcaatttgggtgctaaaccttcagtggaaatccttgctctgtattcagtttataaaagatgcggttaaagaaaccaaactcacttgtccaaggtgttccaaagatacttcaaagtttgcaatcgtttagttaatctgttgacaatggttagattgctgttgtgtttatatataatgctagaaataatgcatatgttgggcatgtacattacaatatgatcctgtcttccagaccataaacacaattagtttttcctggaggattctaactcaccattgggtacctcttatatggaaaatcattagaaatgcctgtcctctctgcaaccagctgggaagaattttctgtcaaaagctagagatgtttgtgtgtttttgtcaatgggatcacaaacttgaagtcagaacagttggattctggatatgagtcttcttttaccagctgtgtgatcttaggtgttctgggtcccatttgggaaatgaggggtttaattgcctccaagcttgatctgtgcatggagcaatgtcgttatgagaattccccacattttgctcccttttggacctccctaaaattcccctaagaacacccctcactagtagaaatgtagaatcccagaccttaccccagatctactgaatcagagtctgtatttttaacaagatcccctacattggaggaaagttgtagaaagactgccctggaggatttctaacatttctgtgggctctcatattccttttaaatatacattagaatgaaatgcagatattttaagatgatgtggcctttcagagagtagttgcatttactaggatgtgaaagaaacacttttcaaatggtaacgatgtgaaggtgtcctaagtgcttgtgttgagtccagcactgtgctggtagctcacgaactcctcgtgacaacctggaaccccatgaaccccattttacaggtaaggaagcacaacctgagagacatgaaattatccaggcaggcttgcgtggctagtgattgtgaagcttggatttgagtacaggtcgtctggttccagagcttgcacgaaatcactgtgctagtaagaaacagagttcgaggttgaacccgggtgactcagcatcaaggaatgggctctctctttggggtgtgtgtctgtgtgtgtgtgtgtgtgtgtgtgtgtgtgtgtgagagagagagagagagagagagctttcttaattaccacaccatactacctccattttatattaaacagaatattggaatcttgacctttttctgtatttaattagatgctgctgtttaataacctatcacaaaagttaggcaggcattcacacacatggcgatgagaattccccacattttgttccctgtgagccctccctaaaactctcctgagaatacaacagctgcatttaaagaagctgaatcccctattgcagattttattcctgtaaaaatatattgaacttgacgaaacagagaaaatgtggcctgcttagtcagttaccctgacactatagctcttcacaaaagttttaagatatgatcatatatttaatataatatacttagtataacatgatatatgtgctatactatagcatagtatgtatatgtaatatatataatatacagtacagcatagcaattgtctaccagtgacagatttatttttaagttttttattgacacataatatttttacatatttttaggatatatgtggtattttgttacatgtacagaatgtgtaatggtcaagtcagggaatttagaatatccatcatcacaatcatttatcatttctatgtgttgagaacatttctagtcctcccctctagctattttgagatgtacaatacattggtgtgagctgtagtcaccgtactttactattaacattaaaacttcttccttctgtctactgcctgtttgtacttaactaatttctcttcacttaccctcccagaccgacaaacatctgcatccttcccagcctctggtaaccaccattgcgctctttttctccatattttaggtcccatctgtgagtgagcatgtgcgatatttctctttctgtgtctggcatatttcatttgacataactatctccagttccattaaggttgcagcaaataatatgatttcgttcttttttatagccaaatagtatttcattgtgtaaatataccacaattttttaatccgttatccatttatccactgatgggcacaaggtccgttccatatctttgctatcgtagatagtgctacaataaacattagggtgcatgtatccctttgatagactgattttctttccttggtataaataccaagtagtgggattgctggatcatacggtagttctatttttagtgattttttaagaaatatccatactgttttccataatggctatactaatttacttttacaccaacagtgtatgagtttccttttctccacatccttgctagcatctgttattttttgcaatgactgatttctatgaacaggagtctttggagccttccttcatagccatcgtctcacacagtcctcactggtgctattaccagctccatttgcagaaaaggaagctaaagccaaagcttaagtgagttcctgataaatagtccatattttacctcaggtcttctgattccagacatcacgtggactgtctgaaagacgcaaaattagacaaacagcaaaaaagagaccctgttggtgtccaacacttataatgaggctcacttctgaggacacgtgcagcctaagcaaggcagccactgcctctcaccttacagcttgctgggctgataatggccataggggatcctcagccaatgaggggtaagatctgtagataaacatccttgggtccagcatccttgacccttaatggacaattctgggggatgtttctcactgtctcttagagagtccccagtaggattgagctccagttgcccacagtggaagtctttccatgaatgcaccctttattggcttgtgtccacaccctgtcttacttcccaactccctcacttgtgattcctggcataacctcccaaataaaagagtttcaccccagttcttgtctcaggggaccacaaagagagtgactatgtggccccgtgaagatgaacttgtgacaatggcatgaccaaggtttaccacctgagctctccctgttagcgctagttacatgtagcatgtgagctgggttcttctttcccagtcattttcctgtcttaaccttggggtgaaggacaatgttcttgacctagaatggcctaggcagagtctgataagattgttgtggatgcaaagggaacagggttgtggttgctgagcattgcatccagtgcgtaccttgttcccttgctgcactctcatcatgtttggattcagatgaactttgatgttctgtgtgaggtggacgttagcactgtatctgtactgagttaggcgaggcggtcccggcaaagtaattacaaggaaatgctgtattttagattgtttgagttttccaatagagacatatcaatcttgcttgggaatactttgacttgtgctttgtgatcagatttccctgtgcttctggtgaagcttatggattcatgagttagctctgcaaatggagagtttgtgttagaagtcaaatcagttaaagctctttgatactgcacatattcatgggcagaattgctgcaaaaatcctctaaacacatacgaggagctacattatacctttaagtggcaggatcagcttcgtgacaaaaaccaaaccaggaatgagaggggaaaataatctaaatgtgttaagggaagtatgcaaaatggctgaaagctgacaaatggcagagccagaacgtgagttctgctgattccagacatcctgcctgatgaacataaaattggaaggaaaaaaaagtaaatgagctatgatgagaccaagtggcccatatgggtatcaaactcaacaggatggcatgaccaggcttttttactcaggcacaaagagcttttgagcattgtttgataatattccaaaaagaaaatgatagagccaaatttcccaaatgttccatgtaaaactaggaaatgactgaagcattcaccctcatttctaagtattgtaagtgtctggatcagaatccattgccatggcttattcattcagagcttgttgctggggattgggatgcttagactggcaggactggtgtctccttggctagacaaagatccttgcatggcattaagggagcctgtcctgacatttcataaaatcatttctgaaccgtgacgtttccagtattttattgtgaacattttcaaacataaagttgaaagaattttacactaaaccaccatgtgcccataacctcgattctacagtttacatttgacatttccatatacttgctttatatatataaatatacacatcacacacacacacacacagtccctgcctctatacatccaccttactttttatgcatttcaaagtaagcaacagatatgtaacactccaccccctaaatagatctgcatgcatattgttaattagaattcaatatttgcttttggttattttcttcttcagaggaaaatttacatactatgaaacccacaaagcttatgcgtcatgtttacattttgacaaacatatattactttggtgcaaaagtaattgctgtttttgacattaaaagtaatggcaaaaaccgcaattacttttgtgccaactgaatacaactgtgcaacccaaacccccatcaagatagaaaccatcattatgacctcagaaagtttcttcatgaccttcctagaggccaccaatattctgatttttcccatcatagacttgtttcaagtttcattggttctagaattttatatgaatgaaatcgtatggtatatatatttttgtttgatttctttcactcagcataagattttctttttctttcttttcttttcttttttttcttttcttttttttttttttttttttttttgagacagagtctcactctgtcacctaggctggagaacagtgatgcagtcttggctcactggacctctgcttcctgagttcgagcgattcttgtgtctcagccttctgagtagttggaattacaggtgcacaccaccatgcctggctaatttattgtatttttactagatctatggttttgccatgttggccaggctggtctcgaactcctgacctcaagtgatctgcccactttggcctcccaaagtgctgggattacaggtgtgagccatcacacctggccagcataagattttttagattcattcatgctcatacatcagcattcatttctctttgttgctaggtaatattctgtcacctggtcacttgtatagaccatatttattatctactctcctattgatggatgtctgagttggttccagcttttgattacaatgaataaaattgctataaaaacgttcatgcacaattctgtgtatagacctgtttttctttcgcttgggtagactcctagcagtaaaagggtatgtcatggggtagactcatattgagtgttatcagaagtgttcacttatttttctgaattggtcgatcctcttccggataacgcgtgagagcagtgacggctttgcatcctcacaaacatttgctgttactgatctttttaattttagcgattctggtgagtgtgtagtggcatcccattgtggatttaatttgcgttaccctaactacccatatgtatgcttattgaccattctgttctgttctgttccttaaaggaacattttgttcgtttattggctttgtttgtttttggcttggctaaagtcaaacttgcatcctccatctgacctgagatgagagtcagctcaaatagggatacctggagactgctcacgcgtgcatggttcgggggtcaacatcggcagagttttgggcagaattcatacacagaagttggggcttcctgtcactgagtctcttctatctggattttcctcccttaatttccaacagctactgttgtcatgaactctgttctctgttctgtaaacaagcagtccccaaccttttggcaccagggactggtttcatggaaggcaatttttccacatattggggacggggatgatggtttgggggtgaaagtgttccagctcacataatcaggcgtttgttagattctcataaggaacgtgcgacctagatccctcgcatgtgaggatcacaattgggtttgtaggtttgtactttgtactcctataagagtctaatgccactgctgatctcacaagaggtggagctcaggcagtaatgctcacttgtcagaggcacatctcctgctgtccggccaggttcctaacaggccacagaccagtaccggtccatggccgaggagttggggacccctgctataagccaccaagactatgggttttcagtcagaatgtagtttcccatctggcactggttggtcctcttatcaggctgaaagccagaaaaatgggaaatttacccagtgtcaaattcttccaagtgtttagcctccagttttttgtttgtttgtttgttttggttttttggttttttttgagacagagtcttgctgttgtcagcccgggctggagtgcaatggcgagatcttggctcactgcaacctccgcctcccaggttccagcaattctcctgcctcagcctcccaagtagctgggattacacgtgtgcaccaccacagcaagctaatttttgtatatttagtagagacggggtttcaccatgttggccaggctggtcttgaactcctgacctcaggtgatctgcctacctcagcctacgaaagtgctgggattacaggtgtgagccattgtgcccggcccaggtttttcatgcattgaagttcacactccacattccccaggtagttgtttattatatgtggccaaaagtttatagcagttttctacaggagaattggtcaaacaggggctactcagctataccagaagtagtgtcttctgcactataaatttgaatggctttagaatattccattgtatgaacgaacacaccttcttttattaaccttgccttctatggatggttattcatattcttcttattgttctctgttatgataactttgcctctgacacaaaatcaacctcactgtgatgcatactggatgtggaactgaagcaagggacaatttatctgagctcaagcttgctcatctgtaaaatgggataattataataacagaaaatatgtgctttaatgagacttaaatggaaataatatttccaccaaatgcaagtagtaatttagtgaaacaatgtgtgcaaagtacctagcactctctggcatgtaattaactcaaattaggtgctacttggttctctttgtagttgtcattgttaccattatccttgctgcctacactcataaatgtataaataaaagattggagaacaaatggcatgtacgcaaatgtgtttcttcctttttataaataaacataccatgaggattttttatgtcagtcaagttgtttttgagaacatgattttaatgactgcataatatttatttggatgatccatggtgttggaaaataataagttacatatctaccttatataaatttctctggggaaacaagtcattaaaaacaagcttatttctaatttcagcctaatgctgatagacaatgtcaactggataaagttgagtcgcacatttcagtagctagaatgctttttaaaagtactttcacgtttggactaataaaaatgacatatctgtctcatcccttttcaaggaagctgaagtgcctcatcaaatttattttattaggatcccgacagcaatcttgtggcctgggtgaaggtcaaggaggttttgccttttgcagaagggagtaacaagtgatgtgatgataaagtgttctttctctctcggttcatccatggtgggaaagagcccttcagctcattcttcagttggaggtggttcagggccccatgttgctcaaattggtgatgacagccagctgtttggtcccaattcgctgagactaggaattcaaacccaggaaaattgagacacctgtgtatgaaaagcataaagagaaaatttggttgccctcatgctcactcttatgccaagtatttattcaagaattaaatgaataagaatagggatttcaactacgttctatcctcctcctcctcctgcatctgcctgaccttcttgggagccagatgttccactgaacactttgcatgcactgtgactatctaatgcaatccttgggacagatctgtgaaatagagtctgttattagtcccgttttaaagatgaggacactaagattcagatggtttaagtaacctgtccagtgtccacagctcctgtattagctgagagtcttgtgccattatatcagaaaagtctgcttgtgtcttacagtcttgatcagaaacaagtatatccctcagaacatagaggcggcaatggggggtgactttgttctaacccacaaggaagattattacatgaatagtatgggaatcttggcagaaaattagtgggttattttttagtccttattagtaaggactccaggcaagatagagttttgttttgtttttgtgtttttttttttttttttttttttttttgagacagagttttgctgttgttgcccaggcgggagtgcaatggtgcaatcttggctcaccgcaacctctgcctcccaggttcaaacgattcccctgcctcagcctcccgagtaactgggactacaggcatgcgccaccaggcccggctaattttttatttttagtacagacggggtttctccatgttggtcaggctggtctcgaactcccgacgtcaggtgatctgcccacctcagcctcccaaaatgctgggattataagcatgagccaccgcacctggcaagatagagtcttttaactttgaaaagttaggattcaaatcagtctagccattgaatcgtatttattgagcacctgctgtgtatcaacctcagtagaagacccaagagatatactggtgaatgggatagacatggtctatatttcagaggcctactagtatacagttgaagacgggcattgaacacaggatcacagctatgctaataggggtgttactgcagggccatccaacctagaacaaggatcatattaccagcgtttagagaatagggtatacacatgcttttaaatgcacagagtgtaccacttcagagaatactgatttctccttagtttgggctgctataacaataccagtgactgggtagtatagaaaacaaacatttatttctcccagttctggagaccagaagttacagatcaggtaccagcagggtagggtttttggggagacctgtcctcttggttcacagacagctgccttttcattgtaaactcacacagtaaagagagagagagagagagaaagagagagagagaaagagctcgcaaggatcatctccttagaatggtactaattccatcatcgggttccaccctcatgacctcatctaaacctaattacctttttttttttgagacagagtttggctcttgttgtccaggctggagtacagtggtgtgatctcggctcaccataacctccgcctcccaggttcaagcaatcctcctgcctcaggctcccaaattgctgggattacaggcatgcgccaccacgcccagctaattttctatttttagtagagacggggtttcttcatgttggtcaggctggtctcgaactcccaacctcaggtgatctgcccgcctcggcctcccaaagtgctgggattacaggcctgagccactgtgcccggccacctaattacttcttaatggcccaatctccaaatgttatcacattggggtttagggcttcaacatagtaatttggaggaggacacagaagttcagctcgtaacattccactctgccctctccccacacatttatgtctttctcacatgcaaaatgtattcattgcatctcaacagcccaaaaagtcttaactcgttccagcatcaattgtcaaacaagctagtacaggagttgaacattttccagattcagaaagatctccctgcccttaatcccagcattttggaaggctgaggcaggtggatcacttgaggtcaggagtttgagaccagcctggccaacatggtgaaaccctgtatctactaaaaataaaaataaaaaaaaaatagccaggtgtggtggtgggtacctgtaatccaaactatttggaaggctgaggcaggagaataggaggattgactgaacccgggaggcagaggttgcagtgagccaagaccatcgtgccactgcattccagcctgggcaacaagacaagactgtctcaacaacaacagaaaagaaataaaaacaccagaaagatctcactaaactggagcaatggactaaagcctcaaagaggaaatttcatttataaggttaggctgtagaagtaagtacagaatcaagagatttggcataagaaaaacctacgtggaaaagatcagaaaaagtccctcaagcacagagtcaatattaattagcaaagcattcggtgctgctgttttaacagcaacagtgaattcgcacgtttgtttttcaggccatgcaaagggaaaaatgatttatgtctattcccagacagtgtgttttaaacggtgtcttccctttcaagagacttttctagtaagaattttttttaatagggaaataagtaataactttgagagcaatttaacttgatcatgaatcagaatgattcagaaccacaaaagaagctgatattctttcatgttctctaaatatcttcactaaatgtaaagtaattggacatttataagaattcagactctcccataacaaaagtaataccaatcatgggttggtataggatgcacagttttaaatacagcatcttacttgattctcaaaatactcttgggagaagagcccaactggtgtttttatgtgtagtcactgtgtgtccacctgtttcagtaaagcattaggacaatttacataactctataccgtacagtataaacaaggctgtgatgaaatttgaaaggaagacaataaggataggagagctataaagaaggcaaaacaagtgaacacaattccaatctgtgtagtcctgcacatttgctggaggtggaacaaaatccttgcccccatgttatgcatatggaaattgagatttggagagattactgacatgcccagtatcacagagctagtgagtaacagagcccaaaacacatcagccccaccgaaattctgttgttttctctagtactctatgctgccttccaataacatgaaatatggaatttgtattggaaaagatgccaactcgcagagaaactcgatagaactatagttggaagtgtcttttcaatatgagcctctagctataaatggatgaaatttccactccctcaaagcttagaactttcttactcttagcagctcactagttgtttaacatacctaatattaaccatctggtcagggagctaaatacaatgaagggcatccagctattatcccacccatttgcctatcccaagttatgttttattaggttgagttgtcaattttaaataatcaagaaagatagctccaggtaagtctcactatctcgttaataaccctttaccaattgcagctgtttcgagaccagacctttgcaatgagtttagaaagctgctgtggacctatcataatttttactacactttgtggccacatgaactggcagaagaggctgtcctaaaatcctaatgtggcaaaaaccaattttcagaagtcaatttggatgttataggtagcgctcttcacacccaataaattgcttatctttggctttgaactgatgggcacgtacacaaaagattggagccaactgattgcattattagctgaggaaaaagtgtgtgactgtggcgaatttagcaaggggtagtctggagaaggatctgtgacctgggaaaagtttgttttgacgtggaaggtcaggagtttttgtttgtctcttgtgtccctttttacgttcatgtctgtccagaagtattcatcttctctttgtggtttaaatgccctgggcagctgaattactgtgtgacctcctattgtcagagcatctttgtggaggagaacccatcacctgtctctcgaaaacagttgtcctttgaactttcaagattatggggaaaaaatgtacttattttctcaatcatggagagcatgtcctttagagatacctttggctgcagatatgtgacacagctgatttaaaatagcttaagtacccaggtgcagtggctcatgcctgtaatcccaacacatccggaggctgaggtgggtggatcacctgaggttaggagtttgagaccggcctggccaacatggtgaaaccccgcctctactaaaaatataaaaattagccaggtgtggtggcagcacctgtaatcccagctactcaggaggctgaggcaggagaatcccttgaacccaggaggcagaggttgcagtgagccgagatcgcaccattgcactccagcctgggcaataagcacaaaacttcatctcaaaaaataaaataggttgagtaagtagaggtgtttttcttgcctaacgagaagtctcagtgtaggtgatgctgggtttggttcaactattcaacagtgctatgagaaattcaggctattcctctacttcatctcagcatccttaattgtctggctttaatcttcatagttttccccttatattggtctgttttcatgctgttgatagagacatagctgagactgggaagaaaaagaggtttaattggacttacagttccacatggctggggaggccctagaatcatgacagggggcaaaaggcacttctttcttggtggcggcaagggaacatgagaaagaagcaaaagcagaaacccctgataaacccatcagatgtcttgagatttattcactatcatgagaatagcacaggaaagaccagcccccaggattcaattacctcccctaggtccctcccacaacacgtgggaattctgggagatacagttcaagttgagatttgggtggggacacagtcaaaccatatcactcctcatggtgtgcaagatggctgatacatgtctagctatcatgtcagcaagactgggagaatgtggaaagggtgagccagccagccatgcttgtcctctttggaataagaaagtcttatcaaaaaccactagaagtctactgtttgtctctcataggccaggactgtgttatgacacagctatgcttagctgcaaaggaggctgacacagcaagcatttggctgttttatttgtgccttaaacaaaatacaagctctacagcaagaagaaggagagaaataaatgttagggagatgagcaaccatgtcactatgggttgtatagtcaaatacatatatttgggaaacgttattttcttgctgacagaacttctcagaggtctcaatatgctaagacacattgaagctcttgatggggaatagtcattatatttggcattttgccagagtaaacaaagaacccttaatttattctttagaatacctattaattcagaagtgttctgaatggcgtcatgaaatactatgttagtgccagctcacatcctttgctgagagagttaaacgtatttgtctcaaatcagcacagccttctacagctaaggcaggtgtactggctgctccaattgagaacaaacaaggcaccagggcctttgcatgtaccccatgatgaaaagatggtggcctaagtgcaaaatggttaatgaaataccaaactcagataccaggccactggtgtcttccagttcactacatgtttaaggcaaaaataagagagcggttttctcagacagagtcttgagactacaaaacagtcaagacatttccccaagcaaactcagaaaaatattaagcctagacaatgtagagcgttagtagttagggaatgcagtatttcaattccagatctaccatttataagctgtgtgtttttgggtaaggtactctgagacttagtgttctaatctgtaaaaggggataattccttccactggagttctaattaagactcattagggtgacgatggttgtaaagtgcttattgcagtacagtggagctgtttctgtcccagatcctttatcaaggattgagccaagcggaatccttgtctttgttagtccaaattggattccccattcctcaaggtcttgtatagcttaacttataactttcaaagcaagatatcctgacattgctgttttgaccttgacatttaaaccatgctttgaaattaagttttgtgtctttaccttgccagtagtatttgctccaagaagtaagtgcacaccaccagtctcaaattcagttcataatattgctgctaagaatgatgcacacaaaataaaacaagcaatggcaaaaactgggcacagtaaaatttgctggagataggaaattggctaaaagatcaaatattgctggcatcatgaaaaaccacaaaaaaatcctatgaagaattagacttggcagaaagaacgagagcaaaataaaattataatggccaaaactacatagaagaggttttattattgactagaaatcaatgcaaatataaaaaaagacttcctgtcaaaaatacacaaccgcaaaactggctttggcggactaaggctaccaaagaaaatccacaagtcagcagttgccattggtaaaatttaacttggcaaaaaacaatcaatgaaccaaatagttgacataaaatgtacacacagcacaattaatcctgatgaaaataattccagcaaagtaaaattgatttttttaattcagttgtttatgccatgtaggaaactgatcaatgacttaatttgacgtgataaagtttgctttgagaaacattggatgaacaatgttggaaaaagtctgactcattttattgctttgaaatatatataaaaagctagcaaggtccaaatgataggattaaaatatcctatactcattttaaatatacaatgcttagcaccagctggacacggtggctcacgcctgtaatcccagcactttgagaggccgaggcgggcagatcacgaggtcaggagttcgagaccagcctacccaacatgtcgaaaccctgtgtctactaaaaatacagagattagccaggtgcggtggcatgtgcctatagtcccagctactcaggaggctgatgcagcagactcacttgaacgcgggagccggaggtcacagcgagccaaaaccgtgtcattgcactccagcccgggcgacgaagcaagactccctccgtctcaaaaaaaaaaaaaaaaaaaaaaaaaagcctagcaccaaagtattagcaagttcctgttatttattaatgttctcatactttcattgaatttttaaacctaatgatgtttattttcaaacacttcagtccatttattattgaatataaaatgggtgctaattacaaatgggtcttatgtatgcccttgggttgtctagcaagatggtttcataggtagtaataagagcagcaagagaagaaaatagtgtggcctttacctttactgaacactcactttggaataggcctcatgcttgggactgcctccgtcagtgtgcagccttcagcggctacatttggaaatggtacaagtattaggttggcgcaaaaagtagttgcggttttgccactgaaagtaatggcaaatacttagaaatatttagaatatttagaaagtacctgctgttctgactatcttaattcagatgtgcactcaccttttggctcacgacaacaaaagccttcgaaattcctgcctgtttagtttgtgttgacacattgcagattcaactctgacatgttatttccttatgctgagggtgtcttgttgagtttcatgggttttgtgcttccctggtgccttattaggcttataactcacagagctatgagtttaaatgtcagggttgtcaccaaaacaatggagcaaaaagcaagttgttgacattctttggacgcaatttgcaatcccctttattttcctgtaacgtttttgtgtttccaggtgacagttgcccaccgaaccacagaaccacaaagcccagagttttagttacatactgctgctctaggatcagtagcccttaggtccaaaagccgtttctgatacagccttgggcaagctggttccttctctgagcctgggcccctgtcctataaagtaaaggtgttattacccttcataggattgttgtgagaacaaagtatttacattcttcatataatcagaacttttccaaaaacatgggatcttttacatggctcaacatgtttaaagctgtttatgttcatctgatattttaacattttgtagagtagaaaatgcttcaagcaaataaatgagctttatggtaattttttttgccagcatttagaagctggtggttaataaatactaatatgtatttagaagtttagaacagagatttttcagcaacaaccacaggctagatatagcccactacctgtttttgtcaataaagctttaatggaacataagcatggccattcattaatatatgatcaatagattttttttggtacaagggcagaattgagtagttgcaatacaaacagtgtggattacaatgcctaaaatatttactacctggttctttatagacaaaatttacagactcctgaggcagggttttatcaattcctttccatgtctatggatttagatataagcgtatattttgttaaatattacagcagactttgaggtggctatcatctccattttacagatgtagaggatcaggctcacaggtagtgaatggcagaaccaaggatgaattccagcccactaacgtcacatctctatttgatcattagcgtatagacttttggtccttcataaattttactttataaagatattttacgttgtataattgatgtcatggccatattgtttaatcatcactcaccatgcacctattgtgtggcaggcactattctatccattagggcacaatagtgaacgaaaaacttgctgccatcagagaacttgtgttctgggctttcatgcacctgccttgcaggcgtcaggaatctgaatcacactcattccctccatcacttggctcaccagtgggaccagacaggagtcctgcagtttcagcaatgaaccccagggcttggtgcctgctctggaggtggggaatggggttcacagtttagtggaagattgcctttagggagcactcttggtttctagaacctgatatagatgagggatgtaatgaattcgagtctgaatgtttatttgccatggacttctatctcacgactttgctataagggctacacgtcggaaatgggatctaagtaaacgtagagtccacaagtttcaggacttatatagatgagtgaatctcagattttcacgtgcatacagattacctgaggatcttgtaaaaaatgtagtttctgatttcaagtctctgggatagggcctaggactcagcatttataacgacatcctaagagatgctctgaggaccatactttgcatagcaagaaatgagaacagtccaggagcctctaagatccctcacatttgaggctagaagcatgtaacatgaatgggttctcaaacctaaaagtcagggcttgggcataaactaaaactgtgatcacctcgcgtagatttgaggctttgactggtcgtcaaccccacccacaaaagcctacagcttcctcctaccccaggtcccagcttctccacttctctccaactacctcccacttttcctcaatttcaggctctttcgtgcctccagcccagtctacagcatgttccctggttcagaccatcccaatcagacccctatagagatgccaagccattcgtttgtgggccgggcacggtggctcatgcctgtaatcccagcactttgggaggccgaggcgggcagatcatgaggtcaggagttggagaccagcccgaccaatatggtgagaccctgtctctactaaaaatacaaaaatgagttgggcatggtggtgcacccctgtaatcccagccacttgggaggctgaggcgggagaatcgcttgaacccaggaggcagaggttgcagtgagtcgagatcgcgtcattgcactccagactgggcgacaaagcgaaactgcatctcaaaaaaaaaaaaaaaaataagtgcttgtctctgctcaaagagaagtcagaaatggcagcaacattcctagcccaggctctgcactctcggtaatccctctgactgactctcaagtcttccccgtctgtctgctccgactgcacgagttggtgattaaactttaaaacaacaattagacccttgattttcaaagcaaacttggtttatagaccagacttcagcattcattacaatacagactaataaaaacaaatccggaaacatacgctttttaagctgtggtggtgtgaaatctgtaacagcattaaaaccattttgaaaaaaaaaaagtcatttgggaacccccagcaaaatactgtgtggatattcttttctattcctcattcaagtatattgcatatatataaacataatatatatgtttgttactgtaatttttctacttattatataacattttctatgttgctacatgatctttgtaaatattatttttaaagactgtacaatatttcatgtagttgacaagccacaatatttgtaaacataaaacatttctcccctgggaaatattttagtgatctccttcttcctttctctctcttcttctttcttccttctttccttcctttcttttctccttctcctcctctttgcttttccccctactccctttttctccatcttctgctatcagaaaaaaaaaaattccatgagcacttggtaaccatctactttatgttgaattatttcctagggtaaattctcagtcagtagtaggaggcatatttttcccattcaatgtagtttgagaagcccaatgaccaaatcatgagatgttgccattctctatgaaaatcacaaaggatgactccctaaatacattttatgtctacagagaaactgtataattctgacattaatttcagttccttacaactgccttcattccttggggagggtactgaaatgagctccagctggagactaagtcagctcaagccactaagtcatgggctggtcttgcacaaattattttctgtttctctgtttctgtaagcttacaatttatatattgtatattttataaacatacctcatcagataaggttatagtgaaaaatatatctgctagggtattcacttcataagggaaggcttttttgtctgttttgttcactacatactatatccccagcatctatagcagtgcctggcacatggtgggtgtataataactgtttgtttcatgattcattttttaaaagatctagaaaaagaaatctttactccaaagggtttgaagcagtgattcataagtattttaagaataaatgtatctttcacacctgtgtgcctataaatataatttcacaaataattctagtaagttcagagaatctagaaatttttttctgtgcataccaggcaatgctggcattaaaaatttattttgaaaatcctctaagttctaattcacttgacattatcctaccaagttaaagaaccatgaaataataagtaattcatatcactgcattcatttctcattatggactgtcaaaattgacattcttgttcccgttttatagaagcaaatcttagactcagaaaatttcaaagaacttatccaaagtgacacaattcttcaatagagagcagggactacaacctaaattttctaattcaagtccagtagggtctgccttaaatgcctcccactgtcaccgtgttgatttgtataacctttgtcttcctagcatttgattgacggctactgttagtacagatcatctgggctccttgtagtgatggacacattttcatgaggcaaggtcttagatgattaaaacaaggcagatgctaatgccatcctcaccttcatctggaactgtctaactagagttcgttaacttgtcagccctagttccttttgagcaccaggctgatataataaaatattgcaaatcaatagaagctttaaagaagcttcatctgtctttctttgttacttttttcctttcttcttcttttattactacttctttctttgccgctttaaagggaaaactgctatccctcttattggctgtacaattctgttttctctgtttattttgagttgttggaaattcaggtacatccaggttttcccaaatacacctattattaccccaaagagtaggaagccgatcttatctagattcactcaccaaatctagaatctcccaagagactccaaatttagtacattaatttttcttaagtataacattgctcagtaactatgtgggtgaagatctgaaagttctgcagcactgtttcatttataaaaataaaggtaacggtacttttgcgcaagatttgtgtggaatctaaaaacttccccaagttagtaaggaaggcactgtgatagtatctactaatgaaaatgtgagcacagagatggttataaaataccttatttttctcttcttcattattattgctcatttcatttgattagcaatttctagactcactcaacctccatctataaaagaaaccattagtctttgcctatgtctgctaaagcgaacttcttgttctgtctcatcttcattccctactcagtttctgtcttctccagcccttcttacattattgaaataattgactctatcaggtggatttctccagttgaacacatttggatttgtcctgtggaaacaccataagtacttttttttttttttttttttttttttttttttttttttgaggtggagtcttcgtcttttgccccggctggagtgccgtgagtggcacagtctaggctgactgcaacctccacctcccgggttcaagcgattctcctgcctcagcctactgagtagctgggattataggcacccaccaccatgcctggctaattttttgtatttttagtagagatgggatttcaccgtgttggccagcctggtctcgaactcctgacctcaggtgatccacctacctcggcctcccaaagtgctgggattacaggcatgaaccactgctcccagcccaccataagtactttaatatgctaatttatttcaaacaatatgggaatcagttcaaagcacatagtctcttccatgcacatcttcatgccggaatttgctaggcgcttgtacctccactcccttcttctcagtcctttgtccaaggaattcttccctcaaagagttctcagtcggaaagcatgtataagacaagaaaataaatggataccaaaatcaacaagtgaagtaaattcccagaaagcacttgcaatagtatatgataagaagtgggaactccgtaaaagaggcagaaaggaaatacctgaaaaggttaagcaagcgagtaatagcctggagagaagagttacagaaatgtttcatagaaaaggtgatctttgaggtgagcttttatgaataggcaaaatttgggtaaagaggtagacccatttttaagagcagggtgacatgaaaatctcaggatatattactcagcaattaatcctcattgttgtaacaaatagttacaaaattctcgttgcatggctctggcttaactgcaaagcaaagtagaaaatggagaagctcccaggcaaggccaacaacgcctggtctgtgctgcacgtgaagatatctgagcacttgtgacccctgctttgccctctttgtcattgcaatggggttactgggaaagcctctcccatggtggttgacaagagggaaactttgggaaatgttctcaggagtaacccacattattttcacgcctgaaagatgcaaggttggatagagagagaagttgggctgtggtacgcttacaacagagatctcaactgaccctgcagagagctttaagatgaggagaacccttctgtgttgtccttactcaggacaaggagctgaggtcttatgcctccacattgactagtcattgaatgtaggctcatttcaggaagggagtataatcttgggagaggtgctgtcttcagcagaaggcaaggcctcttagtttatagctgtcagcctccaacttcccagtggctgaaagaatgaatgcttcagttccaaataaagggatctgagcagcaaatcccatcgtcctgtattttcattgaagtagcatttcataaccagtaacaactgtcttcccctgaaagtgtggtttaaatttaaagttggtgacttccttctgacttgtcaaggcgtgggcatacgcaattttttcctctatggttatagcttccaaactgttagctatatagatacctactttttaagataagtgagacctcaatcacaattaactctgtaagttattgaaaaccggtttgatgatgatcatcatcatcctgtgtacaccttgtgtgagcttgaggtcctattgtaggattaatcatcagagcagtatctgcagtctgcagtgcatttcttcttctttatttgtttagaaaaatcccactcttcctcccaaaattaactttattgtcaacttgataagaagatttctgaacagaaataaaataaccctgatttgtggtgtttgccaattactgtggtataaatactcacactgtggctgatgccaagctacaaacatgacatcatggaattggaagaaatagtaaaaatcatttataccttctccaaaacactcactgttcccaaaactttcacctcaataattctgtccactggtatatcaacatggtactggtgtagtaatgatccattccaggtacggacaaaaaaagataaataaaacaacaaaaaacttactaaatgccatatggttttatcatcttgtgctggcaatttgtaaacatcatcagtgataaagtacttctcccaaatgggatgaatcatacctatcctcaccctgcttttggacactggtatatcctctcaaaggcattaataactatgttataatgcaaatatcacgttatctttctatgatttttctaacccaatagactgtgagttcttcaagcttatgtatttgggtacagaacacctcgccaaaatccttggcatatggtagatgctcaacacaggtgcactaacttgttagttgaagtgaccggtacaacctagttaactgaatcagaaccatgaattcagaggatagtagtaaaaaatcaagttcatgaagtttttaatgagcagtatgttttgcctaagactctatgattctcactgtggaatgaaccacatagactccagaatgtgtcttttcttaaaggcaatagaggcatgcagtgaataaaatgcactgagagaagcccataaaacaatattcgtaagtacagagaaaggcaatattaatgccaatttcaggggatctgttcaagttcaccggaaggcagagtttttagcaattttttaaaggttgaacatgtctttaggaggtagcaacaagacaaaggtccaggaagagggtgtgatgcagtggggaagcatgcagtcaccttgtgccgaacttaacaggtcaagaactccgtatgtgaataatggtggaaatatgtggagttacaggtacaactctgtaagggcattagcctgtaccagctatcattgcgtaccaggctatgtgtggactttgtccttgtgaatctggtaaaagttaatcatcaggtctcaggagttcagcaaccgaccatcatgagctatatagtattagtctgcagctctacctgagagcagcccagaaaccaaataggaatatatcagacattatcccagagagaaggctcagtcaaggatctgcagctgggacctgcatatcttaattcccctgttcctgggaaagttatccaatagctactgaaatacaagatggaaggtatcctctctgtaccatagctaaaggattgctcacaaaaatgaaagtgcaattacagaaaaattatccttgggctatgaccacatctcctgagtattttattgccaccacgactcatgatttcaattctcaggactgagtatctctgctgaacgcaaatttaaattcttaatatgagaagctgcgctttccagtcgtgtgtcaatgcaaagtgagcggatttgggtttaactcccttggactgagtgcaattatatgttgggaggggactaacaaggtagcccatgtaacaatactgtcgtaattatgtgcaatattttcatttttacttctgatcaaccgcaagagtagattgaatgctattgttcagtttgcacttaaaaatgatgatttttttatacctggagtttaacatctgagtttttgtttaaaggaaaaattgtccttgcctttgaaagttagggtcatgttaaaatatttactaattctcataaaatattttttttctgagcacggttgaaaataaaaatatcttggtcctgtcctttgaataatgtcaagattgagtgtacctctggagaaatattgatagagactcaaagcaataccactctcccttgtcacttttctctgtgtactgtggacaagttgctcaacctcattcaaactcagtttttctcaacaaaatttgatatcaccataaaggaggagactcggttgcctttgtttttattattaaaaggaagcattgagtctaactgatatgaaacatttctgtatatgcctaagaacttatgaagctcataggataagaattcttggcaatccaaataatctcacattgtctctaatctgttataatgctgctcttgcctcataacttttgttctttgtattccttaaaaagacctaagagagctcaagattatggggtgctgccaaatataacactagtcttctatttttatttttaaataaaactttgtaattggtaaagtcacagaatcagtgtgcatatgatcaaagtctataaaataatgaaccatgcataattgcagcagagttaccaaggaaggctgtaaggatgatctcactggtgcagccaataccccagtaatcaatatggatgcctgggtgacaactccttccttcctaactttcacagcttgcctgactgggatagccaaggaaggcatctgtgaagaggcagcatctttagagtttatgtgggaagtgcactctaggtaagacagatgctatatacaaaagcaggaaaatgtaaaatttgttcgtaaagagcaactagttgcatttgatctaaagtagatgattccagtacaaaaaggaaattacagaagttttctcagctccaattttagagagcctttaatatcatgctaagagggtagagtagaccacattccacaaagaagaaacagtattttatttgttcattccttcttacaaaaaatatccacctagtacctactctgtactagcttaaaggtaacttttgaaaaaaaaaattttataatgcctagtcaagaagcatatctggatggaatgaaggagaatgagacttcagggcaggaaagaaggcaagttaggatactattgggatggtccagataagagagagcaccgtctgaagggtctggcttataacaaagaggaaataatctttgagaccaaacagaaaagtgtagcctcaagaaatattctttgtcatcctagtggttgctttagaatttgtagtatacatctttaacttatcacagttcgtgttaaataatattatagcatttcatatatggtataagaaccttacagtaaaacactttcattttctcctttcccagcctttgcactactgctcctctggtttttagttgctcataggttgtaaactctacattacattgctattattttttactttaaacaatcaattttccttctaaacatagaaaaaggcatatttttccacatatacaccactttctgtgctcttcattcctttgtgtagattcatatatccatccaacattatttttggtttggatgaaggactattgaacatttcttacaatgaggttctgctggtgatgaattccttcgccttttgtatgtgcatctgaaaaagtcttacttttgctttcaataatgggagatatcttcactggatacagaattctgagttgacaaattttatttttctttgagcatttcaacggttcactccattatcttctgacttgcattgttgctaacaagacatctgctgtcattcttctctttttcctctgtgtgccatgtgtcttcttccctctagctgctctcaagaatttatttttattagtggttttgagcaatttgattatgataagaaacatttttgagtggagaatcaagggaaggttgaaacagataagacgtcaatgctgggaaaaaaggttaattgtgagactggttgttccttatttgagcctgataataacaatctcttcaggtacaggacaaatgtcatgacagaatgcactttaaaagaaaaataatagctaacacttgaagattgctatatatacctatgtgtgtgggtgtgtatgtatacatacacatatacatatatatgcacatacacacccacacacacatacataaagatagtgttcatacatataagatctaacttctaagatatataagatcctattctaacatatttaatatgttgcatatattagaatatatatttgaacagtatctcatacaaagtatgtttacacaaagtaggtgctctttaaatgttaactattacataaatgtacacacacacattttacactaaaaacaattctatgatgtaggtagtatgataatcttcattttacacattttttttaagatggagtttcactcttgtcacccaggctggagtgcaacggtgcaatctcagctcattgcagcctccgcctcctgggttcaagtgattctcctgcctcagcctccagagtagctgggattacaggcacctggcaccatgcctggctaatttttgcatttttagtagagacagggttttgccatgttggccaggctggtctcgaagtcctaacctcatgtgatctacctaactcagcctcccaaagtgctgggattataggtgtgagccaccgtgccgggcctctacatattacttctaatccttaacataacagcccatgattccactctttcaatctcgtttcttttaactttgaaccattctttgccaattactttacctacctgtgtctcagtttcttcatttgcatcatgaagctaataataaaaccaaaaggctgttttgagtattaaatgagataattcatttgaaaagtgctcagcatagcgccagacgcgggagagcactcagtaagagtgaggaggtggtactgttatcgctgctgttttatgctttcttctgcctgcgagttcccacttggttcattcaaagcacccacactgtcctacaaagccaagttagcatgcagcctactgccctgatcatgcagtcacaatctctgtttctgctaacagtcagtaaacacaatttagcatctcgatgggtttcattgctccacataggctcatttagacttttcaactagattaactcatcactcattcaattcgtgtgctgtctgaggacacaccaggtgccaaggactgttctggtttactagggttagaaaggtaaataagaaagataaaaattaaatccctgcctcatggatcttatgtatgggggtgggggagacaaacaaaaataatataaataagtaaaatatgtggtatgatagatgaaaacaagggacatagatacaaataaagcacagaagggaaataggaagtgttggggataccatatattttggataccgaggtcaaatttcactgtgtgggcaggattatctcacccatttcagaagagaggaaactgatgctcagagaagggtggtgaattttttcatttcatgcagcattggtttagagacaagatagaaatcaagattctccaacttacagtccaagacatatttctgtagcgggcagaagctgaactctatttgtgctcctaggtggaaaacaatggtcctgtagtcctcatcaccatttcccatgtctgaaactgtctttgtctacctcttttcagttcttctcaacttcataacctattcttgctgtatctaaaaagcattaatgatccactggcataagaattttgggttagctcaagccaggtaggatagacttgaccatatgttcgtgcaagttacaaacagccatccccttagggtatacacttgcagcacccatgggtgtgtggttgcagaacacagggtaaatttcagccctcagccacttcctgcagggacttttgtacagcgtacaacctttaccaccataaatggaggctttttgtatttcacacatcatttaactagtgaaagttgcataatagatactcagtgaatcatggatgattgaattctttctcatttttcatttcctatatgattcagatcctttatatttcagttcatggtaaaggacaaaaattatttgtcaaatattgattgagcacctactatatgccagacactggtctaggcacaggggtacagctgtggaaaactgacaaaaatccctgcatttatggggcttacatttataatatatatttatatatcatttgtctcttcttaatagaaaagtatatagaggtatgtatatatacatacatgcacatatactatatactataagtatatatacttatgtatacatatacatatacagatatatactttatgtgtattatatatagtgtattgtatacatgtttatatactatatatgtgtagtatatatagaacaccatatatatgcttatatactctatgtctattatatatagtaatgtatatatttagtatgttagattgtgatattgccaaaaaaaaaaagagtaaaataaagcacaggaggggaaatgaagtttgaaggatgttttagaaatactgggtagaggctgggcgtggtggctaatgcctctaagcccagcactttgggagaccgaggtgggtggaatcacatgaggtcaggagttcgagaccagcctggctaacatggccaaaccccatctctactaaaaatacaaaaattagctgggtgtcgttttgcatgcatgtcatcccagctactgaggaggctgaggaaggataatcaattgaacctgggaggcagaggttgcagtaagccgagatcgtgcccctgcactccagcctgggagagagagtgagatttcatctcaataaggaaatagtgggtagagtggccaggacagggctcatggagtaggtgacttgtgaggaaaggtctgaggaaagtgaaagaactgctgtggaagacagaaccaaggccccaggattgttcacattctactccttggaacctgtgaatgtgttaccttatatggccaaatagactttgcaaatgtgattcaagttaaggattttggattatgttgatgggtccaatgttatcaccagggtccttatgagagggaggtaatgtgtcagagccagaaagggatttgaagatgctacgctcctggctttgaagatgaaggaagggtccatgagccaaggaatgcaggcagcctttaacagttggagaaggcaaggataccttctggtgtacatcttccagaaggaacacagttctgatgacaccttgattttagcacaggaaggtctgtttgggacattcgaccccagaaatgtaagataataaatgtgtgttgttttaagtcgctgagtttgttatgacttgttatagcagccattggaaactaatacagcaattctgtggctatctggcggaagagatacccaggcagggagaccagcaaatctgcaggctctgaagtgggggtgggtctggtgtgctccaggatgccagtgtgcctggactgagctggagtgagtcaggggagcttgcagtaacaggggcagagtgcagatgacatgagattacatgacacactgtaacccggaacaaggacactggcttcactccaggtgctaggagatcgcactggaagctacgaagcagaggagggacatcacccagttcacgtttcaacaggaccgctctggccaccctgggggagggtggtgaggaagaggatgtagaggtatagtcaggagatgtggagcagttaggaggattgtgttttgatccaggaaaagatgattttggcttggagcaaggtggtgggaattggataagggtaagagggtaagaaatagttatattgtgaatgtattttgaagatggaggtcattaaccagaaaagggtaaatgtgatacatgtaggctgaactggaagagacagtgaataaaattcctttgctaattaaactttcttttttttttttctttttctttttttttttctttttcttttttttttttttttttttttgaggtggagtcctgctctgtcacccaggttggagtgcagtggcacaatctcagctcactgcagcctctgcctccctggttcaaacaattttcctgcctcagcttccgaagtagctgggattacaggagtgtgccaccacgcccagctaatttttgtatctttagtagagatggggttccaccatgttggctaggctggtctcaaactcctgatctcaagtgatccacccacctcaacctcccaaagtactgagattacaggcgttaactgaactttttttttttttttttttttgagacagtctggctctgttgcccgggatgaagtgctgtggcgtgaactcagctctcactgcaaccagtgcctccaggttcaagcaattctcctgcctcagcctactgagtagctgggactacaggcacgtgccaccacgcccggctgatttttatatttttagtagagatggggtttcaccatgttggccaggctggtgtcgaactcctgacctcaagtgatccacccacctcggcctcccaaagtactgagattacaggcatgagccaccgtgcccggctaattaaacttttaatgtggaaagacagcacatgcaggagataagaggtagagtgggtgatggtccaggctctgagcggaatggcctgtgttcaaatgctggcttctctaacttaccagaattacgtatgtccttgagcagagtgtttaaccttcctgtgcctcactttcctcatctgtagtatgggatacatcacagaaattgtgtatcaaagggggaaaatgtttgcaagacttagtgcctaattcacagtaagtgctcaaaaaatgcacacagtaagtgctctgtcattttctagaacacattgatgtttaaaaaaattttcctacttgtaaaacagtcaaagagttcagtgtgaagtatttgcaaaaaatttgaaataaaaaattactcctttcctgtggggcaagttcacagaatagctggtatgctgacaattttctcttggtcccataatagtttttcagagtttcattataaaatagttgctgtatttgccaatgcagactttgaagaaggagactgatccttctggcttttaaagaagaatgagtattacacgaccattgaatatttataacactctcttctctttttaaagctgttgttgttttaccatcctaacatcaaaaccactgggcccagggaaacctcagatgtgggagaatatcaaatgtggaacttttccttgtttttcctggtggatctgacacaccttggaaccttcaaagaacacagtaatcaatgacgtggggagacgtgagacatcgcatacattattgtgaagaatttattaatgtaaactgcatggtgtggaatagaggttggggctgaatgaaaatgtgaggctctgtaatgcgacaaaaaacacagagcagagagaagagagaggccaatgaaagacactttgctgatttgggacttcactaaagagagccacataaaagagaaattattgtttaagtaggttaaggcaaccctagtgttttaattaaaatgtctttagcaaaaaaggaagaagaatagtacttgaggtttggggaaggcttcagtgaaagaagaaatgtaccaggcggtggcgggggtgggcgggggaaatagtgtaatttaggttaaatattgtgaataactccccaagccgaataatgttgaatttcagtcgtaggagatatttaagaattggttgaacaaagggggcaattgactttggtggttagtgtgggagacagctttctaattttagagtttgcagccataacattatgaagctaacgaacaaaaacaagccatgtagataaaaccaggagaaataaggatctgaaaaatggaccaaatcgatcgagttctggcaatgagtgcttccttttcgtaaatacaagggcagtgctctgcatcttctccctctctcattttctctgagaaaggaacgtgccattcttttttctctctctcttttggcattcctttttttaacttttaagttccggggtacacgcacaggatgtgcaggtttgttacataggtaaacgtgtgccatggcggtttgctgcacccgtcaacccatcacctagatatgaagcccagcatgcattagctattttaagaggaggatcgatttcaccctttttggaaaactcaatctggggcctgctttccccaggatcaccgtaagattctacctgaggagctgagttttcctaagaatgaaaaagcaaagagacccctggttttgtatttgatacaaagtcaaacgctgtttttctctgagtctgtcctggaataatccagtgacatccaccatcatctgcatctcccatggaaccaccacatgtgaagtcgaggctgagcgcagggtggctgcaccatccacatcaacagccagcactgccttctgccagtttatgaggcaattcggctgccagggagaggagaacagtgtcccttccaatccgatgagtaaatgcctcaggtgttaggtaaaaccccaaggtttttctcttctctggggccaccctcaggaaaggaaaactccaaaaacttctttgggaaaaagaaaaaagaggttgccatgtgatattagatggcatgaattaaatagatactacttattaaagttaaaaaaaaaataaagcctgcatttgcatggtaatgggacctggcagatgaaaccagaaattgatagaaaccacccccaaatcatcatctaacctgtactgaagaatgacgcacataatgtacaacaggcagccattgtcatgtgtgtgtatgtctgtgtgtatctgtgttatcaggcaggtagtgaagaccaggagggagaaagtagtgagtcagcgaagatggtatcccagttagagaaacgacacaatgaaggcatgaagtcatgagacagtgtggcatgtttgggcaacacagatgtggttgggaccacaaaagttgtgatcaaggaaatgtgttggaacaatgtccgccttcacaagattaaatttgtttccagtgatgattttattccactggtgggttatttgtcaatatgttacaggacttttaaaatgttcataacctttgatccagtaacacctcttttgctaatctattctaaggaattctcattacagaaaaacaagcaaaagcaaatgaaactctacctacaacgtcactttatttgcctttcatttatagtaagaaacaattggaagcacttaacatacaagcaggccaggcaccatggctcatgcctgtaatcccagcactttgggaggccaaggcaagtggatcatgaggtcaggagttcgagacgagcctggccaacgttgtgaaaccctgtctctactaaagatacaaaaaaaattagctgggcatggtggcatgtgcctgtaatcccagctacctgggaggctgaggcaggagaataactagaatccaggaagcagaggttgcggtgggccgagatcacgccattgcactccagcctgggcgacaaggcgagactccacctcaaacaaaacaaaacaaaacaatacaaaacaaaaaaacaagcatatcaagggaatgatttaatacatgttgatacatccacaagatgtattgtgccgcaactaaaattatgtttacagaatctttgacgtgggaggaaagaaaacttgggaagtatcattaggttcaaaaaccaaaatacaaaactgctcacacccttccacttcaacttaaacaaaaagtatattacaacctggaaggaagtccactaaaatgctattctgtttgtctgatacaggatggtaaataaatttacttttcttctgtgttttaatatattttttggagtttctctgatgaacctattctatgtggatgattttttttttaaaaaagtataatctggtgtggcagtatgagcccaacatatagtgcatccctcctaccgaatgctaagctaaaactctgggcagacacacactcaagtgcatgcacaccccacacacagacagacagacacacacacacatttgaaaaatgtgaagagcaaaccaaagcagttgggtaggtggattgaagagagtcaaaacttggagaggtgatttcactgagaagagtttcctacattaggttatttttttcttcttaggctttgccttgggactgggttctagtcatactgcagggggttggccaggcaggtagctaagagtcccgttgaatttccaaccttctggccagagaaaccaggaaaagggacccctatggggaaattttgaaaaagagttcgttggggttggtggtggttgtggtggtggtggtggtggtgattctctcctcagctagtataaatagtttggtacataataggtgctcaataaatacttgttgactaaatgaattaaatttttgagaaaaaaatccaccttggagattgacacactatcttccaggtagaccaatgcagccttctttccagtacaggacaagttctgtttctccactggacaccagaggaagtagtttgcatttaggagggtttcatctgaaaaatagggaaactcctatgtttacacactagagtcctcttcagtgcaatgagcattcacagtatgagaggctgaggaactgaaaacaggtgaagagacagctgaattctctttctctctgtgtattgattctggagcatttgcgtagtgagtggaattttaggtgggttttttttttttttttacaatcacataattcattcctctgactctttgtccctcctcttttcttttcttttttcttttcttttccttttgcttttcttttcttgagacggcatctcgctctgttgcccaggctggagtgcattggtgtgatctcggctcactgcaacatccgcctgctggattcaagcaattccctgcctcagcctcccgattagcaggaattacaggtgcctgccaccacagccacccagctaatttttgtatttttagtagagacggggtttcaccatcttggacaggctggtcttgactccctgacctcgtgatccacccaccttggcctcccaaagtgctgggattacagacatgagccaccgcgcccagcccctctttttctttttatctctttctcttccttcattccccgggtatgtagttaaggccatggttgtgaagtatccgcatgatgcatctccactatacaccgtgcttgtggcaatggaggaggcaaaggaccacagaggaaggacccttaggtggaaaagccaactctgtccatgccccacctgtaaatgtttgtgttgcagaactttccccttagttcagctaaaactgagttcttgtcaaacaaccaggaaagactgggctcacagccacataaaagggtgagaaacagaagttattggacaaaaaggaataataactctcagcaaagcgagaaagggtcctgcttgcaggtctcccgcctcatagattgaatcccaggttaccacagaaacaagagaggccaggctcctccccactgcaaagggcacaaacttccttaggctccaccccatcctcccagtgcacaggtgggcattatatagaaagagttggtcgggaaagggtgggcttcatccaggaccagcagtccagtttttcagccttcaggctattttaggctcgaaggcagggttttgctggggacccttggctgtctcttgtctgtatcacttaggctttgcagttagaacacatcaggccagtctctgcatttatttgccttatcacaagcctagagaatgtgtacccatccctaggagagtcctcagtaaatgactgatgggagctgggatataaatcccccagctcccttgcccttccgagtcacaggttctgccctgcctcctggaattctccagtgggaatgtacttgttaatgcttccctcatcagctcccttcccctccctgcctcacttcctcattctcctgcccacatttcctgggatgacccaccaataaagtacttgctgttaaatcctcaatcttagggtctgctcctggggagcacagactaagagtattgaggtcctggttgtcctgattctactatccagtgggctcatgtacaaaaaggaaaccagaagtcacgaggatccctcaggtggcctacagtaaagcagggaaaagatgaggatcatagcagggaatgtggtcataaagagggaagggatggattcctgggaaattttcccaggtggaatctgtaggacttggcaaccgctcgtgagtgcagtatggtgggaaccaaagaagcctttcatacgatgtgagtgtctaacccctcaactgctgagaaaagggatgcaggaaaccccatggctttggaaggagtaagtgggaagggccggattttcagttaagtttaggatatgttgagttttaggtgcctgtggatagtcatgtatcatttatggtgacagtgccacagggaaggtatgtgtcaaacccctaataaatacccactgaattgaaaataattctttttccaagtgcgggttttctaacaggggccagccagacatttatgagctcaggcagatgaggaaagcatgatacctggatcacgtgtgctcacatctggaatacatgcgcaaattaacacagctgtggaggcaggagtacatatgtgtattagaaaaacaagccccacctgtagagcgctgcaagatgcctccagctggtcacaagtagctattgaacatgaatattttatcagtgccagagcagatagagggaaactgtatccattatattctcatcaccatcacatgtggttgaacgggcttccgactaaagaatctaaacatgtttaaaacatttttcacctccagtaaaactagcaagtcttgatttgtgttgttattgctcctgctagattcgtgaaatatttcagaggcaattgcatcttggaagtgtggtttggcaaattttcatccaaagcgtatgtttttgttttattttttaactagcggttcaaacgtggggaagttgacattttagagcaaatggtagaatatgtggggttattttctgttgctgtttcatttttaggttcaacttttcaaatatagagctggattaagtctcactagtagcagaaaacaaagtctgtttaagtaaatgtgttttcaggatggcccaactgtacagaaacttgcagatctcacgttctgatcactccatcaactgctgcttctttaaaatactcaagagtcacttacgatgtttaattggcatgtctgtctttcaaaatgaaaagctacagggtagcttgtgttaaccacacaacagctggttttggtcacttggtaggtgacaatccagtgaccacaaccaaggaggatttaacaagggattttatgccttgcaatgcggaagagcactggggaaagttcccgaaggggtgcctcccagaacacaaatgaaaacagggcttttactgggctggcgagctgagtcactgtatgtagaggtgtagtgaaggcagcacatgctcagtcaccgatcatgctgctacatacttgtacatacttactgtctatacattactcactcatgtataggcagtggtgaataagctcctccctgggcctggttagtagtatggtaatacagatagataaccgaagtacatttccaactcagacatctctggatccaaccagcttttgttttgccagggtcgggcttctttctgaaatttttgaaacaaaaaaaaccaaggtgtgacagttacaaggggctacttcttcacagtgcataccccaaaaccttgggaccctggagcatacccccaaaaccctgggaccttgggttagacttggacttttcctgttttcttgttactcagcaaccaccacaatgcctggtccgtggaaaatggtcaataaatatctgttggctggataaattaatccctaaatgtatgtattaggttgttgcaaaaaaaaaaaaaaaaaaaattagccgggcgtggtgtcgggtgcctgtagtcccagctactcgggaggctgaggcaggagaatggcgtgaacccgggaggcggagcttgcagtgagccgagatgacgccactgcactccagcctgggcgacagagcgggactccgtctcaaaaaaaaaagaaaaaaatagaaatggcaaggaataaaatttgccttcaatgtgcttatggtcttgggaggagtagagtaaaaaaaatccctaatttctattgatataatatcattggatagtgccatgatagaagaatgtcccatgtgcagtgagaatctagagagaaaataagtgattacacttaaagtagagagtcagggaagacttcctgggagaggtgacatttagactaaagcataaataatattgatttgtttgccaaatggaggaagcaaagaaggatcctgagtgaaagcatgatgtgtctgaggatttgcaagtcgatcatgaggttgcagcatacatcacatgggagagagttgctgactcttcaggagagcagatcatggtatgctaggacaatcagagtctccactagagcatatgaagggcttaacataagggagtgtcataattacatttatgtttggtcagagcactcaggcattggattggagaatggagttgagatgagaagcagtgaagcacttgctgtagccatcataaaaacctggatcatatcaatagatcgtcataacttggcttcaacaagaattcataaaaccaactcctctctatttcatagtttcatcattttatggaatatcaaaaacctaaagagaaagagaaataaaaataaactatatgaacttctccctgatgaagcattcagtcttgttttcctggatctcatgcatgttaaatacatatttagatctaagccactatatcaaggaagtgaaaaactcttattccttaaatatcaatatgtgcacaaattttcttatacccacataattttagtaaaactttggagaaaaaagtttccagagttctagggctttgttccatttttggaaacagtaattttagaactctctgctttgctttacttattcattttatctcccgctgggtttccttcttgatttctatacctttgtgtctgcattaattaatttttctttcatttattcacacatgcaaccattgtgtatttggtctatgtatcagttagggcaggctaattactctagcaaaccagcagttaacaagaaaccaatcccgttggcagggaactgcactgtgtgaagacattcagagatccaggctccatctatcctaaagcaagcaaacaggctttgagagggagacagagacagagacacagaaagacagagagaaaaagagagaggaagttcttggtgattagaaatttgtgtttctgtgcggtatgtgtatacacaggtggtatttttctatttggagggcttaatgtgtttttaggtgtttgtgggttaggagttagaagaaatagccaaaaaggaggtgtaattaaccctttatctctttctcttgatgggtaatgtggttacttcctttttgttagtttccccataatattatagtaaatacctgagtgtattatgtgtgtgtattttgattatttctctgcactgtgttcctagtagttaaattacttagtcaaaaagcatgaacactttaaaggctatcaaacatagttacattgtttttcagtaaaatatctgtacctttttctttagcatcgaggtatctatttaccagaccttcgtgagcaccgtgcagtttattttttaaaaatatttctcaactttatagtcagtatatttggctattaggataatttcaggatatttgaggaggaactttaagaccggcttataaattacagcacttataaaggaggaaaacatgtggaactcatgtctggtacacatgattctaggaactggtggtgtttggatggcagaagttacaaggaacgcaaaagcagggagcgtgagccaacaccagattgacctcaggcagctgatgctatcgaaggaaaaagggaggacttccatgcaactccagaaaacaaaaccaagacacctgcggtagattctggtttaacaaaagggagaattttctaaaaattttctatagatttggttacttcacaaagcattgagcaccccaggataaaagaatccaactgagagtggcagctttactcttattagagagaagatttctctattaaagacaaaatcaaagcgaaatcaccaacatcttactcatttacttattagacacaatcgtggagcaaatactctgcaccagctactgtgctaactccgttacctggattactcaaattcttacaataactctatatttatttcataattgctttatttagtaatattttaagtgctttttagacacctgctctatgcctgtcttgtgctaggcaccagggggcgtagcagcagaccaggaaaatgtagagtctgcccttacggagctgggagccttgcatgaaagactggcactgacgacacagtggcactgaatgaacgtgtgatcagaagctgagacagggctctaggggaaaaaggcaaagtgcagccaatcctcatagcaaaagagaccgaggaagcctagaagtggtgcttgagtggagagtagaaggatgggtggggggttaaccaggcacaagaggggagggacgggaagggaagtcacaaggtgagaagccctcagacaagcacctgcaattggagggtgcgtgcagctgagaagcagagccaggaggacagtgatagcacttgaggtcagagtggtcatcgggatccaagcctgctggatcttcctggccttaggaaacccagaggcttcatcctttggcaaggggaagcctatataccctgtaggcttaatgacggggagaagaatgtttgtaaaagatctcgctggctgctgaagagagaacatctggagttaactctccaatttcagactcccctgatgaaaactgttacttctgttctccactcccttatttgggcaaagcagtttattttctacccgaagcatatctactaatagaaatgactgagatattcattacgttaggaatgtaatgtaatgattcttagatggtgattcagatgattagttattggaccttcgatgcattttttattttaattttgagattggccgtccccaacgcctctgatgtgtgactttcattactggagatgttgtttctgatgttgctggcggtccctactgaaaaggatgcatgcatgaagactcaaggcaacagtgacttgcacccatttctaacaatgacttgcacccatttctcccgtatgggggtgcttgataagcactgagtggtgtaatttacaacagcttattggcttgatgccatcctatgaatccaccaaccatcatcttctctgaccctttaaaatgacttccctcacaccccctgccatgagatgatatgaagaactaacaacagataatttctatatcaccacattttattatcagcataattctatacagtaaatctgcagtgggtgacttagttttgctgatatgtggcctctagaatattgggaaaatagatacatggaaatttagggagcttgtatcttgcctctccaaccttttaaatttgctgcagaaagttggatatttgttgggtttttcttccttaagtaggcaaacttcagccccaggaggcaatgaagcaaactttaaatgtagccccaggtacttcaaagctggctgaaccatgtgtttgattgcatacaaaatgtgaattgagtagcacagaactgtcctcctagcaactttgtagcacaatgagatcagctgcaagaacggaataaattggagattggcttctgcagttccattcatttgcaaaaatttgcagacaattaagctgtccccctgcagtataggtagctccttttagccaggggctggagatttgttctctctgggaaaatgttaaagctgtgattatctagttatacctgaataaatggatcaaaggacctctccagccaagcacagacctccttgaaaaggtagtctccagcagcaaccctggggaggtttatagcaaagtgtttttagagcagatggttctggagttacagaggccaaagagctgaatgacttgggatgagtcttttacatcttttaacttcaggaaaacagccatggtggttctgccagcaagtcgttgaatggattaagtgagataatcatacaatgtgtttagcactgtgcctggcatgtaataaatactcaataaatggcagtattttctatggcagacttggtgaatccaggactaggatcccaggcaaatcttagggttataaaggttagaaggaaccaggttatgtcatcttgagtctagaatataagcttcaaactctccaaaggaataaccctcaggtccttgaactcaaacccgaagcatcacatctttgcgtgaagcctgcaaaggctcgctattgccttggaagcaaatccagtcttcttaccttgacttacaagactgtccataattgggctgggctgactgcatgagtctcacctttcactgttctcccttaattccctgcctgcctggaagacgtatttcagcttctgcaatgctttgccttgctaaaaatatctcctcttagcaaacaagtttgcccagaagttatgaaagtaggagagggaacaaagatgatagaggtttgtggtttgtttatgaggttttcactatttctccctatcactttttctattatgcaaagccagggtccaggagggcagaaagagggaatgaggacaaattatctggacactgtttgtctgtttgaatgtcagcgtatttaggagatcctccaacaggtggccagcccgggtcaagctgcgtctggccttgtgttcaggtgtgcaggaagtaggatcattcctctcaaatctcaccacttccttcagttggctgttagggaaggcttttatgcccttggctgggtgtgacggaaaggggcagggacagacaaaacttggagtgcggtcccagctgtagaatgccagtctggcagacataacaaaagtgagcacttcttcgcttttgggacaccttccccatttggtcttgacattgagcaccatgctttggcaggtgtcagaggttggctcccgggaaatagaccacgcaaccggggaggtgttatcagcatccatacctcacggggagggaggtcagggggatggggcggggaaggaggctgatggaggagttgctgactgcaggtagctggaggcctcagccttcctgggcagcagggatacgggcagggatgtcccctgagcatggtcccacctggaagccagggggctgaccttgacacactcctgaccagtcagtggatggcgctgcagccccttctgtttagtcttcacatcagcaatgaaagagggtgaagttcatggaaatattgtggggacatatcgcatggtttctgttcatgaaatgtccagaaaagacaaacatatacagccagtggctgtggtaaagtgggaatgactgctaatgggcatgaggtttcatttaagggtgatggagatgttctaaaattatatgtggtgaggattgcacaactctgtaaatttcctaacaatcactgtgttacacacttaaaacgggtgaatttcatggtacgtaaattatacctcaataatacttttaaaatactgcaggcgagaggggctccagccagagaaattgactccaactctccctttccacaaatcaaatgctcagatttgcattgtgggaggagcctgagtgttcactgcaggacaatgtaggttcttcagggagtgcagaccactttcacatgcagcttctcatttcgttctgataacctagaggacgggcaaatcatcgtaggacgatgagcgctgagctacagtgaatgtagcttgttatcttacgacagacctgggagaaggaggaaatccaactaatttatttacttttatccctttgagtctattctccacaaagcagctatgatctgttttattgcaactggactcctcagctcaaaacccttccagggctcactcctcatgcggagtaaaagccagggccctctccatggcctacgtgcctctccagggtctgacttcccttcaccaggtccagactgtctccttcacctcacagcgctcaccttgcccacgccagcagctgccacactgaagctccgccatgcccggtaggcttctgctgctggcagtgcctcctcctcctgcccccttggcccattcttcctccatcttccactgccatctcctcggtggaccgcttcttgcctccctgtctaaaacatcagcaccctctccccctgagcacttccagccctcctccctgctgatcttttttctcttgagccatatgtgttctctttccctttctgtggtttgccccctctctctacaattgaagcttcatgagggcacttgcttcttttaggcactgcaccatccgagatgcctagaattatacctggcagagagaaagggcttggttgatacgttttgaagaaatgaatgaaagaatgaatgaatgacttagttaatatgaatctattctctcgctccttctcacgttctttttctcttcctgccttcctgtttccctgggcctccaccctcccttcccaccctcaacccctcccctgcccctcactgtttcaggggtctcccctttatttctgatatgtgttctttggggcgagtgttgtggtgcttccagacagcgtgatacttgcttcccctgagattgggaaacagggaggaaagcaaatgaggttttaacctcaaatgccctaagacaggaagatgaagaccttgcttagctgcatgaaaccggagatctttgtgtagggatgacagtcctcctctaatagaatccagcatgcgtgaggctccctgaagacacaacactgcccctgtgatggaagcaaggctggatgaggctgcagcaggcctcggatgacctaggctaaagatgctgcggatcactgtccggagactgctgtggggggaatcccacaagtcacacatggtctggtgttggtggcggccccagaacctcactctcctctgcacacctctgcgtgcctacgtctgttcctgtgactgaggggattgtgttcagcacactggaagtgcgaagacgtgtggcatatgtccgtgggtctaggcagctgatgcatgtctgttgcatgtacatctgctcgtgagtgtgtgtgtatgtgtgtctatcagatggattctggtgtgtgtgtaaacccgcatgtgcataagtgtgtgcatttgatgtcacagagaacatttgacatctgcacgcgtctagtaaatctggaaagctggaaggggctgcgtgtctacatgtgtctgtgtttcagatctggccttaggccatccacagccgaattactcactcctgatacagactgagtggctcaccctcattttctcacttcctccgtcctggtgttaataagactcatccttcatttttctaccgtttctgcagttctttagagagtgcagaccactttcacatgcagcttctcatttcattctcataacctagaggacgggcacattatcctcctttacagatgagaaaatttccttcaacccctctgtgtcctgtctcgaggggagcagtattgggcctcttctctgaggctgatgtaactgctgattcctctcacacctcctgtgggcatctcctctgctctcttgcatcttcattcattctgtgtttctttcttcaccactgtgctttctttcctctgaccccttcttcctcaaggtcagccccattccttgtctcccatttaactgaagaacttctttccatagctctccttttcttctatgccagagtcctcactgtccatgtaatcgcctagcacacaccaaaagctgctctttctaaattcagccgtcatctgttcatggtcaagcctagcagcctccgtgattttggaggagacctctgccttgtgtaacgtggctgtgcactgttcctttttggaattctcctctctgtgcttctggtttttctgctacgctgactaaactttctgtggcctttgctgaaactcatcagatggttacgttcctcccttttcccttttccctcttcccataatctgggttgtgccattgtctccatgtcttgcagctactcttgtatatgagtgattgtgacatttgtctccctcctgaatgcaattcctcatgtcccctagaaatctctgcttcacgtccagcaggctcctcaacgtcaacaggtctactctagcactggtaccccaaaatgcctttttaaaagcctttgcccacttggtaatggcaacaccagaagtcaagagatcttattacctccctcctttacgctgatcttcagttctttcccatacactgctcttctgccttttgtaactgtctcttgaattgattacattatttttgtcaccaccatttttgtgttgtccttctctgagtttctggccacggattggcaccctcacaggcttcatgcatgaaatgacagatgcaagtacaccacacgcacaaacacagagagttgtcccgaagcagggtatatggatgtcagtcaaatcatgtatgatggttcttacacggtcccagtcatacagaaacatatggcagaacacacaaactcattagcacagactcgatcaaaggtgggtacagccacaaatatagaagtagacacttggccacaaacacatacttatagatatacacataaatcacaggcaaagatagaagcagagccacaggcccagaaacgcagagccatggataaatattcactgaagtttctcctaatgtcagacaaaaacttaagcatcagaagaagcaggatgtcctgacttcagtcgttccttaagatgcccaccgtgacgggcccagagagtcgacatgcacatggtgacttctctacaatcaatacctccagcagcccccgaaccctgtcccttccaggtactgtttttcccgaatcagagcttcctgcttcttttcttgggcactttagatccacggattaacacaattgtgccacttgccatacttctgggatgcgccgtaataatcaaggaaatggatgggcagctgtggagttgatgagctggtgagctgggaggacaccagaggtaggatggggatgggattcagggagctgaccactctggacacccgtgaggacagaaatatcacccatttgtgggtatgaaaacacaagaaagcaattcatgacactctatgcaaggttcattattgatgacacggtgtgctttgtcattactttggacacatttagacatacattgtcatcatgaactgaggcctatgtttgctctaggatgaagcccattcaccagtcctttacatctgcacaaagtttacgtctttttaaagtgtttctctagaccagctctcatctgaggctcaagatatttttttaataatgaatgatattcagatattacaaatatattttacgtatttcctatttttgccacccttaacaaaccaacagaatcttcatagatgttaaatatcagttttgtgtaaatacaacgcgctctaattttctttcttttttttttttttttctgagatggagtctcaccgtgtcacccaggctggagtacagtggcgcgatctcagctcactgcaacttccatctcccaggttcaagtgattctcctgcctcatcctcccgagtagctgggattacaggcaggtgccaccacacctagctaatttttgtatttttggtagagacggggtttcaccttgttggtcagcctggtctcgaactcctgacctcgtgatcctcccgcctcggcctcccaaagtgctgggattacaggcgtgatccgctgcgcccagccaatgctgtttctttgtttagtgttgggttcgttttgggtggttggcttttttgttcgttttgttatattattcttgctttttcttctgtcttatacagaatctagttttctttgcctgcatattgagtccttttcacttcctagagactaaagtgtctcttacttagtctctttcattgagattttaatattcttctgtgatcactatagtgtatacaaaatagaatgcattgaatatgatattctatattttcctacatagcttgtcttaaatattctctctgctagctaggtaaattggagcagtttgcatgcaacctctctgaactttcttcattgattaaggagggataagatttactttggaggtctgttggaaatatttgagggggctcatgccaagtgcccagcacattggccagcatacgcttgctgtatcattattatagtagtttagagtagtgatggtgagggcattggagtgatgatgatagtggtcggaacatggtcttcacagttgccttattggtcatagcctaggagtattgcctactaacaaacccaaatgtaactttgtccctgctatggaacatttaggatgttttccatttttgccccttataaatcatgtctcactaaacgtcttccttcatacagttttattcttcttttgaatgtaacgtttggatgggttcctagcagtaaaattactgagtgaagggatatgtgcattcataaagctctcgataaatgaatattgcctgattacttttcacaagggtgctatgaatttatactcccacccaaatcaagagaatggctatttatagatgctttcagagccttagcttatcttgtttcctgtttgaactttattacataaattttcctttaaaactgtcacacacacacacacacacacacacacacacacttttatggggccttggggccaaagatggaatgaaactatcatttatcacatgattttgataggaagctgttgttaggattgagatgcttgcttctgatgatgcagaagacagttttaattagtatgtggcattaaataagatcagtttgcatattggaaatgatattctttttcaattatctttcagtcctctgatcagatcaaagaggaagtctcagcttggtgctaacacgcctttaacaccgctctggcccctttttacctgtaagatgaagagctttccataggcaacagtttctagctcaaatttaatggtgtcattaggtctccagcatgtttatttttatgttttccttcttttatgtgaagtgatactaatgttttatttaaaatgatacaaagttttcattttgaacacatttaattaaaaatatgagttacgcatagagcaaacaccctgacagtgtcactccaataactgaacttgtgacatgctacttggagagtgcattccaacagttgccccactgatcatataataacaacacgtttcccttgacaatacactgaatacaagtctccataatgcctgacatagtttgggactttgtgattgtccctttatccctattcatttgtgagtgtaaggaccttgcagtggctcatgaagagagttgctttttattttttatttttaaaattttttttgaagactcttaacaaagtataaccattttgaaaatgcctatctattaccctagataaaaattacctagtatcggaagagtatctaaaaagatattcaaggggtacaagtgcaggcttcttacatgcacacactgtgtagtgggaagtgtggccttttagtgaacccatcacccaaagagtgaacgttgtacccaacaggtgatttttcagctctcaccctcctcccaccctcccactttccgaagtccccactgtctcttattccactctgtatgttcacaagtacccattgttgagctcccaccaaaaagtgaaaatatgcggcatttttctgtttgagttatttcctttggatcatgtcttccggcttcatccatgtggctgcaaaagacatgattttattctttttttaggcttgagtagtattttatggcatgtgcgtgtgtgtgtatgagtatgtgtgtgtgtatatatgtttttgtgtgtgtacacatctttatagatatgtttatatatacgtatagatatatttacatatatgtatagatacaaatatatatatatatatcccacattttctttttttcttttttgagactgattttcactcttgttgcccaggctggagtgcaatggcgcgatctcggctcactgcaacctctgactcttgggttcaagtgattctcctgcctcagcctcatgaatagctgggattacaggcatgcaccaccatgcccggctaattttgtatttttagtagagacgaggtttctccatgttggtcaggctggtctcaaactcccaacctcaggttatccaccctcctcagcctcccaaagggctgggattacaggcgtgagccactgcatctggccccacatttttttttatcctgtcttctgttgatggacacttaggttcattccatgtctttgctattgtgaatagtgctatgataaacacacaagtgcaggtattgttttgatataacgattccttttcctttgtgtatatacctggtagtgggattgctaggttgaatggtagttctgttttcagttctttgagaaatcatcatactgtttttcatagagtttgcactaatttacactcccaccaacagtatataagcattcttttttctcttcagcctcaccaatatttgttgtttaagactttttaatcatagccattctgactggtataagatgatatcgcattgtcgtttcaatttgcatttctctgatgattagtgatattgagcatttttcatatgtctgttggcccgtcgtacgtgtccttttgaagaatgtctgttcatgttgtttgccccactttcttttgtttgtttgtttgttctgagctggagtctcgttctgtcacccaggatggagttcagtggtgtaatcttggctcactgcactgtccgcctcctgggttcaagcaattctcctgcctcagcctccctagtagctgggattacaggtacctgccaccatgcctggctaatttttgtgtttttagttgagacctggtttcaccatgttggccaggctggtctcgaactcctgacctcaggagatcggcctgccctggcctcccaaagtgctgggattataggtgtgagccaccgcacccggcctacccacttttaattgggtcatttttgttgtttgagttccttgtaaattctggataatagtcctttgttgaatacatactttacaaatatttttcccattctctaggttatctgcttagtctgttgattgcttattttgctgtgcagaagcttttaagtttaattaaatttgaattgtccatttttttttttttttggtcatgtttgcttttgaggactaggccataaatcctttgccgaggccaatatctggaagagtttttcctagggtttcttctagaatttttatagttgcaggtcttatgtttaggtctttaatccatcttgagttaatttttgtatatggtgaaagctgtgggtccaatttcactcttaggtatatgattatccaattttccatatgggtgtttaggccaacaccatttattgaatagagcgtcatttccctatcatatatttttgccgactttcttgaagatcagttggttgtaggtatgtggctttagttctggattctctgttctgttccattaatctagatttataccagtaccatcctgttttggttactatagctttgtagtataatttgaagtcaggcaatatgatgcatctaacttagttcttttcacttaggatttgttataaaaccaattctttattggctgtaaatcaaataaaattttatatctaagcaagtcctccagattcctgaccaggtgagtaatccagtagcttggcagattaagaacagcaatatgcaagcaatgagggatgagtaaatcaagactgtcattgtgaatagaatgatttggaagttgggtgttcaaatagcttaatgatagttatagtgaataacaatgtcagctttagtattattctagtaatgtacttggtaatgctaatagggtttgatggaatacagtgaacactttccaaacagctgtatgctttcccaacaaaggaactctatctcggagcagactgatacatcatttcaatgggagattttaatcaatccttttgttttcccttttaggatatatttaaatttgcaagaacttctcctgtcccaagacaaaagaggtccattgtggtatctcccattttaattccagagaatcagagacagcctttcccaagagatgttggcaaggtaagtcagacaaacagcaaatgacaaaaacatgtttttatgaaaagatgagcacagcagactgagtatgactgtcttggtgaccagctggaattagtcttcatctgtctatgataagagaccaaatggtttagtcatgaaaagaatgttggaagatcattcatatgcaaaagaggaaattggaaaaaaccaatagcagctttgaatattacgggatcaacatggtagatgatgttgaaattaagcaggaagatgtcaatggttaagaaacaaggctcattgcttttatagattatattcaggtgatcaccagatagggccccctaggatggtagtatgttgacatgtggccttcactgagatcctgtttttcaaatatttaggtctacgcgtaccactgggtcggttttccaaaaactaaaccagatcaagggaataaaatcatactaatcatatccagaatcggatatggaaaacactgtcccatgaatcagaacaatagcttttccaggaagaaatagtcactgttaaatgtgccaaaatacggatactgcctcatcagtacattctcccctctttaagagagtcaacatggagaatcaaattttgagcagtttgtactttttggttgttagaaacaagtgctcagtgccgcaaaggagaaccagcactcaggaaaagagttttctcagcaaggcaatttacttctgcggaagggtgctgcttgtacttctggccactgggagagcacaccaaacaaaagagggaaggggtttttatccctcacgtggttagtccctgcttctgtgtcctgtccccattggctggagttggattgcacaatctaagctgacctgattggctactgtttaaaattgaatatggctaattaggcaggaagggagaggctgtctgttatggtacaaggcatgtttgggcatgtcagggcacggcaaaggcgggaagggtagtttcattgggaagagctgttttggctggaggggcagtttacagaatgggtagccaggattaaagaggactctttccaaataagaaagagatgtgagtcacagattgggactaatgggagaagttgtttatagagcaggtagcttaggagaagggacaaggaagttgatctcgagaacaaagaacaagggagtcagaaattaaacgtttgaaaaggaacttactgtatcagacattggtgagcctggaattcgaaaaatggtggttggttaaatgaatgatcttaatggcagttgctgttgaactactaattcattaaatacacagtacatgtgatatgctggactccaagctttggactgggtgtgaagaagcagataataaagctaacatgctagtgggaagacagaaacaagaacattgcagagtatgacaaatgctgtgaaaatcagcaatgggatgatgtgaaaaaaagagcaaatggcaggatgaaggagtagagggaggagggaatcttcacgcagatggctgtgatggctggttggaggtactgatatttgaggggagactggaagggtgagaaaggaacagttacaggtatatctggttgaacagcatctttggcagaggtgagtctacattgcaaaggcctgaagatgggaaagaatagcatgtagtagagtcgcaacatgcctgggttgcatgagagtaagcaaggatgacagtggtaaaagtgaaatcagagaggccagcctgcccttggatgaggagttggggtttcatcgtgcatgcagcaggggaccactggaagatttccccagaagactgcatgttttgaaagatcatcctggctgccttgtagagaatgattagtggtagcagagcagtagagaggagtggaagcaaagagacccactaagaggggagtttggtggtgatctgaacaaaggtgacttggactattgaaaattgatcttggacgggcatggtggttcacgcctgtaatcccagcactgtgggacgctgaggcgggaggatcacccgaggtcaggagttcaagaccatcctggccaacgtggcgaaaccccgtctcaactaaaaatacaaaaattagccagtgtcatggcacgcctgtaatcccagctacttgggaagctgaggcaagagaaccacttgaacccaggaggtggaggttgcagtgagccgggatcatgccagtgtactccagcatgggcgacagggtgagactctgtgtcaaacaaacacacaaacaaaaaatcgatctttattgcaaattgaaagaagtgctaatccaatatcctggtaatcattatatttatcattttaaactcccactgtgccaaagatacctttctctaagcaaaaatctttttaagagtctgggacatgatacaaagggaagcagagctgctctaaagggatagccctgtccccttgggcagccctagccactgtgatgatccttttctagacaggtttcctgggagcccaagatgccagatgccaagggacctgactccccacttcttcaaaactcttcccaaacagtttctgagactcaagatgcattctcgtttttcagttttcttttagataatcctgggcttctcagctctcaccatgcatcagaatcagcagagacacttaaaatgcagatgtcagggctccaccctcagagattgattccactggggtgggggtgaggaccatgcatcaatatatgttaaaatatccgaggtgattcagatatgcagccgaggtggaggactgccggtcttaagcagtcctccaagagtggttgtggaccagctacattagcatcgcctgggagcttgctagaaatgcatattttcatgtcccaccccaaaaccactgagccaaaaactctggggttaaagccaggaatctgcgtttttacacagcttctaggtgattgtgatgcacactcaaatttacagagggctgacctgaaatgcactttctcctcctgtccaccactagtacacaatactttcagttgcaattccattaattaggttataataaggacaatcacatttcagttgcctggaaaatcccagtttacacctgtcgtccaaatctgtcatgtccagatttagacaataaattatgtagccatcctatagttttcttcaattacacacaatttcctccggggtatatttgggtgaattttctcacaagcctcttttcttgagctattcaatgggtccataagcatgcagctaattgggaacattcttctgcattgtttttttacttattacagcttcaaaaagcaatttggtttgcaagctgaggactcacttcttcttagccccttatgtgttgcccatacttgttctcaacttagattctctacaaagcaactgcttttctaagtgtggtaggctactaactagacaatgcgcaagagccttcaaaacctctagatgttttttgtagaattactgcactgctttgcaaaaactatttatttgtccctgctttttatgcctttgaaggtacgtattttcctttttgttcctgcttgtttctatttatctgtcttactctttatatctcctgtcttatcctcatcaactccaccacagctgacgagctgtgctctgcagagctgtggaagaggacgtaggtgttttcagtgagtgctggggaggcagggagaagggaaggaagaccacagaggcagagctctggcctccaaacaccaccacgctcccaaaaaatgtctaagtcaggacacctctaattttataaatattacgtattagacttcgatatagaatgccatttgaagaagagattctgcagctctaaaagtataaagacgtttgtctttggcttcccctagaagtggaccgcaagacaagaattcaaatgaaggcagttcatttcagaggtggaggaaatatttgtaataaagtaagggagagacgtggagaagggaaggcagctaggagagaagcttgtttatgaagccagctacccctgtgggtgactggattgtaatgtcaggggctaactttaacatggtgtggaacacactgtcagcgttacaccacccccaggggatggcactgggatactttgacaccagctggggtatttctactcccagcagtcactggtggagggccgcttccaggggtgtaaattccctggcatatctggtctgccctgcactctgtgcactgacgcgacagcctgctgaggtttggaggagaaccttagacaaaaaggattctgtacagcagccaccagtctgctggtctgcactgaaaagctgacacatagaggatgtggacagggcactgatcccttctgcttcatcaccaaaactaatatatctatattattttttgcatacttcatttcatcctctgcttttacctcatttcctgaactagcattctcatgtcctgggcttttgaaaccccctgtacttgcctctctctctccattaataagtagttcctgcatcccaggagggaaaacctctgaaattcaacctaattcatatcaacaagcatatattcagcatctgtttttataaggaactgtgctaggggctgggaatttaatggaggagaaaacagacagaatcattgatcttgcgggattacaaaagaggtgacaatatcagcacatagtcattatttgtccagcactgtgctaagcacttttcatctattatgttgaattcttatgataacaaccacatgaggatcattttccagcatgccaatgaaggtaatgagactcaggggtgacgtaacctgtccaaagccacacagctagttcataacagagccaagctttgttactgctttttgagatttcaaagtctgtgctcttaaccagtatcctcaggaaatactaagcccaatctgagaatactcttccgtggaatgaaatatcttcactgacaatttctctttttaaaacagcattaaaattgagtgcaattcttggcaatgcactcaaaaataaggtggacagagggttggatcaatagatcgatatctgatatgtgataaaggaagtatattaaaatgttagtggtagaatataagttggtgaacatatgggtacttgctgtacaattctttcgagttttctctgcatttggaagttttgtaataaaatgttgggaaaaattaagtttaactaaatataaaattatcataaaagacacaggagttagcatgctggcacaaaaacgccttttaaatcatttgtcttgcatttcaagagggtgaatggagacaaagtacgtaactggttcttgatttttttggtcatattttattacaacctgaattcctgtaaagaaaggagactcatatcctgaagaatgaagacatcaaaagcaaggtgctgtggcaagttagcccttggtggagggtttttcacaactggatatcctgctgtgtagaactgaatacccacagcagggttattcaggcagctccagggatgagagaaagtgtcttgactgatacataatttatctgtctgccaagtaattagttggttggtaagtagctaaactactagaatttgggatctgcttttccgtaatacgagggaatcatattacaaccctgagattccaaatcactgctactcacttagatagcaggtggggagtataagggggtgtatgacccccccccccccccccccgcccacagacacacacaggagacaacccgagagatcactgccagccctgggaaaatgagtttgcctcctaatttctggctcttttccatggtgcattctgccctagactatctgtcatagttttggaagacaaggtaaaacacccagtcgtgaacatacttgctcatacctgtgattttctttccatttttgaactctagacagcagggaggagctgacagtgagtgctctggagaggaacatgcagatcccaaagtggctttttcccctcccccttcaaagtatgactatttcaaaatttgggccataaataatttctcagttttaccaactttcactgataactaattgattgcatctttaaagatttttgagttcttgggcccgattgattgagagcaggggactttaaatctgtaagccagcagggaggtctttgggagatgtattttattctgttttatattaagtttgaaagacaagtcatttatgaaatgcttattagagattctgctttcatcacaaacccttttcatcaaaaccaatgaaagtacttttttacagaaaatcctgttttaaagaccctataaattggtagaatgggcatttagaaggccatctttaacccaggatagaagaaatatgtaactgggccaagtgctgtttgtaaagggaatcaacattgatcattagactaaatcatgaaaaccactcaaccaggactccgctttgattgtgtcatgaacgtaagtcagacatgacggtaatttacatcagctttgccatgttcctcagtgttctgtgcatctgattcttagaggtctcactgcatccagatactctgtacctgagatttatgcccacctatgcgaataggtgccaaggagtctgatagtcttggaatttaatttgttttattctatttaatagccatttgcctcactttgaagacccacgaagaccaagctatatccttagaggctgaaccagaaagctggtactgaagccccagcacctctccatcacccctctcctgaaatgcagactcagggttacttgctgttgcctgattgattttatgatcaggcacttactgggttgtctagggtaacccagtaattgctgtcatccctctacctcttttaaaatctattgttttgtgccctttatctatgtctaactatatacacttttctcagaaatttacatctgcttaatttctaccccccacccaccccccaacacccccccctttttttttttttgagacagagtctttctctgtcaccaggctggagtgcattggtgcaatctctgctcactgcaacgtccgcctcccagcttcaagcaattctcctgctcagcctccctaactgggactacaggtggatgccaccacgcccagctaatttttgtatttttttagtagagacagggtttcaccatgttggccagactcatctggatccatctgcctcggcctcccaaagggtggggattacaagcatgagcacctggccttaatttcccccttttaaggcaactagcagttttattcaataactgaaacttaccataggctagagtataggagaaaaattggaatacagagtatctaagatgcctaaaggctcagtgctcaaaaattcttcttgagatgaacatcacagtttatttctacattcagcagccatagctacacataagcctttcctatttccaagtctttgaactgtcagttcttcctgggatacaccctctgtatccttattccttaggagcagcccacattcacactctaaggctgcactgtcccatggaacattgacattattgcaggaagttctgcctctacacagcccaatatggtacccactaaccacatgtggtcaatgcagttataaagtctttactaattttaattggggctcaaaaagtaacacttcattccattattgggacaacttggcagttgaatgtacctttttcctgatacattttaatctatttacagataaaatattttttactgaaaacgcaatgtccacactgagatgttttgtaagcgtaaaatacacattggatttcaaaagcttatcacacgaacacaaaaagaatggaaaatgtctccttaataatctttgtattgatttcatttggaaacaaatcccttgtatttcttttcactttttttttaacgtggctgccagaaaagtattaaattattaatatggctcacgtatttttatcagatggtgctaatgtaaataaggcctatttttgatacagtctctcctcagtggaattatgtttttgagacagagtcttgctctgtcacccacactggaatgcagtggcgtgatctgtgctcactgcaacctctgcctccggggttcaagagattctcatgcctcagcctccctaatagctgagattacaggtatgcaccaccatgcctggccaacttttgtatttttggtagagatgggggttcaccatattggtcaggctggtctcaaactcctggcctcaagtgatccacctgcctcggctgcccaaagtgctgggattacaggtgtgacccactgagcccggcccatggaattttacttgatctcttttatacattgtttatacatctttgatggcacttaacacattttgagagacaatgtccttccctgccttcccactaactgtaattcatcagatgcggtggcccaggacagggcctaacacagagtagcgactcaaatattctctgaattgaattctagccatatgtatggctgattaacatagacattcactgcttactgattaattaaagtgatcatagcctgctttgttgttagaatggaattaatagaccattatatgatcagtctggatatttccagcaaattttaattttctaaattggtaatgaggccaccagataaattgcttggcagtcaactattatgtcaggtcatataagcattcttagtagatttgttttttttctttgagacagagtctcgctctgtcgcccgggctggagtgcagtggcacaatcttggctcactgcaacctctgcctcccaggttcaagcagttctgcctcagcttcccaagtaactgggattacaggcgcccgccaccatgcccagttaatttttgtatttttaggagagatgagctttcaccatgttagccaggctgctctggaactcctgacctcaggtgatccacctgcctcggcctcccaaagtgctgggattacaggcatgagatgctgtgcccagccagtagatcttgatagatttgatgttgatggattttatgtggggatggggtggggggagagagagagagagagagagagagagagagagagagagagagagagagtgagttacatgactgtatttctgaatttgcctatgtatatgatggtgttttaattccaattaaatgaaaacactcataacttttatcttttttcacaactgaacacagtcaattctaacttatttttgctaagtctaataaaagctatgttcaccattcgcaagtgttgccctcctgcaaattttaattaatgacaaaacataatcgggtggttttggctttttgccaaatacatatatatgcaaaacttccctccatgatctacatcccgcaaataaaggcatctgagcccaaggaggaagcaatatttttaaccctgagtttatcaccctttcggttctccattttaaaggttcctagaactttattgttattatgaacatctggcctcagactgaatttatatttaattatttgtgaacattcaaggaccaggcatttcagcttgaattagcatccagactcagggttgttgaagaattttcaaattggactagaatgttcactacctaatgaatgtctggatctaagccaaacatggctaaccctactgtcctgcttagtttttacaacagccctataaagtaggcaatcctacactcatttctcagatgagaaagtggaaattaagagagattaagtaacttgcccagggtaaccctcttaaagaacggcaatgctgagacccaaaaccaagactcttcaatgccacatcagtgatctgtccaccacaacgtgtgtgaatgcttaaagcttccatgggtctttgctgtttgcatagcacactcacacaaatggtcatttgactctcataagtaccctcagaaatcaatattatgtccccattgtacagtggaggctctgaactgagcatgaccaaggtgcagaagcatcttgcaaaacagtctatttgtggtacaaactgagttgcctttctgtgtcacctgcaattgtaccagggctctggatggattttaaaatagcacatggcatgagttaagccactatggaaaacagtgtggagattcctgaaagaactaaaactagaactaccatttgatccagcaatcccactactgggtatctacccagaggaaaagaagtcattatatgaaaaagatacttgcacacacacgtttatagcagcacaactcacaattgcaaaatcatgtaaccaaatgcccatcaatccacaagtggataaagaaactgtgacatatgtatatatgatggaatactactcagccatccaaaggaatgaattaatggcatttgcagcaacctggatgagattggagactattattctaagtgaagtaactcaggaatggaaaaccaaacatcatatgtccccactgacatgtgggagctaagctatgaggacgcaaaagcataggcatgatacaacggactttggggactgggaggaaaggatgggagaggggagagggataaaagactgtaaacaggatgccgtgtattctgatcgggtgatgggtgcaccaaaatctcacatatcaccactaaagaacttattcatgtaaccaaacaccacctgtaccccaacaacctatagaaattaaaaaaaaaaaaaaagaaatagactttgtctgggcacggtggctcatgcctgtaatcccagcactttgggaggccgaggcaggcggatcatgaggtcaggagatcgagaccatcctggctaacatggtgaaaccctgtctctactaaaaaatacaacaaaaattagccgggcgtagtggtgtgcgcctgtagtcccagctactcgggaggctgaggcaggagaatggcgtgaacccaggaggcagagtttgtagtgagccgagatcgctccactgcactccagcctgggcgacagagcgggactctgtctccaaaaaaaaaaaaaaaaaaaaagaaatagacttcactagaggaaggagaaacatacaagccaggggtgagccaaggatgagaagcatagctcaccatccccctcattccacagggaggtctgccaggggagaaactgggctctcatagctgttccttctctgccggacagcttcagtacaatcttgttagtggacagacgatcaaacaccagggatgttccgcagcctgaatgcagacagcttcagtacaatcttgttagtgggtagatgatcaaacaccagggatgttccgcagcctgaatgcaggttcccagattcgtaggagtggtctgagattccaaagttcaaagtcagatgctttgggtagggatgtgctggaaaactggctctcggaggctggaagccttgagttggagtgtttgcagctactttggcataaattctcccacagcggccagtttcaagctagcagcttacaaaatctctgaatgtttaacaatggacttccatgaaggagtagggttgacttcagcacggcactggccttgggactcagggaccgtgacactggaaggggtcagggggcacatgggtcccaggggagctacgcttgagtgaagccctccattgtggagaagtggcttccacacccacctgttcaccccgggttgcagctggtctcatgcccagtttagcagtgaggatcattttttgacaactctgcctgttgcaggtgttaagtaacttgtccaacttcatgcagcaagtgcaacataaaagcaaagctccaccactcttctccttggcacagaaaaatccaagtcactctcctaaggctggaaaattctgcagcaattgtcccagttctacctggaaaatgaggaagggagtgataaaattctctgtgaagtgaggagaaatgaggttaacctcgccaacatttatttgatgtgcgtgtttgtgcgctgagtcagggccggaggtcgtgtcttcgtttaacaaatagaccacatgttgacaagcaaaaaacggctttctttgtctggcaagaaaagccactgcctcgcttcagacaacgcttttttttgttggtgtctccgctgacaaccctgttcaaagagagccacaaggaatgaaagtgaaagcagaaaaagccaacttcggtgtaattaagagatatcactgcccgtttttctcagtgatgaggccgcagctgactcagtcgataagggccgtgaaggagtggggcccagggcgcagtggggatggactggccttttcacggtccaattactggtccaattactagtccaagttttgaagaggattgaagtagaactggatggagatgggaaagagaccaataaagtgttttttgttttttaggttttttttttaagaggggaggaatgaatgaagaacttcttttattttcttttccggcttggagctagctctggttcccaaatagggtcctgggggaaagacgtgatgtgagtctgggtggctgggaacagtccctcctgggtatctgcgcttggcccacttctgcaaccagtaatggaggagacagaagaacgcttgaatgtgggtttaattgttcccatctgtgagtgttgcattaaagatgttgctgtcttctgttgcatcgggtggtttgggacaagtgatgaagaaagagagtcagttgatgcctcttgagcaggcatacactctccctaggctgaaaattgagctgcattaattcagaaatatttactgagcaactactatgtgtcaagcactgcactggctactgcttatggattcccccgagaagaatgcccgtcctaggagagggggcagacctgtaaacaggcagacaagcgctgtgatggggtgctgtgggatcttggaaaaatcgagaaggcagaagaagtaattccgaagaggactcctgaaggacgcctaagagcaggcaacgcgaagctgagatgggaagaaagcgctctccaggcagtgggaagaacatgatccagtatctacgggcgagagggacggtggtctgtccagagaggtgagaataattcaaagtggctgtgatgcaaggaggaaattgtcacaaataaacttggagaaatcatcaaaggctggaagaggaaaaattgtaaaaactactgtatggaatttggacctttttctacggatgactaagtgttatacattggggaatcacacgatcagatttgcatttcaggaagtttagtcctgttacgctgggtaacacctgaaggctgagaaaaccaggagcaggggtgacaaagagggaggctgtgacagaaatccaggagggtgacgaagggctcccgggcaggggagaggcagaaggactggaaagagggcacagtgaagggccatggtgggggataccaggcaacactggcaagcaagtggacagtgatgagtgaggaggtagaggaaggtcccctcttagctgggacattatgcctctataggacgctgaacaaagtaacctgcggaggtgttactttgtgggaatgtagactgtgaaactgaaggaactgttttatccacctccccgtagtttgctctgtgctgaggctgctgtactgctcctctttgaaataaaagagaactcttcccagaggtgacagatccacctgcgtgctgtatgttgcatggaggtgggcgaacaggttatgtggagggttgttcttggaaagacggattcattttgcaccagtgacaggcttgagggaacaccagcgtgtcacacgtctcttcccagtgtccctgactcatccatgcctagggattttactttagtccttccttgctgtgaatttgaaaacttttattttatttttttctactagctaagaaatgtgtaacagctgtgttcactgttggccttctagcctcaaatttattttaaatacatttcttcttagtgatctcttctttgaatgctgatgttggctatgcattagtttacacaattcacaggctctgtgttgctcaatttttagttcatttatttgacaacttgaaattcatcacaagtggtgcttttattttgttatttgcatctggaaatcattcctaacatgccatgaaatacatctgttttttccttttgcaaatcacttttttttcttattataagagtaatatgtgtttattgtagaaattttagagaaaaatacacattgaaaaataataatataaaaatatccggccaggcgcagtggttcatgcctgtaatcccagcactttgggaggccgaccgggtggatcacctgaggtcgggagtttgagaccaccctgaccaacatggagaaaccccatctctactaaaaatacaaaattagttaggcatggtggtgcatgcctgtaagcccagctactctggaggctgaggcaggagaattgcttgaacccaggaggcagaagttgtggtgagccaagatcataccattacactccagcctgggcaacaagagcaaaactccatctataaataaataaatatccctgagtcccaccattggggataaccgctgtagacatccgagggttttacctctctatttttaaagtgcgtatacattcataaagacacagcatcaggctgtaccaccagaggtttagatcccataggtctggggtgacacctaacagttaacattccaacaagcctcctggcactgctgacaagcccagctccatggccggcccacactttgaggagctccacttctaatcatacctattcctacacatgaccatcttgtgctcatgcattttccacttgccaatgtctcagaaaccttcttcatgtccttcatcaacacgtggtatggcagaccattgctatggccaacactgagtttcagggcttctaatgtgggatctactgcctctgcagggacccacagataggtctgttcactttctcatctgatgtatcttttttcttttttttgagatggagtcgtgctcttcttgcccaggctggagtgcagtggtgtgatcttggctcactacaacctcgctgtctcaggttcaagtgattttcctgcctcagcccccagggtagctgggattacaggcgcctgccaccatgccctggctaatttttgtacttttagtagagaaggggttttgccatgttggccaggcttgtctcgaactcctgacctcaggtgatccacccgcctgggcctccaaaagtgctgggattacaggtgcgagccgctgcacccggccgatctgatgtatcttaaggcatagagcatgacataaaatgactgaagagcacctcacgatttttgtttcttacccttgtttctccctcctgggaacggactgacccaaggtttaaggcaccaagaatgcccagcaatgtatttttttcccagataaaggaagatctgccacatgaaaaatgaccagttatcttggtctattgatgcacaattgctaaacagacaattttcacatccattctcatttgaagttcccaatgaaccagagtcactgaagtatccactatttcccttcctgttgcagaggaatccaccttgaagctatgaatacttttttgttgtatttatatttatcaacacttatatcttctccctctcctgattcagtgagatcagagaatattaaagccggaggggctctggaggtggcctgctccaaatacctcacttgatagataagacacaaaatgatttttctgggatcacaagatgggaacagtccttaataaatctctactccctcactctggtgcccttttgcctacacccagtattctgagccttcattgtcctaggaatggctgccctgagcctggggatgtcccagggtttttaggagcctcagcataagcttgacataattgatgtcagcatgttcacaatctctataggatcatttctactgagactaatcttattctttatattttcatttctcttcgcagtgttcttagaggttgattttttgtttgtttgtttgtttttactttaagttctgggatacatgtgcagaatgtgcaggtttgttacataggtatacatgtgccatggtggcttgctgcacctatcaacccatcatctacgttttaagccccgtgtgcattaggtatttgtcctaatgctctctctccttttgtccccaacccccaacaggccccagtgtgtgatgttcccctccctgtgtccatgtgttctcattgttcagctcccacttacaagtgagaatatgcggcatttggttttctgttctgtcttagtttgctgagaatgatggcttccagctttatccatgtccctgcaaaggacatgaattcattcttttttatggctgcatagtattccatgtgcatatgtgctttcactttaggagctcaactagcaactcccccatgcactccctcctccagtgtcagagcacactgcaggacccacccagtctttgaataggaaagcactggctgaaaagccccagaaagtggggatgtaccagtacaagtttcccacctgtgtatcccactgttttgtttggggagaacaacggatataaccgaaacgggctatctggtgagcataagttctacattaagttgtccctgtgcctgaaccatttttgtttgtttgtttttgtttttttttttttttttttgaaatggagtctcatcctatcacccagctaaagtgcagtggtgtaatctcagctcaccacagcctccgccttctgggttccagccattctcctgtctcagcctcctgagtggctggaactacaggtgtgtgcccccacacctggctaagttttttattttttagcagaggtggggttttgccatgttggccaggctggtctcgaatttctgtcctcaggacccacctgggcctcccaaagtgcttagatgacaggtgtgagccacagtgcctggttgccttgggccattcttcatccagctgcctcctactcatcccttgggtctgaggttgaacgttacctcctcggggaagctttcctcaattccccaaactgaatcaggtccttcctcatgtgtagccgttcgcctagtccttctccagagcactgatcacaccagtgattaattaagtatttgttcaattgattatgcagcaaaccccaagatagcagaatctcagtttttcttatttacccttttatcttcagcatctaggatatgtctggtggactaggctctcaataaatattttttgactgaatgaatggtcaaaaaaggccaactccagtggtctctctacaaggtgataaaagagtaaaggggccgggcgcagtggcttatacctggaatcccagccctttgggaggccgaggcgggcagatcacctgaggttgggagttcaaagaccagcctgacccacatgaagaaaccccgtatgtactgaaaatacaaaattagctgggtgtgatggcacatgcctgtcatcccagctactcaggaaggctgaggcaggaaaatcgcttgaacccgggaggcggaggttgccataagccaagatcgtgccgttgcgctccagcctgggcaacaagagtgaaactccacctcaaaaaataaaaaagagttaagggcaggctgtcttggacacatctctacccctatcttacatgcagaacgaatggtattaattttgtgatgaataaaaaatattttttctttggatatattttaaacttggatatagttcacatattataaaattgagtatatttgatccaatatgtcaagtaccattaaatggataaaatgataaatttggtagaagaaaaaatatttaggaaagtctcagaaatttaaatgtaataaatgaatatgtattcatatacatactataaaactcattatgtaacatattacataaagcacattttgtgttgaggagtgagttccctgtatttagcttcatggaaaaaatagtttcttgtagataaatattacaggtgactgaactaaaaatattttgacaatgtgaactacttggatagcaatattttgagttgttttatacactagttccttatcttaaacagaagttaacatactcatttatcaatggagaggtggcatttatcattaggaccatcaaaacaattgtgttaaaatctcagggacaagaatgagtgcagggattgtaagctcctctgctgggtgcttcgttctgctcttctatacaacctgctctgcatcctcttgagtgctttttaaacttccctcgtctcctccttcgtttccaggctttctcacccactactcctctttgccgttcctctgcctgactctattaagataaactaatccttggaatttgctgctttgaagttgatgtcggctgggaaactcatacacaggcgtgtcccagtcctgtggtctagaatcaacatagtgagacgagacagaaggctggtggttgctgctctgctggttaccagctgtttaaccctcggataggtcacactgaaaacccctgggccctgtttgttcttgtatgagataaggctagtaacactcacattccacgtttggggaaggataaaatgaaatcgcctgattggtcatacttgacccacagctagtgcttggtcaacgtgccccttccttctttctctccctacctggagagcctacagatgtggtaagtgattctgaaggtttctcccatgaggaagtgacacaggcttgtacttatttggatagtcaaggcaccttttgttcctgcggttgacactcttccaaatagttgaagttacgtgtaagtgaacaccacctaaccaatatgctactgtatttataaaggatgctaacttgaattagctttgcccaagcagaatattttaaaaaataaaaataaataagaagcagtagtccattctacctgtctgccaatttctatgttctagttaaggacatgggaacacatgatcagcaatacatgatcagatataatcaccacgagacaaggtgtgttaacaactttacgttcagggcctggaacataatagatgcactgtattttttgactaaataaatagctattcctggaggtgtgatgattatactatgcccagatcctgccaaaggcaaaaaggcaaaaagttatattcagaccagctatctctctatttttttccctgctcagggctaaatttttccgaaaaaatcacataagagtccaactgtcagaatgagttcatcacctgggctggggatcccagattctgtgagcagaagacttcatccacccaggtgtctatttcaagaacagtctcctcttttgcaaaagcgttcatggaaatggccttctctcctaacagacagcagctacagagcctcctttccctgggctgcagagggtaggttaatggagactgaggagccctctggagaacagcaaaaggaacacgatttcacccttcttagcatcctggggcttgtgatacagatggcccatgttgcaaatggagacgccgtggctatgttgccacttgcccttgcagacacaagtacggggacattatattcaattttgggtctccatccatatgctgctcctccaatttatttgtctacatgaagggatatgaagcccaaagccagaggacatccaattcggctttaattacagtgatgagctgtttgtcagggtgccatgagctgcaacgccaccttggtcgctgacaaactcggagcaggggtgacaccaactcccctgttggctgctgatcattgaggcttgggcagcagcagcacttagttcaatatttgttgtttgaaacccaacagttatgactctgccaagcttaatgaaagggagaaaataattatcagagagcttatgcaattttgaagaccaggggcttttaaacaaagttaccatgccagaagtgttcttggcatgtcatgaggactgttgccgttattagcgatgacaatgcagtcattatttttacactggcttaattgttcagcagacaccaaggaccgtgtcaacacagttctgcaaatggaaacaaacacgccatcattcagggtcccactttgatattctgcctttgcacttgtttcattttttctttgaagaacattctatagatcgaaggaattattccagacctctgattcatgctaggcttattctcttcctcattcagtctctcaatcaatcaatacttactgagtacttgtcattgcaagacctgaggaatagaggggctagcagaccagcctgggttctgcccttattggaatctttcaccttctactgcagaaggtcccacctttaggtagaatgatcagagatctctctgaggatgtcacatttaaactgtgactctaaggatgaaaagaagccagatttgtaactaatgaaaggatgttccagccggatgctggaactttgggaggccgaggcgggtggattacctgaggtcgggagttcgggaccaacctggccaacttggtgaaaccccatctctgctaaaaacacaaaaaattagccagacatggtggcagcacctgtaattccagctactcagaaggctggggcaggagaatcgcttgaacctgggaggcagaagttacagtgagccaagattgtgccactgcactccagcctgggcgacagagcaagactctgtctcaaaaaaaaaaaaaaaaagaaaagaaaaggaaggagggaaggaaggcaggaagaaaggaaagaagaatggacatttcaggtggagggatagcaactgcagaggccctggtagttgaagacattatgtctagataactccatcaccatggcttatgccatgtaggggtttgtctgtctcacatagcaagaaacctaaaagtaggcaaaagtttaccagtgcagccatgtcaggaccagcatctctgcaatttgtttggtcttcccttatggttacaagctgcctgcagcagctcaggccatcctatctaaggctggggcaggagtaacaggaaggttttaagctaactatatctgtcattttttgtttgttctatttcaagaaagcaagatattttccagaaactttgagcagttatatgtgtatgtcacgttaaccagaatggtattcaacaggcatccctaactgcagcagcagctggagaagtaagatttagttgcaaataccaataattcaagcacaattggagtttggttatcaaaggacaaaataggccatagatatttcaaaaaaaatggtatgttcaaagtattattttaaaaaggccagggatggggccaagcatggtggctcacgcctgtaattccagcagtttggaaggccaaggcagacagattccttgaggtcaggagttcgaagttagcctagtcaacatggtgaaaccctgtctctactaaaaatacaaaaattagcctggtgtggtggcacacacttgtaatctcagctacccagcaggctgaggcaggaaaattgcttgaactcaagaggtggaggctacagtgagatgagatcacgccgctgtactctggcctgggcaacagagtgagactccatcttaaaaaaaaagcccatggaggctgcactccaaaggtggagcgatagcatagtgtaacatgatttttgagatgtgtgaagaggtcaaatccacagaaactgagggccgtgatcagacatcaccaactgtagtcaaccacatgttaaagttgaattgttccgtcttctgttttccacatccaccttcttccgtccaccctttcctgaaggtccgtgtgaggcctgaccttgctttgattcttgcagtcctcttctaactgtgcccctttgcctccacttcctgcctgcacccttgcatctcctatctgtgacttttaaagaaagtaaatctcaacattcctcagggctccctatgacgtaaattccaagcttctctgtgtgacctcaagtcatttctgatctggtgccttatcctgcagccacagcccctgccacttcctcctttcacgactatcttatcacagctgtcctgttatttgtgattctcccaacatccctcaggaacatttgccttccttgaagtcctttttcttcgggtcctttccagagtcagagtgggcttttcttgacatccttatgggaaagggacaactcattcctttgcctttccaccccacttgcgttccacccctaggttgctacacattcccctagagggcttttgtttgtccacctgagtatcttcttcccactggtctctggggtcacagggggcaaagacctcacctcactcatcttggtctctggctctgagcacagcaccctgacaccatcataagctgtaactacaaattcaatggaattagtatgaaggtaaggagccagcaggttctggtggctcactgaggcattactgttcttgtttttgagatggagtctcactctgttgcccaggctggagtacagtggtacgatgtttgcttaatgcaacctcagcctcctaggtacaagcaattgattctcctgcctcagcctcctgagtagctgggattacaggcgtgcgccaccacgcctggctaatttttgtatttttagtaggcacggggtttcaccattttggccaggctgatcctgaactcctgacctcaagtgatccacccgcctcagcttcccaaagtgctgggattacagatgtgagccactgtgcccagtttgaggcattgctgtttaaggggccagagagaccacaataggcacagaggctgagacaacatgggtggtaccatgtagacaacatgtagacaacatgggtaccatgtagacaacatgtagacaacatgggtggtgccatgtaggctcatccctccatgatttgctggaagaactaagacggcagtaggagaagtggataaaataatgtctgtggagtcagactgcaagggttcaaatcccagccctgccattcaccagccagatgaccttggtcaatgtacgtaatgcctctgtgcctcattttatgcacctgcacagtggaggtaataatagtgcctgcctcataggattttccagaggattgaataagataatctttgagagtattccagtacatggtaaactctcgcaccatattaactattgcagtatggtgttattattattatgaatatctaatacagttaatatctttgtacgtaggagttttagcaggcaggtgtgaatggcacttttgaagatgcagagacagatttatccttatactcctaatatttatcctcaaagacactatttaactcattcaaaaatatttactcttttttaaagaccgctttcagctcctttttatacaaaaaaaaggaattctatcctcattctagcaatagtagcctaaagaaaatcttattacactcattatcttaaattaaggtaattgaaaaccactgtttaagagtagaccccaaatgtatcataaaattaattcaattataaataacaagaattgactgtacttgaatgtgcatgaagtatagaatcatagtggaacatttaagaaatatgtccttatcttgttactatggctacatgttactccaagatacagtagttctatggtaaggttggaattacattatttcctctctatattgaaatattcagcaactaatttcctgtagcttcatagtaaatcatgctaatgacctcagaggtggaaaccaaggtggtgagactttctccctgctctaaggttattccattaaacaaagcagagaatacacatttatactcatttgatcaggaagcataaggaagcttataatgagaaagacatggcaatgacatctcatgaggcgatgttaactttaaactcaagtatttaatattatttattcattgcgtccatgataggatcacaacagtgagaaaactagagattcatatgggcaggaactgagaggggatatggtacaattgaattcaattccacaagtaattcatggaaacttatcatgtgctaggtacgtattaggtaggatacccccataccctattctttgtctactgaaattattataatatttttgtgtatatcactaaacattcaaaacagtgggaataatgaagaaaggaagttacactggtttctaaaagccctatcatcagtagcaatttctcaaaagctcttcatgacatcctagagacatcaaagcattggaagcactggggtgctggggctggctcacggcatcttgcaccagcggtacatatctcttccaaactctgtattcagcgatgtcttgttggtagttgaagtccaccatgatggtaatatttacaccacagaaacaaacaaatattacaagtcaggtctttttttcttcttcccagagaattggctattaaacagttagcagcatgccactgattacaagcagcgatgtgagattgtatcttcttatttcaaagactgctctttccactttatgtgtttgtttccctttcccaaacctcttccacattcacctgtaagactgatttttgcctctctagatgaaggtgagataagagaggtttgtaagcttgtctctgtttacttcaccctgagtcaagccaccaacttctcttgctggactttgtctgtaactttcaaattagtccctttgtgttgatgcttgctcccctccaatccaatctccatccaccaatgagagtgatcttctaaaattgtaagtcacttaagcaaacagaagaaaagtaataataatgacatccctaattctctctctctctgtctcatgtctatgtctatgcctatgcctatatctgtgtctatatctccctatccctacccacttttctctcccttgctatcattatctctgtccccaatatatgcttctgcacatctcacattctggctttttcttatgctgctccccataagacccttcacttctctattgacatcattttcaccttcaactccacactcagatactgactcatacatatgattgattctcacctgcctgtgtcttgttgatccaggtctcagcttagaaattacttcctccaggaagctgtctccaagtcctgttcagatatctgtccttatagagcgttttttatctcacttactatactttttgttgtcttacctatttactatatgcttatatagtaagcaactcttaggaattagacaaaagttcccatttctgtaagacagatttccaaaacaggacagatgcttgatgaggaatgcttgagctggatttcaaccttttcttcccaagtattttgtgtggtgaacaacctgcatgactggcccttccccttaaccatttccattatagcatacattctgtcattgtagcacttagatgtgtatagcaatctttattatctgcctctgtccctgaagattatataccccatcttttttttacattcccagtgcattgtgatcatatattattcatctttatgtgaaacatggtgacaagcatatagtaggtgtgtacattttgcttgaagtaaagtgaaatcaatcttgttcccataccactcaaccttactacctttattcacccagatactaatcaggtactgcttcattccagatgcttagaaagatgagcaaggcacggaatatccctgtaggaaactcgaaggcccatcagagagacagacacataattgaacagtggtgacacaatatgctccatgacaaacatgtgtgagactaactgcattagaattccctggcatgctttaatgaagatttccagactgtacctcacacctaatgaattaacatatttgtgctgcttcttctgtcttctctgtgcccctcttcccatcgtttccaaccaactcagccagtcactgctccctccagcagggaatatgcccctgtgaaatgtacctatgggaggatagccatcattggctagacctggaaactagttattctaacccagttaataacaaacccagaacaactgaacccctaaaaggcggtggatttggacaagaagttctagagagtatttgctaagaggtgttgatatgttgcaaagaatcaatcacttatttttcaaggatagctttaaaaaaaaataaaagcccacctacttagtctattagaaataaagtcagtaggccaggcacagtggttcacgcctgtaatcccagcactttctgaggcagaggcgagcagatcacctgaggtcaggagttcacggccagcctgaccaacatggtgaaactgtctctcctaaaaatacaaatttagctgggtgtggtggcacatgtctgtaatcccagctactcaggaggctgaggcaggagaatcacttgaacctggaaggtggaggttgcagtgagccaagatcgcgccattgcgctccagcctgggcaacaaaaaaaaaagaaaaggaaaagaaaaaaaagaaagtaaatcactaagtagccttttgcaagacaaacaaaaaaaaaaagaatatttaggatttagtctataaccattgacttttggaaatcctgtccttcctaaggaaaattagaggaaaaaaaagagctgaagtctctgttgcatgagaaataccatttgtgattaaactgctgtgaaatacatactcaaaactgtgggaaattcttgccacatctttctaaaattgctgtttgatgtcttacatgccaaaatgactgtgaactagtgctctcttgaaaaccacctaaatgatccacgacaaggaagtcattaattaaataataaggtggatgtggactactatgcaatcattaaaaatctattctcaaataatttttaaacatatagaaaaatgcataaaaatactattaagggaaaatataggttataaaacaatattatagcattgttctagttttactaaaaaatcgtgtgtattcaccaaaatgttgacagtagggtttaaaatggactggtacttaaaggtgattcctttacatttttttctacttgaaatatttctatatttatttgacttcttcataatggccatgttttatttttagggctgccattcaattggtcatccaatctgggacaggtttcagagtaaaagaggaaaccttagcaataatatgggactataggcaaaagcaggactgttttggacaaacacgctatgtggttgttacgggctgaattgcatcccccaaaacccatgtgttgaagtcctaacctctggtctctcagaatgtggctttccttggaaatagggttgtggcagatataattagttaagatggggttatactgaatgatatagattgggtctttaatccaatatgactggtgtccttagaaaaaggaaaaatacggacatagacacgcccacaaagaaagaacactgtgtgagcaggaaagcagagattgggatgatgcatctacaaggcacggaatgccaagaacagacagtaaccaccaaaagccgtaaccgcttagtgggttcaccttacctgctgcctacccagagccaacttctcaagacaggggaattgcaatagagaaaaagtaattcatgcagagccagctgtgtgggagactggagttttattattactccaatcaattcccctgagcatttggggatcagagtttttaaagacaatttggtgggaggggaggggcagtgagttggggagtgctgattggttgggtcggagatgaaatcatggggtgtcatgttcttcttgcactgagtcagttcctgagttgggggtcataagatcagatgggccagtgtctctatctgggtggtgccagttgatccatcaaatgcagagtctgcacaacacctcaaacaatgaccttaggagcagtttagggagggtcagtatcttacagcctccagctgcatgactcctaaaccataatttctaatcttgtggctaatgttagtagtctaatccccaggcaagaaagaggtttgtttcgggaaagggctgttatcacctttgttttaaactataaactaagctcctcccaaagttagttcagcctatgcccaggaatgaacagggacagtttggaggttcgaggcaagatggagtcacttaagttggactgttttcactgtctcagtcataattttgcaaaggcggtttcaatcctataagaccaacatacaacagattctcccttagagactcagaaggaaccaaccctggcattaccttgatctcagacttctaacttccaaaaccatgagacaggaaatgtctgtttaagccactcactttgtggcatttcggttttttgtggtaggcctaggaaactaatacaatggtcattgtagttattttatatttagaaattaagagcaattctggaggtgagagatgggcaggagtagggaagaatgaagttcagtgcaacaaaagaagcttgttcactcaactaagactgtaaacaatgctgtttttcaaaaatacgtattccttctttctgcctggcccctctttagagagccatgtcctgttgatatcaagcttgaccatgtgacttgcttcagcctgtggcgtgtgagtcacagtcacatgttccattgagaaatgggagctttaaagaccatgctacggttctgccacctttgtcgtttgccatgacacgagcttatcctaagggagagctgcttctttagcctgaaacagagttgaaactgatctgcaatgaacctgtcacatgagataaaaatgtatcttttggccaagtgcagtggctcacatctgtaatcccagcactttgggaggctgaggctgggggttcacaaggtcaggagatccagaccatccaggccaacatggtgaaaccctgtctctactaaaaatacaaaaaaataaaataaaattagcaaggtgtggtggcatacacctgtggtcccagctactgtggaggctgaggcaggagaattgcttgaaaccaggaggcagaggttgcagtgagccaagatcgcaccactgcactccaacctggcgacagagagactccatctcaaaaaaaaaaaaaaaaattgtatcttttactagtgttattcaccaagattaggaggccgtagtgttactgcagcagaatgtagcctaagctgactgataaaacattgactaagcaactctcaggtaccatgccaggatgaaaaaattaattagacacagaccctgccagtgaagaactaacattatactgtgtaccattggcctttaaaagataaagatttttggccccaggtgtgttctatattttctgtaagacctgcaagtaaatgttaaatgatgttatttcaaccggtttttctgtagcaaaaatctttaaaagctctcatattcaaagtggttcttgcaatcttgaactacatgtacagatataaaatctgccaattaaaattttatggtttagggaaaaaatcccctctgaaaaataaacctaggtcaattatttcattatttaattctcatttggaaaataagatgttcagacattgagttatattagaaggaagaaaaccacttctgtgggaacagtcaaatttatttcatttactattagagaatgttaatttcaagaagcaatctttgaaagcaaccaaatttggcaaagacaagtagtcttccctgagaaatattggacagcaacagattatataaggaaaggacagaggggagagacatctcaagtgtaggtctggatggaggtagaagagtcatgttctagagtcagcattgtaaagcaaaaattgcatggtgtcaaaattatccttgaaagtcccttaaatggcccttaaattgtctggacctgtgcctttagaggttgaaaggccaagaattaatgtcttttgtttctctggggcagtgaaggccaaggtctaatttgaaaggggcaaaggacgatggggaaaataaaggatctctgcctttcttggtccatcttttggtctcctgtcctctctctaggtgactcttcctccagctctcctcctgctctttcccctcaacagtgcatatagctaaagtcaaacaagttaaatgtgcatgttaggcaactctagtccttacaacttaaaaactttaaaatggatgcattgggggcctattgtgtaccctgtcctaggctagatatggaagagatataaagcagggatgggggtgagatgaggagaggaaacaacagacctcacaggagccaggaagactgaactgcaaacagatgatataaatacagtgtagtcaagtcaaggcagtagctcaggtaaacacacaatgccacaaacaggagttctcaaaccttggctgcattttagaatcacttgagcttccaaaagcttcaatgcccaagacacaccccagatgcaccccaattgccagtgaccctggaatctttggggaggacctggtcatcagcatgtctttgagctccccgggtgagtccacatgcagccaaggttgagactgggggctacagctgtgtagaagagcatctggtgtgggtctgaaggctgggcaggaattagctggtagcagtgtgcattccaggctaggggaaccccagtactaaagcttcttcagcacaaagaggcttggtttgtgctttgaacatagcgtggttataaattaaagaataaccaaactccttgagttgaatcagtacacaccataatgcatcagctcacattgacatggcaacctcttttcatctctctttgttaagggccactggttctttaaaagcatgcgtattaatggattctatctgatgatgattcactccatagttccatcatgtatgcatctctaaccagtataagcaaagcattttcctttcaagagtctaatcctagcattgtgccatatccatggccctctaagatacacaccccatctacaaaggcgacatgtactcttaaggtacaaagcatttcctttaggggagtgattgcctgtgtgtccaagctgatgaagggtgctcttttaagttggagaaaattgattttgttgtggttgttgcacaaaggtttatgttttcaaagcctccagataaaaggcaccatgggcagctaacaagcccctaataggactacatcaagttttactcacctgctgccagggcttgacttctgcgtcttgacgacatgaaaccaggctttgacagcattcatttttgctgaaggaccctcccccagcctccttccataaatcctatgctcctttattccgtattcattcagcacagatgtttttatggccataatatatttatactaattcagaggcttgccatcagtagataggctcatctctctgatccggaaggcggcagaggcactccttctgacattgcagatgaaaataaggtctgcttttttcccacagtgctcttcaaaggagcaattttctaaaattcgaacaagggtgtcatagttaataagatggaattctccttttctttttcttattatattttccaaatcaagggcagtagattccagaactccaatgacgtcaggccactgtactttcaaaatgctgttctcagtcaggtttcttattatctgatcctggttcagtagattgtctcagaattgactttttagattaattttgattcttagttaaattactttttaatagctaattaccacacagtctatctgattaacggtattgtgattcagatcaagcggtgagatgactacaggtaacagacccttgctatcatttgggtgttctcacaaggaacaggagccaggtagtgaaccatgtgcctaccctttgggcagggaatgggtggctctaagagatgacagatgctgtcatccggaatcagttctcatcttggtcaattggatgagtcagagagattttggaaacatcttcaggctaacccaatttacattatagttatattttaattgccttttaaagtctaaatgcagttgattgtgaaaactgtgtcacatcatttaagggaactagagctttctttttatggaaacgcaaaaggacctagcaggaaaataccacattgcctaagcagtaaagaaatatgtccggccgggcgcggtggttcacacctgtcatcccagcgctttgggaggccgaggcgggcagatcacaaagttaggagatttagaacatccgggctaacagggtgaaaccccgtctctactagaaatataaaaaaaaaaaaaaaaaaaaaaaaattatctgggcatggtggtgcttgcctgtagtcccagcaactcgggaggcagaggcaggagagtagcttgaacctgggaggcagaggttgcagtgagccaagatcatgccactgcattccagcctgggtgacagagtgagactctgtctcaaaaaaaaagaaagaaaaaagaaaacagaaagaaatgtgtcctcaaagcttcctcagattgttctagaaaagagcactagcagcccccaaccaatgcatgccgtgaactcattccaggtatcatgcacctttgattgtttcactttccttgggtcaaacctttagaaagtgggttccctgtctcaggcactgagctaggtaaattcaggggataagatcaggaagagtcccttcctgaatccaggtactcccactccccccggacaacaaggtcagaggcaatccctcgccttcacctctcatcttatttttaaataaaagtttctctttctttatgttcttcgctttctccttcaacaagattgtttcctgctccctccccacccctgctgcctctctgaatgttgtttctcctcactgcactgtgctgtgcagtgaatccatatttcttttccttttttccttttcacacttgaccacgtctttattcaataactctgccccttcacagcacagggcccggtggaggctgcccttccagggagcccaggctcacgtgtacttgccagggctggctgtccctgtccagcaggtcacagacctctcctggtctgacactgaggagtgaccagtgctgactcagagcagcccatctacgggcgcactgttcagaaagtcgtggaggtagatatactgctccagcgttggggtcataaggccacaggccggggactgctgcagagccacgttaaacagatccacggtacactcagtccctgcctggtgctgcagctgctccatggccaggaaggtgcccagctgggtcgcacccttgctcgagtcactgagcagtgtgcctggcttctggctcttgccctgagagcagcactggcccatggtagccaggaagggcggcggggtggtccttggtacctggagccatcaaatgctgggctctctttgggcttcttcgcagcagccttctttctttactttactcacttcctaaataacactgttctcaggaccttcattactgcatatatattaataattcacaaatctgaatttcatcctttgcctctcatttggtttccaaatttattttcactcacaattcctacatagtcagacaccttcaacttcacgtttccattttgattctttgtcttgccttccatgtcttgtagcttatctatttttttctgtctcggtaaaagttcccatttgcccacagtagaggattgaaaataatctggcttttaaaaataccctgggggaaacaaaaaaaaagaccattcatcagtctgctgattctatatctctgagtaacactgtgaattcctgtgactctagttgagttaaatttattcctagcttttaaaaataaagccaatgaaagaccagagagattattacaaagcctgcattcttgtgaagttgctgaatccacagttttattttagtcaaatcacatttccatattgcaaaaatattttctaaacaattaatgggtatcatatggggtcagtcttgtggcgtttattcttttgtaacactgagctaaagtctctatgggaaagataaataggttgttggagaattaaactggtcaagaagtgaacattgatgcctaaacctctcctctgaaattttgagcacatgttaacataggcacataaaaaagagccttagcagaaagaagaaacgatatttccattgttgggtcacagtggtcactaaaggggatataactttaatttctcatttgaacgtacatggcatccatttaaccaactcatttacagcatagccgcctgtcaagcatataaaactgtaccacattgagctggatcggtttttaaattctaatataatgcacctgggcacggtgggtcatgtctgtaatcctagcactttgggagactgaggctagtggatcacttgaggccaggagttcaagaccagcctggccaacatggcgaaaacccgtatctactaaaaatacaaaaaattagccgggcatggtggtgcatacctgtaatctcagctactcaggaggctgaggcacgagaattgcttgaacccaggaggcagaggttgcagtgagccgatatcacaccactgcattccagcccgggtgacagagcaagactctgtctcaaaaaataaagagaaaaaaaaaattgttacataatgcaccctcgcacatgctgttggatgtaccatgattcaaactatgaattctgtaggaaagctacattttaaacatgtttgggtgaaaatgatgtgtcaatgtaggttcaatgactgtatcaaatgtaccactctggtgggggtcattggtaatgagggaggctacatgtggaggcaggaggtatatgagaaatctctgtagctgactttcaattttattataaacctgaaactgctcttaaaaaaaccgtaaaaaaataagtttgatgaacttggttttcaagcaggtagcaattaagactgtggttgtcatagagacagacctatggcaatggagatgaagggtgggagcttggctttatcagaatggcaattctgcatttttgtgaatgtcagcaaatgaatttgacccatgacgtatggacgtagatcaaagggcacatttagcatactgtcaatgtggtgctcgtgtggccttccaaaaggccagttccacagtgataaccaccactaataatcctacaaacctctccagctgctttcagtgacatgacttctgatctggagggaaagaaaagaggggtgatattttataaatatcaattttcaaaaatctctgatctgttggtattaactgatgagctcagagatgctcggaaacctcctgcctgcacaacaactgtaaccatggcaacctgcatttttaaaggatgttaaagatgtttttaaacatcaggtgagaaaaacagtttccacacaagtgtttgtctgggatgttatgtctaattcctccagtacacatttttccgttactgggacttgatacaatgctggaagctttcctgttagggcagaaattgggcaacccaagacagtcacagatcttgagatcgctgccattgctatgaaaatgaggcattcttattgcatctagactgagcatcagcatgcctggtgttcttatacgtcatacatgaaagagattggcaacccttcctgaaagctttgaatttttgatatcatttgttccacgtgattttctaaggctatattggaccactatacattctagaacaaattaattaaagcctccagtttccagggagatatactaatatctcaataaagtgctggatttgagtaaaagacagagaatcatgtctgtaatcctagcactttgggaggctaagttcaatgtagtattcagaatttgaatattgagcttctatattaaagaaatcatcaaataaataaataagggtctatcagttttctgaagattcagatttttgttgtttttaaatgagtaattctaattgtattttaaatgagtatagggagggtccattttaaggagtcagaatgtaatcaaagatgcctattactattatattttcagatagaaacagataaagttcaagcagtgcaaatactaaataagcaaattaagcattatgtcttttttttatggtctgccactcatccacaaccaccagcatttgtcttgacaaaccaccaacatttccctcccccgccttgactgtgcatggatttgcatatttatagagttaaagaatcacccaccatggttctctttcttatccacattcttgtcttacccatccgtctctgtcactctcctgatatacctcttccctactaattacattaatcaacaacaaacaacaactctaaaagattccccgagatgagagtttcagaagcctgagacgctatgtcaaacaacccaccgtagttattcagggacactgcaactcaaaatgaggtagccatcgatccagagaacaaatgatcattattcatgtaactctcttctttgcttaagaatccatctttttctatcagtgccaaattctctcactactttcctggttctaattcagaagtaagtaaagtcagctagtccctttgtttgggggttaggcccattttataaagaattaaaggaaaataggttaaacatgaactgcttctcagacgtggcatttacatgcctggtgcttccttagctcatcatataaccaagtactggaatctgttttacagataataagaaacattcacgtgttccatcttttacatatgtgaggaccaggcactgactagaaaattttcatcaccattgtcctcatcatcaccatcattagcatcttgtcgtcatcattgtcacgatgacaaagatgctttcatgatgatgaaagcatcatcatgctttatttacgtgatatcattgaatccttccaacaagataccagaccattttattgtagacattttacagatatttacactgaagttcagagttgttgagtggtttacccaagaatacgtagcaagtaaatgatagagctgaaaattcaatctgtctttctctagtgctaagccttagtttccctaccaagttttaaaggttgaacaaagcaaggtgttgaaagagcaccctgagtctgacagtcagaggggaatcagggcaggaagtatctactgaagaggtcctcaaatttcaggttgcctaaacagttactgaatgagcttgtcaaaatgcataaagaaggccctacaccactaccactaccaccaccctctgacacacatacacacagattgtgattcaataggcctgagattagtccaaaatctgtatttgtggcaaactccccaggtgatttcaacagagacagtctgtaggccacccttggagaaatggtgttatagctggattggggactgttgagatgcctaaatccccaacttgtagagctagcttgggctgctcccaagtctagcacactcattgatatggtttggctgtgtccccacgtaaatctcatcttgaattgtaacccccacaattcccatgtgtcgtaggaggaacctggtgggaggtgattgaatcattgaggcaggtctttcccatgctgttcttgtgatagtgaataagcctcacaagatctgatggttatataaaaatgagaatttccctgcacaagttctcttctcttatctgccaccatgtgagacatgccattcaccttccaccatgattgtgaggcttccccagccacatggaactgtaagtccaataaacctttatttttgtaaattgcccaatctcgagtatgtctttatcagtagtgcaaaaaatggactaatacactcacctatgtagggaaacctctttgttccctacataggttctctgcattggttcagagtccatctcttccactgggatgtccatcttgtggtcaaaacctgcaccccaggtaacataaaataaaaataacaatggctataattgtgaaccgcccgctaacctcctcttgtagtgctccaggccagacgctcatcaccttgttttgttgtctttgccatcagcattatagtagagccattggcactcacccatgtccagccccgttcctcctgggcacacagaaatttccgactctgttttctattgcctttgcagtcagatggaaccatatgactagtgctagccaaagtgtgtcatctccactctctttctttccttggtaccatggatgtgtttgatatggtgccagctgcaaagtagtggaggcttcttcagtgtgggttcttgagctgtcatatagcataaagccgccacccaccattctgaattcacagcatgagcaagagataaacaaacctttgttgagttaaggctctgggattttgttttattttgttcagtttttaatttctgtaccatatcctaacccatcctaaccaataaaacctcgtcgctgtcaacatcatcatcatcatcgcaataataaaatgtattaattatgaacataaaaccttaccgtgtgctgaacattagactaagcattttgcaaacattatctaatttaataatcacaccaacactataaaaaagacatagttgttatctgtgtcttacccagctggtaactgatcgggaaaaaaatgaaaacccagcagcctgactccaaagcccgtgtgcttatccaaacactacagcgtaggttgcttagtgccagcttcagtggttagttctttacatgcttatcataggtaatcctctgtcaacctgtagaagtaggcatgattaacttaattttccattgtgaacactgaaggttggacagattcaatgtctggtctgaggccacacatcacacaccacacactacataccacacatcacacaccacacatcacataccacacaccacacaccacacatggtggagttaggtcacaatccacgtccctctgactcttgaaggaagcatcatttattgaaaaactagagtgtctaagcaggtgattttgattccttcaagtctgtttcagaaatgtctaggggccccacagatctcctgaggtcaggggttcaaaaccagcctggccaacatggtgaaaccccatctctactaaaaatacagaaattagccaggcatggtgggggcgcctgcaatcccagctactcaggaggctgaggcaagagaatcgcttgaacttgggaggcggaggttgcagtgagccgagattgtgccattgcactctaggctgggtgacaagagcgagactctgtctcaaaaaaagaaaaaaaaaatcatcgttttactgatgatatttacaataacagcttctgccagtaatagagactaccaataaccaatgctatttattaaatactaacagtgtgtatatatatatatgcatgctggctagtgtcacgccctcacaaagtggacattattatcttacagataaaaacactaatgcttggagagtttcattgtttgccacagggtgcccaggtaaaaccatggcagaactggagacaatccaggcagcctggctccaaaaccttgcagttggccagcacactctctgcccagagcccagcccacgctctgatcacagaaagtgtgtgggagatgagtagaagcaggagaaaaaaaaaaaaaaagtaaaatgtaggctaaggggttgtcctgtaagaatttaggaatccctaagaaggagaactagaggatcaagggaaaaaggccaagtccagtaagtccctccaaacgtcaagtggggacatctcagtagagtatacccctacaactgatctgccaagatgttccacaatacaaaaaggattctgttggcaaaaacaatgcccacccctgcctgtcttgaagattcaaaatgcacagtagatgatagatgatggatattctaagatttgttgtagcaagaggctggttgtgtgcttaactcttcctttctaatttgcttttgaccacagcaccctttttattatgcaaaacctattaacatctactgaaaggcactcagcatttgagggaggggactagcaggctgcagaggagggtgctaagttctgtgctgaggaaggtggttggttgtggaagatgtagtggtcacaaatgagaagagtggacagtgggtacagggtagggatgatgagacctggaattgatgacctcagcagagaaggggaggaaggataagaagcaaataacagtgacatatgtgtaagttaaaaagatggaggtagagctagtttccaagatggcttaaaaatacacatgggtgccggtttgacctcaaaatagaaattagagacctagaattcaggagagaaggcagaactagcaaatggagactctaggtcaccttacctctccttttcttggaggaatggtggaaagagaagaacaactgaaaggcttcagcacaatcgctctgtaggacccaggagagagaagagtagcctggaatcaacagtggtgggagaggctggagggcctcaggaaattcaaggcaaaagagtagttagctctaatgaccattctttaaaagtagaaaaaatgaaagtggagatgtgcattgtttgtggaaagatagaaccttcctcagtcagaaagcattttgccattagcagcaggcagtgatgctgacaatttgcagttggtggccaggttttaaacagtagtttgggcaagaaagggtatccagcaaatcaatttgcaatagctgatccctgtcattaagggagtcaattcttgatactgtaagtgaataaccaagtgctgctctggtacaattgaggtatgaaataccagacctgactattttatgtaaatctctaacatggtgtttaagcaggacagagcagcggggaggaaggggcttaagcagaaatgggctttgaggacctctcggcccagacaggaagagtaattgggctaagatgagagaggggcaaaactcagcacatctccaaagccatccaaggttgcggacaattaacctcttgattcctccctcctttccttccaagatcagatttttatcgtctcagaaacatatgaacttcaagaaaatgtgaggaacacagactttctgagccagcttccattgacatgccatttgattaatttatgtggttgggacagcagttcagagggaatatagattgtgctcttacctgccccatttccatatttaatatattcaggcatggttatgatagagcatctcatgtttacactaactttgtgtcttttgaagttcacttttaactttgtgttgataaaatactattttctaattcagatttttcaaaaaatgcccgttgggcatcaagtagcttttacagaatgaggtgttcttagcattattatgaagcaaggacaagtgtattaccgccattcacggagacatttttgcagtgttgcaaatctcccaaatgtttcaaaaaattacagcagttgcctgttgcacctcacaattagctgcctaagattctaggagagaagcagttggattttatatgtgaaaatgcctctatttgctgcatttttactttttgagaagttgcaagttacatgaaaataaacatactatataagaaaacacggcagatttctcctggtgttttaataattccacgaaggtttatgaatattggcaaacgtatttgcagtggtacttccctgctatttactttgtagactttgagtcttagattcttgtctgtaagtgaaatgtagtattaaaaaaaaaaaaaaggccgggcacagtggctcacgcctgtaatcccagaactttgggaggctgaggcaggtggatcacttgaggtcaggagtttgagaccagcctggccaacatggtgaaatcccgtctctactaaaaatacaaaaattagctgggcatgctggtgcatacctgtaatcccagttactcactaggctgaggcaggagaatctcttgaacctgggaagcggcagaagttgcagtgagctgagatcacaccattgcactccagcctgagggacagagtgagaccctttcccaaaaaaaaaaaaaaaaaaaaaagcattacaagttggagtagcctgggctcccgtgttggctttattactgagctgtgtgcaggtggatgttttgctaaatctttctatgttccacgttatcaagaccctttctctcttttcccaaagctctcgtatcaattccatttaagccaaatctcattatttcattgcttttttttttaattatcctatttttaaaattattctccctccttctggtttccattttcaaatagttcaactggatagacataatagcaaaggcatagaatcaacctaggtgcccagcagtggtggactggattgaaaaaaaacgtggtacatatgtatcatggaataccatgcagccataaaaaaataaaatcacaagctttgcagcaacatggatgcagccaggggctattatcctaagcgaattaatgcaggaacagaaaaccaaataccacatgttctcacttataagtgggacctaaacagtgaatactcacggacataaagatggcaacaatagacagtggggactactagagtggggagggaaagaggggtatgagggttgaaaaactactagatgctgtgctagctaggtgacaggaccaatgatactcaaacctcagcgccacacaatatacctaggtaacaaacctgcacttgtacccgctgaatctaaaacgaaagttgaaattataaaataaataaataaatgtggtgcttatttttaaaataaatgaacaaaaaaaccccaaagagcttagctaggtgttaagtaccatccaatggacggtgccatccattatataatatagatatttacacacacactcaaacacgcatacatgtatgtatgtgtatatatatacacacacatatatttacgactgtagccttctttccagcagaagcagtttgccaaatgcctctgcccttccttagcccaaatgctaatagtagctatttcatgaatagatacagaatgacagagtcaactttacctaacttctccaaaatgccgactccagtattccattttcaaattaacttattctgattataaaagtaatgttcagtattgttagtaaaataaattttaaaaaaaacgaacttgtaatttccccactcagagatagcttctgataacatattggtgcttttacttctatttttttctatccatatgagtataattaaatacatattcacatctatatctatactcattcatatatattcatatgtaagattaaactatatgttcaaattgtattctgctttttaaaatcacactttattttctgggaatgttctcttcataaagttcttccaaaccatgatatttaatgtccacataagaaaacatctcatggactctcaatttattgaaacttttccctagttttggttattctgtttcccaccagtcattaattactttaaacaattctgtgaggaccattcaggtacacagacgtgggtccacagttatctattttcttagcctcagtgcttggaagttgaaatttgtattgaataactaaattcctttgacaattaaaacataattatcaaacttttttgcaaagaaataacactatggtatatgacatctatggcatatgacagtccctgcttaccttatgcttgccggcattcagtgcttaggtttccttttttttttgagacggcatctcactttgtcgccaggctggagtgcagtggcgggatcttggctcactgcaacctccacctcctgggttcaagcgattctcctgtctcaccctcctgagtagctgggactacaggcgcctgccaccacacccagctattttttgtatttttagtagagacaggatttcaccatattggccaggattgtcttgatgtcttgacctcataatctgcctgcctcggcttcccgaagtgctgggagtaaggtgtgagccaccacacccggccaagctttcttaaatgggccactttgattgatgaaaatgataaggtactgtggcctttttttttgccatttaaaaaacagtggtaaggttttttttttgtttctccatgtcttgggaagcagctgcctgttcaagccctctttccttttcctatttgggtgttaatggcttccctattgattcataaaggcccactacttattgtggatattaatctcttgcctgtcatatgtttgttgcctttcttttatgccagctagttatttgaattaattggatttgatgttttgaaatactgaatttttaaatctttagacagatacaataccattttttccttatgcgtattctcttgtttatacaattaacaatcttggcctgttccaaaatcaaagtcacatgaatacatatatttttctaagtttttatggcttcatattcacatctgattcttcagtccctctagatcttactttcgatgtatggtttaatgtgaagtcccatttcaagtttttacccttcaaattaattttccttccaaatgttattttattttattttaaatacccattctttttctggttttgtcacatagctttcatgtgatgttaagctctaatacatacaacaatttactttgggaccatctcatatattaaattttgcaaaaatgccatactgttccaacactcatagttttataatgtgtcttaacacatgacaataaacccttctaaaatacacacaggtttcagaactgccttaattattttttgctttgatttttcctctagaaaaaaaatgtgatcattttctcagactcccaccctacttgttttctcaaagctactgtcacactctggatgtacaaggtcaggggtggtgagagatcagggtgtttaggagtgtttgcttgactgatggagacacagggttcccaaactggaagatgacaacataggagaagcttccagttttccagtcaaagatactatgtttcatgaggcaaagcgtgagaaactcaccaatacaatttcccccaattccactctatcagcctttgagattttccggacagctatctgtcagtcttagtacttaaaattgttggaagtttgaacacaattcttcaaagatattttagtgaggaacaagagattttgctttggaagatcctgaacagatttccttacaaaaagtatttctaagcacccatccctataatatatctaaatgttaaatgcttattgatggagtaaaatggaaagtccaagagtcgtaacattatctggtaacagtgtggatgagaggtatgggagatgtaggcatgtgcatgtttcctgatttgaccaaacttttcaacatgagtgacccttctaactagttttccaaaaatagagagaagagatccagcatcaatgaaaatgacaaaattgacaaagttttgccttggccctcttccatcgtcgctatcctcttctcctctactcaacctccccatcagtctttttacccgcccgcctccttttttttgagggaagctgtattaggccattctcacatggctataaagaaatacctgagactgggtaatttataaagagaagaggtttaattcgctcgtggttctgcaggctgtgcaggaagcatggtggcttctgcctctggggaggccttaggaaacttatagtcatggtggaaggcaaaggggaagcaggcacttcttcctggcagaacatggcagaaaaggggcatggcggaaacagggcaagagaatggggtggggaagtactacacacttttaaaggaccagatcttgtgagaactctatcatgagaacagcaccaaagggatggtcctaaaccattcatggaggatgcacccccatgatccagtcacctgccaccaggccccacctccaacatgggggattacagttgaacatgagatttgggtgaggacacagatccaaaccatatcaaaagcttttctaattaggttactcattctatgaaaatagactgcccataaataatctttgtttttcagatgaagatttggcaagttctgtgcctagcacgatggctgacatgagataagtgcacaggaaattttgaaatatctgtgtctctatcttcatttccttgtttgtgtctccaatttcctatatgccatcaggggatttagtgacactgcaaatagcatgctctttggcaggcacgcctctcccatttccccagaacctcttcgtctttctgaggcatggagtcccaagctgtatgttttcaggtagtattgtaggaagattaacagtttcctgacatctttcttgcaaaggcatgaatacctccaccggtgcagatcaacataagaaatttaatgtttaccttgccattttataatgctatcaactttctcaaaatctgtccctctgcactctgttatttaagatttattgtcatcctgcatggtgagatagctggtggacattagccccattctcaggggtagctgctatggttgaaacatgctctaccaaaattcgtatgttgaagtcataatccccagtaattcagagtgtgaccttacttggacataggatctttacagaggtaatcatgttaaactgaggtcatttgagtagaccctagtataatatgactgatgcctataaaaagagaaatttggagatagactcacactcagagagaactccacatgaaaataaaggcagatggccgggtacggtggctcatgcctgtaatcccagcactttgggaggccgaggcaggcagatcacttgaggtcaggcattcaagaccagcctgggctatagtgaaaccccgtctctactaaaaatatgaaaaatttagccaggcgtagtggtgcatgcttgtaattccagctactcatgaggctgatacgcaagaattgcttgaaccccagaggcggaggttgcagtgagctgagatcacgccattgcacttcagcctaggtgacagagagactctgtctcaaaaaagaaaaaaaaagctaaaaacacaaaataacagcagaaatcaggatgatacatctataagcccaaaaatgccaaaaaatgcaaaacaaacaaacaacaagaaaaatccatgagaagctaggagacaggcttggaacagattcctcctcacagacctcagaagcaccttgatctcagattttcagcctccatcactgtgagacaatcaatttctgttgcttaagccacccaatctacagtactttgtcataacagccctaacaaacaacatagtagataaaaacaaaaaacaaacaataaaaaaagaaaacaaagaaggctaaatagcttccttctgaatgtggatcgtttcatcagaggatttgatctactgaaccttctactgcactaaaaattctcatttcatcaagtataatgaactgaagtcaaagggatttatttgatgctgaaccaagccaacactctccccaccccaccttagtctaccgttaacgtgtccgaaattgcatgcgttgttttgcttggatgttactagcccttgctgggaaaggtacttggcactaatgtgactatttaaactaatattcacaaagcagttaccctgtgccaggcttatatggattcatgtaattctcacattaattctgtgagactggtgccatgactatgccacttacatatgtccagccagaatctctagttataacttgttcctggtcatacactctgctggttgtgaatccagcgtttgaactcaggcagtctgaccctgggggtgacatttaaactactttattgctgggttctatgttctcaaaagtttagaaggtatttgttaaagagaattggaatatttgctatggaacttgtcagagcttttaaatatgctattatcttagggaatctctgagagtgtggtaaagtaagcagcatttctagcacatagttaaccgtgggtctctttttattaaggcaagatctcttgggactggtgtttcttgaatagacttgccagacaaaatacaagaccccattatgaaatttcagataaacaatgactagtgttttagaataagcacatcccaactattgcactggacatattaatactaaagaatttgtgtttgtttatctgaaattctaattttactagggcgttctgtatttttatttgcaaaatttggcaaactatatgaaagatgcttcgaaaactatagagaacacagccaaagatccctgcctctcccaatcttctgggcctctttctttaggaaacaaacataaacctgcccaaactgaggttgtaccctttttacctgccctgttaccttcctagcatccatcttgctgtccttcattctgccaccctggggttcctatcaaactctgcttcctgtctcttatgacttagaacatgccatcccagacccagggaacagaacaggcatatccctggttatttcaaagccagtatcacaccagcatgtagagatatgaccagacaataacaatcctcctccagttatcactcgagggaaaggagagggacttatggggaacagatgcagataaaacccaaatctgatgccttgaggctggtcagtatgaagtctgtcctgtggtatccctctgcaacatttccatttcaggggagttgagggcttatcaagcttaggaagcaatgtgtactgaaaaggatgaggtcagttcggggtctgtcaaatcaattgaacatatcttgaaccctgaattctatcatcaatctcactttacaatccatcccttccaattaatgctgcatataataacaccactcaatgatgttcatacatcccatcttcttacttggcactatcttttttttctttttaagagattaatttgtctttccaatatattcaagttatcttgaccaatgtttcagaattacttagagctttatggattgcagcaagaccgaagcaaatgaccactcataattcagaatatttctgagccagaataaagtttacacttcatgaccataaagaggaccctttatgcttgtatgtagaagctcaattcaggttccaaacctgcactgtccagttaggtagccactagccacctgtggttacttaaatttacccttaagctaattaaaataaagttaaaactttagtttacgagccatatgtattagtctgttttcacacttctataaagacatacctgagattaggtaatatataaagaaaaaaggtttccttgactcacatttctacatggttggggaggccttaggaaacttaacaatcatggcagaatgtgaaggagaaacaaggcacatcttatcacagtaaagcaggagagagagagaaaaagagccaaggagaactgccaaacacttttaaaccatcagatgttgtgtgaactcactcactatcatgagaacagcttgggggaactgcccccatgatccagtcctctccaaccaggtccctcccctgacacatggggattaaaatttgaggtgagatttgggtggggacacagagccaaaccatatcaccatgctagccacatttcaaatcatcagctacgtatcgctggtggctattatatgcagtacatacatactgcacagtgtagatatgaaacgtttccatcatcatagaaagctctcttggacagccctattctagatgctttattctcaaacatgccacaggataacacataagatattggcatggataccattctatttggtttgggacagaagaaataaggaaaaatgtttctgaaacagggagtccattttagattattttatatgaagttatcaatagtttattaatatattgattaaaagatgacaagttctcaacccccacgatagcccactggtgaagacagaaccatgcagacactattaattcggctctgtttctttttctaatgagccagtgtggagactggggaagaggaagggattgtttggaaagatcagagcatccaggagaaactgtatggggatgggggcaccactgactgaatcagagcctccagtttgctttgggtgaccacagagggactgaacaaacccctgtgttgtcagtccttagttttgagaatagccttgaccagcacacttgttcactgaggaaggatacgaaaatgcagataagttaaaacaaacaaacaaacaccgtcattcttactctggcagccagatgagtcaccaacacattaaattctttatagatctctataccttcctttatgtaaatgtgtataatatgctcacaaaaataagatcataatatacatactgttttttcaacctgcttttttttttttttttttttttttgagacggagtttcactcttattgcccaggctagagtgtaatggcgcgatctcggctcaccgcaacctccgcttcccaggttcaagcgattctcctgcctcagcctcccaagtagctgggattacaggcatgtgccacaatgcctggctaatttttgtttttgtttttgtttttgtttttttttcagtagagacggggtttctccatgtaggtcaggctggtcttgaaatctctacctcaggtcatccacttgcctcggtctcccagagtgctgggattacaggcgtgagctaccattcccggcctcaacctactttttaaattaatatgcttcaacacatttccaagccaaaatgacttgtaaaacgttgtacttaaagattgtggctacgcttggtggctcacgcctgtaatcccagcactttgggaggctgaggcaggcagaccacgaggtcaggagttcgagaccagcctgggcaacatggtgaaaccctgtctcttctaaaaatacaaaaattagcctggcgtggtggcaggtgcctgtaatcccagctactcaggaggctgaggcaggagaattgcttgaacctgggaggcgggggttgcaatgagcccagattgcatcactgcactccagcctgggtgacagagcaagaatccagctagagaaaaaaaaaaaaaaaaaaaaaagtccttgtgcattaatctgttctataggtgtttttagtggaacatttagtgggggtccagttcatccccaattataaatataattccactgagcatcctcaactttgtgcacattcctaataatctgcaaggaatacatttatggaaggagaattactgtcttaaaagggggttggggtgggtatatattattaaagtttgcgataaaagtctttagttgcttgatgaaatggaggcagaagtttaatccctaaggacccttctaattccaaagttgtctgagtgccggattgtagctctgttgagcctgggtcttaagtctgagcgagcccttagttaccttcctctcccatcagcctgagccagagttagcctgaggtcccaaactatgagcaggagaatgtcaccctaggaatggcaactagaaagtttttaccccggatgccatgatgaggcactgccatccactggagcttgctgtgattatggaaatgttctctatctgcacatccagtatgataagcactgaccacatctggctgctgaggacttgagatgtggctggtgtgaccgaataactgggattttaaatcttatttaattttaatagccacatgtggctagtggctaacattttagacagctgttctaagagcatacctctgagactcaaatactcagatctttgccacattgttttatcttaaatatgacaattgataacattgctcatgctcagctgcttgcttcaaatgacatttatttccctcgctagttcttcaaaggtagggactaatcaccaaatctccaatgatagtctgatgccatccccaggtctgctacagcacaaaggggaccctcaatgaataagcatgtcaacatcaatcactttcctcaaagtttaactcagctatgatagatcatggcatatccgcaagccaagctactcatccaaaatatggagatcttgtaagttggagattgtgatgataatagtacctgtcccttagtattgttgtgaggattaaatataagaagagcacttaatattagtgcctagtgcagggtgagtctccagtgaatggggaccattactcttgcctccaacattgtagcaaggtcccctccacatagggataagcctgtcaagacccacgcctgttactcaaaatctcttttagggttatttaaatacgtggtcaagtattgcattaggagaaatggcttaagaacaagagaatgtcaaaccaaattgagttccccttattgtgtgctctcatgaagcacttaccacaatgataattatttgcagtagtattacctaatacctgcttttcccaccatgctataaacacaccagagcaagactgtttatcttgttcacggatgtattcccagtgctaaacatatagtaggtgtttaataaatcctgaatgatagattgaggatgagtgggtagtagatgggcaggaataaaggagctacgggaaaccctagcatagaaaaaaatagtaccagaacccctgaaatctagtcctgtttaggttcacagctaactatcggtccactgaaaagccctggttttggcttctctgttttataaagtgaaaaaggttgatccagattagggtttttcagcctcagaactatagacatttggggcagataattatgttgtgggaggccgtcctgtgcttataaaaggatgtttaatgcacctgtggctgtacccattagctaccagcagccctcctccgccagctgcgacaactaaaaatgtctccagaaaaatgttccaagcagggaaaactcccccgccgcaccccagttgagaaccactgatttagatcctgtctgaagtcccctctggcactgatagtctaagattcttcttgggaccataatttctgaacatgtgaattttctgacatttcatagatggttatagaattataagaatatttccagctactcacgcaaataactcagacctgattatcaatttaatatttggatcagtgggccattaaaatgctgatttgaaattcaattttccatttttaaaaatgatcactttgtgaattctgttagctggttgattttatttaaatggagtgtgtaatttttcccgctctgtgttcatgaataacgctttatagttgaatgtcagaatgcctgctaatgaccctaacaatcatagcttatttctagagaatccatacagtcattgaggctttgttttttttcatcttccactcgtttccttggaataagacctttaattaatgctcattaagatgcacaaatagcctggccttgaatcctcccagtgtttggttcactctcccctaacttattaaagttgcttctggaagttacatagagacgtgcagttaattcctggaacagtgtgtttgtgcttctcattatgcaaaaaatatacaccttggtcaaaaaggaggtatatttttacacaactatttgttcataggacatgtatgcattaagcctcaacaaatgcgccaccctattggcaattatggaattcgagtctcacatcagagcaaatgtggtggtggcctagtaggactttcaatccccttccttggaaaactgccttagtaaggagttcagggattccaggaaatacaggaaagcctttgggatgtgtagtcccattcatatgaaatccacatttcccagaagaccacagaacttttgtgttccatgcagtgtccctagcactacaagctattatctccttaaatctctcaaccctatcaggcacatgctaacaggaccatgattttactatcaacaaaagggaggatgggcgcggtggctcacgcctggaatcccagcactttgggaggccgaggtgggtggatcacctgagatcaggagatggagaccatcctggctaacacagtgaaaccccgtctctactaaaaaaaaaaaaaaaaaaaaattagccgggcgtggtggcgggcacctgtagtcccagctactcgggaggctgaggcaggggaatggagtgaacccgggaggtggagcttgcagtgagccgagatcacgccacggcactccagcctgggctacagagcgagactctctctcagaaaaaaaaaaagaaaagggagcctccctagagaggtgttaagtaacctgcctgaagtcacagaaccagagtttgaattcgtctccccagatttctggaattgcagtcttttccagtgctacattgcccctagatttaggataaaatacaaatgacttatattttccacttaaaagaagcattccttagcatcaaactaaagttagttcaacatatattcctatcaaaataggttaagtttttttttttttaatttataagtgcttatgaacaggaaacgatgggagaatagcttactttcaatgactgctttgagcgtctaattttaatccatatattttctgtaggccactgtttgtagcttttagagtagatttccctctcttaaaagtaaactttgttttacttagaaaacacagagaccttggagcatagtgattgttgtgtttttaaatttcattggtttaattgtcgtttaaaagtaaggttttttttgttgttgttggtttgtttgtttgttttttttattaggaaaacattctcttcatcacatagccctaaatcaatcaacatattttaagagaactgaaatggttttggggtaactttatttttgctattgtagtctttggaggaaataaatgcaaatgaaaaaatcagttaagatcagacgatggatgtattttttttttcacatcctttcctttataaggttaggaacaaacaaacttcctaggaactatcctaatatggattatcataatctatgtttttacaaaaatagtgccaaggaatggaaccaatttaaatggcttagagcatgagacttttaacgtaggactcaccttttggtggtagctaactgaaatgacatcagatctgtaaagaagtgtcccatcatttaagatttcttcagttacaacctaaaagaagccatatgtttgaagtgtgtgctttgtacattttatgtgaaaacatggtcccagcagtccatattatcttggaactatgcagactcccgaagccatgcctccttttcacagacgtaattattagactatgcatgccaattttaattctagaaaaacggtcactctaggtaatgttctttaagacaaacaaacaaaggctgcttaatccatgatgctgtagtcatttgttggcttgtttattttaatccccaatttacaacaaaatgtgttttttttttcttacagagaacccacaatcctattaacagcgaacttctcttgaatgaaggcattacagcagatttaaatccatgcattacaattttagcaatttaatgaacatcctatttggcgacattattgctttaaaggaataaatcacaaacattttacttcccacta

SEQ ID NO: 2390 - DNA, 554233 bp, Homo sapiens; identical to SEQ ID NO: 2389

SEQ ID NO: 2391 - DNA, 102494 bp, Homo sapiens
tttcatatttgcatatactttaataacaagttcattttagtaataaatgaacaaagaaacagagacagagaacttaacacatgatacttccacaagtttgggtctaaaaaggtttacatcaaagtttaaaacatatactgtctgtgttaacagaggctacaataccaatttggattacgcacattatctaaaacattattatcaaagagtgcaaagttagatcaaacaacatcaagaaaattctgtcctaaaattttaacgtcttttaagaaagtctaaaaacctccttttttcccactgacttcaaaactttgagttttatatcagaatatcaatttgtcattttaactttaccatacatgaaaaattatcaaaaatatatcgatgggtctatactaattgtgactgtttatatttacattaagcaaattctcttgccaagttctttatatacaaattaccaattgtcctctgtgaaattcattaaaaagttaaaaaccacagaaatgtcattagaaacaacatatttcaatatgtaactgctttccatcaatgaagaatatttttaaataacttaattgaaaagtattgaactccccaccaatttcagctgcaacagtattcctcctgaatgttttctgtgatttaagggggaaaaaaaaactaggtaaagcttgattgcaaataattcaatgacaaaaatgtgatgagtgtttattgaccttatcttcaagatacttatagtctaattaggttgacataaaaaaactaagcaataaaaaatgtaaacagtgttagaaactgaagaaacagaaaatttttaaaaactggcaaatccaacgtataaatatttttcatattaatttaaatcacaaaatgacatcccaaatccaattaaattgaatgcaggcaaggctttctgatacttctaataagggccagcattttaaaaaattttgaactattcccaaattggaaataatttagattttagaagcatcataacagataaaagaaatttatcaacatttaagaggcaaagatttaggggaaagttcataaaaagattatattaatgtcactaaaataaacaggccactttaattgttttagactcatagttacatagtaaggaaataaaaaagttgtctttttctaagaaaaaacttgaccacaaaatcataaacatctctaatttaaagagcattggttcagatgaatataaaactggtgcaacaatttctccagtacagatgcatgtctcttgaccaaaaattaactgagtttgtaaaaattgcttaaaaattaatgcctcaagattttctggtttgaaaatagagatttgctccatttttgaaattatcttaatttatgttaattatatactcttctaaagcaagaaatacagctctaaaatatttacctaattagtgctctgtctctggactttaggaccaatactctgtgtgtcctcttcctgactaggacgtttcccaccactgagaccagtgcccatggagcttcttcctgcacatttaaaaaatgtatgtttaagataggaaaaggaaaaagaacagtatgctccaatgcttcattcttaccttgcttcaacaggtgagtttgctgactgtcgccatgagcatagtgtaaaataccactcccttgagagcaacctgttagtatttaaaacacagtaaaattacttaaaatcaaatccaagatgtatgtattattaagtctacaaatccaacttttagcgcttgtacttaaggtcatttatatgcttttaagactaaatctcaatcttcctatgaaccaaaaatcacatgctcaaaccaggaaaacttaaatttaggctcacagaagtgttgacagctcaaaggaaaaatcattgatgatcattttctaaaaaacatttccttactagatgacaatttgaaacttgaccatgaaggtaaaacataggggcaagagtgagatagacattcctccctcactcttgtcccttttcccacgcttttccttcagagctcctccaaacatatttccttgaggataagggaataagggcctgcccgatgagttaaacaattcaaatcatacgacaagcagaagacacagactatgtggcagttacctagcctaagcaatcctatcaacccttctaaaaacaaacactattataggagaataggttggctagaacagagaagtatgttttagggaaacatttctgtcagtgtgtccagtttatggaaaaatatgagcattctggacctatccacgagcaggtggataggtcaacaccttatggcctgaacaagactgtgcacttactttcgttttaattaacttcaatcccaggcaatcagtggcagttgctcaccctaagtgagtatgaagtactatcccatagttgttttaatttgcatttccctaatgactaataatgccgatgaactgatattttacaataaaaaaacctaaaagttaaataaaaactaaaacatattgctacagtagtaaacatattacagtctgttttattataagaacaaaagtaagacttctatgtatagtttattcctttcctgagcacatgtgcacacacacacaaatacaaagatgagcagagaaaaatgcaatttgtgttgcagagattaagaatgttccacagtcattaaaaaaacaaacaaaaacaaacaaacaaaaaactaagacaagtaaaagaattttgccctttgacatgccttgtaaggtactataaaagcctacagacaggataagtgtaaggcataaaaggatatgctttagaagcatttaagtcctttcaaatggggcagaaacctgagaggagaaatgtttaatattaatagcatagcccaagccgtgtcttttcacaatttcccatttccaggtctaaaatgtttttttccttcatctgactacccaaatgctactcaatcctgccacctttcaagaaagtttctctagtcccttcagctctcaataatctctcccttttctcatattgcacatggaggcagcatcttataatttatcactttttcatttgtttttgttttccctccacacccccatttatacttaagttctacttagcttttcatgtctcatgtcttttgaaagcctccaagaagctggctacaaactatgttacaggcaaatatttacatgattaaaataatttcaagatttattaattcttctattatataataaactaccctatatacatttgtgaagcaaaattgtcccaatttaacctgctactatgattagcttttgaagataattccaaataaacgacacaggtttgagtggtctaagaagcagtctgtgccatcattgtgtattagcccaacccttggttcctagcccattgctacctgcctgttatcttagtgcttcacagagcttctgtccctcactcatgtgtgggctgacaaggcaggctgtgaactgaacaagagatctgaaagaacttttgaaatgattatcttgtggaagtttattcaaattgtaggagatactgagaaggaacatttctcaagtatactgccatcactggcaactgtcgactgctgggtggatcacattccaggaataaaatattttctcttgtaaacacttatggcattccatttgcagaggaggcccaatgatgcaggaagaagtacaagctttggagctagtcagacttggatctgaatcttagctcaactacttactaactgtgggatcttggttaagttacctaatctttctaggattatttccccaaatataaaatgaggatcccactacctcctccccaggttactgtgagaaagtatgcaaaaatcccttactatctactgggcaaaggtaggcagtcaaaatgtgagtgcttttgtccccttctcccaaaactaattcttggaggataaaatacatgctgttttcatgaggatgcaggacatttctgaattcaaaaaggttcagtttttaaaaggttttattcttaatatcaacttagaacatctgacttaaaaaagcattcctcaaatgctaccctgtttttatcctgttttttttattttgaaaaatatagattcacaaacagttgtaaagttagtacaaagaggtcctgtttccctatcttcttagtgacatcttatgaaactacagtacaacaatataaccaggtattgacattgatacaaagtgtttgtatgattttatgctcttttatcacatgtatagatttcttttttcttttttttcccttcaatttttattttaagttctggggtacatgtgcaggatgtgcaggtttgttacataggcaaacatgtgccatgggggtttgctgcacagatcaacccatcacctaggtattaagaccagcatgcattagctattcttcctaatgctctccctgcccctgcccccccaacagaccccagcatgtgtgttttgttgttttttgtttttgagatggagttttgctcttgttatccaggctggagtgcaatggcgcgatctcagctcaccacaacctctgcctcctgggttcaagtgattctcctgcctcagcctcccaagtagctgggattacaggcatgcgctaccacgcccggccaattttgtctttttagtagagacgggggtttctccatgttggtcaggggctggtctcaaactcccaacctcaggtgatccacccacctcggcctcccaaagtgctgggattacaagtgtgagctactgcacctggccccagtatgtgttgttctccgcatgtatccatgtgttctcatcattctacttccacttacaagcaagaacatgaggtgtttggttttctgttcctgccttagtttgctgaggataatggctacaagctccatcatgtccctgcaaagaacatgatctcgttcctttttatggctgcatagtatttcatggtacatatgtaccacattttctttatctagtctatcatcgactggcatttaggttgattccacgtctttgctaatgtgaatagtgctgcaatgaacatacgtgtgcatgtatctttataacagaatgatttatattcctttgggtatatacccagtaatgggattgctcagtcaaatggtattcctgcttctagatctttgaggaatcaccacactctcttccacaatggttgaactaatttacaatcccatcaacaatgtaaaagccttcctttttctctgcatcctcaccagcatctgttgtttcttgactttttaataatcaccattctcactgatgctgtcctattttttaatcaaattactgagcttcatgctatttttggtcaaagccaaaaactaatatgatggttcaaatttctaacacatactgagttcctgaaattattaatatcacacataagaatttacatggtcactaaatttgtatcatacagaaaactactacagaccagactttataagaaaaacttatgtgcaaaaagactagagggctctatgcatgtgtacaataaatcttttggccatgttcacagggccactgactttcttaactaattaccttatagttgccatacacctaaggagtaaaaaataataagcattctgaaaatatgacatttgagtttcattttatccttaaaattgctctcctcagtttgcaagagctttaacttgacccagtatctattatacgtaatgatattttccatctctaaaatgtcatcaatggagtgaagagatgtgtctgggtgcacatgtatgcatgcatacaaagaatctattaagctaatttcaaagacagatttttataaaatatgttagtgaggatcaataacaaatatatttgtttaataacctcttcatgttactaagtgcagaaatttccttttcacttacttccactgctgctacaacctgggatattttctgcagaatatcccatgaagcctccattcccattaggattagaaggtactgatgccagaagacctaaaggacaaaaaaattttcttttaaattatgatcaagataaaattcaaagataagtacataaacagctgccaaagaaacaaagacagttcttaacatacctagtcctctatatcgtgaaagctgctgatagatctgtttcatcctttcgatattcaaacggcttgcctcagcatggttcaccattggtttaggataattaactcctatcaaacatttggctaccttttggataccttctggtgcattccagggatcatagatatattttgcagggaagcctcttaggacaggcaaataacgcctttgggagaaaaaagaaagattactaataaaatgcactctaagcaaactataactactagctatgacagaccaaaatcaaatcaagaccatttaaatgatctgtttacccttctcatctctgctgcccatcatgagtggggaatactttaagcattgattaaacatgaaaagctcttcttgaattaactattccaaactgagtagtaatcacccttgatttacctgatatagtctccattgggatctgttctcctaccaaaaccaacagggcaatagcagtgaaaaaactgttgaaaaaaggaactacaagacagccacatccaacttccagcatttatgctccaatctgcatcaagcaataattcttcaaataccttcagaagtaacagtaaccaattagtttgcacacacataattcgcaaagcaagcattttcaaggtcacagtagagccaaagtcaaggcaaagaaaatctagcacagaattgtaaaattaaacattccaaagttagcttccctatgttctgttctataatgagctcttccagagaaagaaacatagtggtaatatagtatgcttctgaagagaatttacttttccaacctctgcagtgttactgggagaatggaaggtaaaaaaaatattcaaatcactgatttaaaaggatgtggatttaaaaggatattattagtagacacaggaaaagcagtcaaccactttcaagaaagcaaaaatgctattacataaaacaccaacaaaaacttagcttcatattctagcctaaataaaggaagcatactcaaatataaattcacttaaaaatatatactagcattacatagtttaatttcgaattccttgatcagaaagaaaatagaattaaaataaatgatttttatatatattcattaagtatgttatatattgtctttgtatacaacggtgtactaggaaatataagagattaaacacacacacacacacacacacacacacacacaagctcagaaatggtccttggatggggcaaatgtatggtattgccagaaaggtaaaaaatgtacgtaatggccgggcacggtggctcatgcgtgtaatcccagcactttgggaggctgaggcagggggatcatttgaggtcaggagttcaagaccagcctgggcaatatggtaaaaccctctctctactaaaaatgcaaaattagctgggcacagtggtgggcacctgtaatcccagctactcgggaggttgaggcaggagaatcacttgaacctggaaggcgtaggttgcagtgagctgagatcacgtcattgcaccccggcctgggctacagagtgagagactccgtctcaaaaaaaaaaaaaaaaaaaaagtacctaagtcttattacgtgtaatccacaagatgtcgtcacaaaatgtagtatgcttctctttacataatagaagtattactaaaaagctgagaagtgaggtgaaatgatttatattttaaaatttataatatgaattcactatctctaggaactctttagtgaattcttttcgtgatagaaatatcacctataaatatatctatcaacaaattcagtgttaaattttacagttctcttagtggctaggctggtttaaccattaaaatgactttaggttaatcaatttaaccagttttcacctttttgcttgtctgattataccatttttctctgaaagtgtccccgtatttggggaattaaatgttttatccactgaaaaactacaccataaatgaatctataaacagacaacttctaggatttgttttattaaggtaaggattccttcaaaataaggcatgctatatcagttagaacacttaccttcattccttcttcccaactaatccacaggtcccctcgtgtcaggaagcaagcaactgcatgcctggctagatgatgaatccaaccctcctgacgaagctgtgtcatgatggcatcaatccatggaaagcctgtccggccttccgcccatttggctaaagcctcaggatttttatcccaaggaatctgaacacagatagggtttccttccattttatcaaagcgtggattatttgttgctgctgtatagaaaaattcacgccataacagttgcccataaagggaaaggggaggggaactgttcttctttacctatggttaaaaagcaaagaagtattatcagaatttttttttaaagtattaaacaataagctctaattttagagaatacctttttgtagagatctgttagtttgaagtaaaacagtcgacatgacaaacaaccaaatcggagataaggactaagtccagtagggcttgcaagcagagaattcgcattcattcgaggtctttcaaaatttgccacccaagcctgaaaacacacagagaaaattatattaactaattgtctttttcattttaaaagaacactcagaatggagatttttttttttaaagttacatagttcttggggaataaaatcttatcctagccacaaattacatgttttaataaaaaataagacaggataaaaaagtgagcattcttttgtttcagtcgtccttgtgcagcacatactcatgtgaaataaatttccttcaaatttccaacagaaagctgagagcaccttcaatctctctctcttttttttttttcctgagacagggtctcgctctgtcacccaggctggagtgcagtggctcaatctcggctcactgcaacctccagctcccgggtggaggattctcttgcctcagcctcctgagtagctgcgactacaggcatgcgccaccacgcccggctaatttttgtatttttagtagggatgggatttcaccatgttggccaggctggtctcaaactcctgaccccaaatgatctgcccacctcagcctcccaaagtgttgggattacaggtatgagccaccaggcctggaaaatttatttatttattttgagatggagtctcactccatcacccaggctggagtacagtggtacgatcttggcttactgcgacttctgcctcctgggttcaaacaattctcatgcctcagcatcccaagtagctggaattaaaggcacacaccaccaccctggctaacttttgtatttttagtaaagatgggggttttgccatgttggccaggctggtcttgaactcctgacctcaagtgatccacctgcgtcagcctcccaaagtgctgggattacaggcgtaagccaccatgcctggctttcaacctctctttaacacaaaggtaaaggtgaaatataattctattctagtttcgaaattgtggccactagatactagcttaggtagaaagaacagaagaggtagtgcggtagtagctaaaggggaaataattagaagagaaggagaaagagcatttaaatgaggagatggtagttaactttcaaacaattaggtttgtgctattttaaccatttctgttaatcctcccctttcaacaatctatttgttatttttaaaagagagaaaaattattttttaaatggcagtttggaaatacaagcatagctatataatctacattatcatacttttctttccaaatgcctttccaaacgagtaagtgcttcagtttctccacctggccacactgcagaggataagccatctgtatcaaaacctacaagaaagaaaagaaaaaaacatcattcttccgaaactaatttttatttaaccccaataactgggagaacaaattactttgcagaaaaattaagagagtaccataaaaatgaactgaaggcctaaataagccctcacctatagaggatatgacatggtttcaatttttcaggatgtacatcttaaggtggtaacaatagatcacatatttataaaacacataaatgatgaacaaacatatcacttcttaaagggttctttttcttctccccctgccctttctttctctcctaatgcaaaatactttacatggcaaaattaaaaggggaattttctgagtaatttatgatttattaacttgcaagcctcacactgactacagtttacactcacctagctcttccagtgaagggactccatatttctcatcatggtcatcagacagaggagttgtgcacttttctatcacttctgaagtaattgtctctactggtatctctagtggttccattttgctgatgagagtctggaatcttttataagttagaggcggttgtccaccattgagttctatgatcctataacaagagttagtaaaatgtagttagtattaaaaaagacaatacattttggctaataagctcccaaaaggcttaaaaagcagaaaataaaattaatcactgaagtctttgagggtgttagcttgttataatgaccaagaaatgtgtccaaaatgattaatgagtccaaaaatcattctcctgagcttctagacatcctctgggtatcaaatatactacacaaatatactacacaaatattaaacctttaagacaaagaatattaaaaacttatgagaggaaaaaacaagtaagaggggaaattagtctaaaggcaattacaaaaagttaatacacacagacatatgaaaaacatgttatggcccagctcaaagaatctcaatcatcaataaaaactaaaccaggttgataattatatgaaagagtaatcagcaggtctcatttaggaaaaataaattttattgtatatatttgagtttacaacacattatgggatacatgtagatagtaaaatggttactatagtgaagcagattaacatatttataatctcagttacttttttgtatgtgtgtgacaaaagcagctaaaatctacttatttgattaaaattccaaataaaatacaattttattaactaaaatccttactctgtacactagacctctagtgttgttcatcttacataacttctactttgtatccttggacctacattcctgatatggtttggctgtgcccccaccaaaatctcatcttgagttgtaactcccacaattcccacatcatgggagggaccctgtgggaggtaactgaatcatgggggcaggtctttcccgtgctgttctcatgatagtgagtaagtctcacaagatctgatggtttttaaaagggggagttaccctgcacaagatccctccttgcctgctgtcatccatgtaagacatgacttgctcctccttgccttccaccatgattgtgaggccttctgagccgtgtggaattgtaagtccattaaatctttcttttgtaaattgcccagtctcgggtatgtctttatcagcatcgtgaaaacagactaaaacaattaccctatttccttcagcaaattttataaattttgattctatattactgtggtgacaattacttcctattttctattgtgctaatgaaggcatgagagatgtcagcatatgtatctatgtcacatacttagaacacataagcccccaaatttcaagttatttaaatttaagtatctttttacttctgatcattaattaactcaatcaattattaattaaaaaaataactagctttgccaatggtagttaaagattaagtttagacactcttttggaataactactctttttcactatggccatttgcttagcatttggccttaataaaaaatgacaggtgaaatccaactccatcattttatagatgtgaaaacaggcctaccaggagagttaagtaaactagtcaaggtcatataactgataaacggcaaatcaaggttttcttagtgtattttagtgtatttttcattatacaatacgtagtgatgtatcaactacagatacatacagaaagtaatacagaaagcaatcaccataaaagatatcctgtttaagtaaattttgttttggtgtattttgaatttattcatagggttgcaatgaattttgctgaatgtaatgatgctacaataatactactgaggacattgttaattacacaacagtagcaaaatgagaatcttaggacaaaacattttctatatgttacattttaatatgatagattacatatagtaaatattcacattcaatccaataaacacttgatttttttttttttttttgagacagagtcttgctctattgcccaggctggaatgcagtggtgctatcttggctcactgcaacgtctgcctcccgggttcaagtgattctcctccctcagcctcccaagtagctggattacaggcacccgccactatgcctggctaatttttgtatttttagtagagatgagggtttcaccattttggccaggctggtcttgaactcctgacctcgtgatccatctgcctcggcctcccaaagtgctgggattacaggtgtgagccatcgcgcctagcctaaacaattttatgcataacactgagtctcccacttagaagcaactgcttttatcctgtgttgccccctccttgctatgagctccttaaagttaagcaaattggtgagctcgaaggcaagattattattaaaagatatatgaattctagcttagtatcaagacctttgtctgaatcaaatcatgattttttgatacatttaaaatgtgaaatcaaatcaactagtttgtcatgttacagaatttgttttactaacttgataaaatacataaattactaaaaaagtaaaatgatttaaaaggtaaataaattataagatttcagtacttaaaaggacaatggtatgccaaaagttttaaaaagttaagttttacagacctctaagactcatagcatataacactccctaaatttaagtttgaccacagaatttctgtgggacaaagcatcaccaaggactggtgctggaagaaatacactttgggaaatattctattatgccattgttcagaggactacagctatgcaatgttatattacatccaatttgcatctggatttaaaatccagacagacataatagatatacatgaaataagataacattaaacaagcatacaaaatatgtcaaggcaatttataactatatataactataaaattgataatgctaagagcccagaaaggcaagaccacaggaggctgagttaagagtagtcaaggaaaattctgtaatagtcttaatccataatagttttgaaactgaaatgctgatacctgtcattgggtcaatagcagctaaataaaatgctaaggatttgacatatgttcacttaattctcccataactctgtgaagtacatgttatttctactttataaacctcagttaaaaacttatctatgtagttaataccaccgaactatatacttaaaaatggttaagatggtaaatattatgttatacgcattttcccacagtaaaaaaaaaaaaaggactcacttgtctaggtcatataatgtatgtgaaattcttacaatgacttctactccagcttcagttgccagtttcttaatagctgcgtctcgttcctttccaaagggctcagaatcatactcaattgaaagtttagtaatgttccattcctaaagtaagagaaaggggaacaatgtacaccaattgtaatagttattttttctattataacgaaaagtgaaaaagctgaaaatctacatatcaaaggattatacataaatcaaactttgaatatgcaggaaaaagtaaacaatttatcaattaaaaaatacataagtaatgaatgcataacccattagattctaggcattatgctaggcaacaatctagcaaagcaatatgcttaaaaccagctcttatactaaatgtgtttgtagagcactttactttttcaaattactcatacttacattatttcatttgagcctcaaaacaacactcagagtttggcactttggttagtatttccattttggagataagtttatttttaaaacttagggacctgccagagttcacagaaagccagaccacctgaatttatgtctgttgagtctaagaactggtctttaactaacctttgatattgatatggtataagctgcctggctgaggtcgtgtgtgtgtgtgtatgtaaatattttctttctgattactaaaaaacgttaactgaaaaatttggagatggtaataataatagcagttacttattatcaggagctatgttaataagttctgtacatctccttatactgattttaaatgaggaaactgtgacttaaaggaattgatttttcttaaggagaaagttttttttttattctaagtctattctgatttatctcataaagaaaaaattctaccattatttaactgcctatatggtaacatactataattcaccaaacacctccagattagacaagggctattccaatggtgggtttaaaaaaattgctattctaggcggcgtgcggtggctcatgcctgtaatcctagcactctgggaggctggggtgggtggatcacctgaggtcaggagttcaagaccagcctggccagcatggtgaaaccccgtctctactaaaaataaaatcattagctgggtatggtggcacatgcttgtaattccagctactcgggaggctgaggaagtagaatcacttgaacccgggaggtggaggttgcagtgtgccactgcactccagactgagcgacaggagcgaggctccatctcaaaaaaaaaaaattgctattataaactttacagtatatatctttacctttatgcacacatcttacaaattatagggtatttatccaattttttcctagaaataatcccttgaaaaacaactgatggatcaaagataagcacattcaaaattctgataggctgtcaaattatgtaccagaaagactgtacaaatttatattcccatcagcagtgcacctaaggcttgatctccacacacttgccaataatatgtattagtaatcttttttttttttttttttagatgacatctcactttgtcacccaggctgaagtgcagtggctgaagtgcagtggcatgatcttggctcactgcaacctccacctcccaggttcaagcgattctcctgcctcagcctcccgagtagctgggattaaaggcacataccaccacaactagctaatttttgtattttcagtagagaaggcattttgccattttggccaggctggtctcaaattcctgacctccatctacctcggcctcccaaagtgctgggattacaggcgtgagccaccatgcccagccagtaattgtttttaaatgtctgctaaactattaggaaaaaaatagtatctcattaaaaattttttcctttcttaaaagtcctgaaaagtgcacatcaagaaattaagggctgttgactttgaggaatagaatttgagcatgtaaataagataacttttacattctgctgcattgctcagatttgttagtacgaacttgctatttttgaaatttaaaaataaaactaagatgagaatagaaaagcattctatttctttgttttatagtgaggtagtatagaatagtttaaaaacacaggatctaacaagttagacttcctaagttcaaagactggctcaactacttaggcaaactgctaaactctccatgcctgtttcctagtctataaaatgggtagagtaagtaaggtgcagagagagtgcctagcacgtaataaaccctatgtaagtatttgctacagtgatgtgaaaaaattaaccatattattgggttgctaaagaattaaataacataatgcatatagagtgtttaggacagagcacaatgcatagcaagccctcaatgaatgacaggaactctttttcttctttttttttttttttaagagttaggctcccactctgttgcccaagctggagtgcaatggtgcaatcatagctcattgcaacctcagactccaggacttgagcaattctcccacctcaacctcccgagtagctaggactacaggcatgcaccaccataaccagctaacttaattttttttcgtaaagacagggtctcactgtattgcccaagctagtctcaaaatcctgccctcaagagatcctccttcctcagcctcccaacgtgctgggattacagacgagagccaatgtgcctagtgcaatttagcactgttttttgaaaaacattattttaaatcttagtaaatactgaagtgagtcaataaataacacttcctgccccttttccttcttgagttcagtcacgtaagccagggggctaaagataaaaatatcagccatattattagcaaagctgaattgtagaaaacataccaggtttcagggcaggtaaacttgctaatactatttcactgttgaatcaaacagatttacctactcaatcataagcagcacctcccgcagtgtgggctttccctataaaacgtatcacatagaagaggagaatataacgtgtgctctctacaactaaaagaaaaggaaccgtctcagctaaactagcccagctccttctcctaaactcaccaatgagatcattcacttttccttccctggggataaattagtgaacatctctccaaaagaaaaatgaaaatctagggaagagaaagtttcccaaaattaaatgcattcagtaatacactaagtatttattataattctaattatatgacagatattatgctagatgcccctctcctggagcttattgagaaagagtggcaatacagaggtaaattactgaatacgtaactattagggaaaaaaatgctatgataaagaatacggggatggggtatgaggtggtaagctaataatccacactctgtcttccatgactgcactggctagacttcaagtaatttgtaaaagcaaatatccttgttttttcctatcttgggtagaaagcattcagtgtttcacctttaagtaagattttatgtttttttgtagacttcctttatcaaattgctatttagcacttgatatggtttggctgtgtccccacccaaatctcattttgaattgcagctcccataatccccacatgtcatgggagggacccagtgggaggtaactgaatcatgggggtgggtttcgcccgtgctgttctcatgatagtgaataagtctcacaaggtctgatggtttttttaaagggcagttcccctacccatgctctcttgccagctgccatgtaacatgtgcctttgctcctccatcttccactaggattgtgaggcctccccagtcacgtgaaactgtgagtcaattacatctctttcctttataaattacccagtctcaggtatgtctttatttgcagtgtgagaacaaactaatatagcactttaaagaatttctagttagctaaaagacctttttaaaaagtatacacgggtgttgaattatgtcagatgcgttctcttcatttgttaagataatttctcttttcctttatcctattaacccagtaggttatattaattgatttttttaatgctcaaccaactttgtattcatgagataaaccccacttgatcctgaagtagcagtattttaaaatattgcaggctgggcacggtggctcacaccagtgagctctttgggaggctgaggcaggcggatagcctgagctcaggagtttgagaccactctgggcaacatggtgaaaccccgtctccaataaagatacaacaattagccagacgtggtggtgggtgcctgtaattccagctactcaggaggctgaggcaggagaattgcttgaacccgggaggtagacgttgcagtgagccaaggttgtaccactgcactccagcctgggcgacagagcaagactccatctcagaaaaaacaaaaaaacaaaaaaacatatatatatatatatatatatatatatatatatatataaaatctctatatctccaggttcacggtccggtacggtggctcatacctgtaattccagcactttgggaagtcaacatgggaggatggcttgagcacaggagttcgagctcagcctaggtaaatataatgagaccacatagtgtctttacaaaaaaaactttttttaaataaaaaatattgctagattcaatttagtgatttctgagtctttgtttatgggggacacttggctatacttttaattttttctcaaactttccttgtcaggttgtggtatcagggttatgctgtcctcataaaatgagttgggaagtaatctcaatcttgttttctgaaagagtttaatttaagaaggaaatacttccttcttaaatgtgtgatataactcaaaataaagccatctaagggcttgaagtttgtttatgggaaggtttttaattacaaattcaatttatttaagagatatagggctattcaggttttctttttcttcttatgagagttctagtaaattatacctttcaagaaattttttcatctcagatatataatttattgacagtatagtgtttacgatattctttactatgcttttaaagtctggagaatctctagtgatgtcctctttcttattcctgatataggtaacttgtattttctttcttttttgtccgaatcagtattaagagtttatcaattttattaatgttttcaaagaacccgtttttggctttgttgactaacaggagacaaaaatcacatcagcaatttgaacatgaaaaatttacaagggcaactcattttattgtgctttgctatttattgcacttctcagatattgtgcattttataaatcaaaggctaacggcaaccctgcactaagcaattctattggtgccattttcccaaaagcatgtgctcacctcgtgtctctgtgtcacattttatcaattctcacagtatttcaaactttttcattattatatctgttatgatgacctgtgatctcttctctttttttttaagagacgtggtttcactgtatcacccaggctggtcttgaactcctggcctcaagtgatcctcccatttcagcctcctgagtagctggcactacaggtaccagtcactacacccagcttttatcagagatctctgatgctactattgtaattgttttggggtgccatgaattgcacccataaaagagggtgaacttaactgataaatgtagtgtggtctgtctgccctacccagcctttcccccatctctttcaccctctctccctctcctcaggcctccttattccctgagacaacaatattgaaattaggccagttagtaaccctacaatggtctctaagtgttcaagtgaaacgaggagtcacacatctctcactttcaaccaaaagctagaaataagcttagtgaggaaggcatgttgaaaggtgagacaggccaggctgggcgcagtggctcacgcatgtaatcccagcactttgggaggccaaggcgggcggatcacgaggtcaggagttccagaccagcctggcaacatggtaaaaccctgtctctactaaaaacaaacaaacaaacaaaaactgggcatggtggcatgtgcctgtaatcccagctactcgggaggctgaggcaggagaatcgtttgaacccggaaagcggagtttgcagtgagctgagatcgagccattgcactccagcctgggcaacagggcaagactctgtctcaaaaaacaaacaaaaaaaaaaaacaaaaaagaaagctgaggcaggccaaaagctaggccatttgcaccagttagccaagatgtctaaacaaaggaaaagttcttgaaggaaattaaaagtgctactccaatgaacacatgaatcataaaaaaaaacaaagcagccttaatggcgatatggagaaaactttaggggtctggatagaagatcaaaccagatacaatactcccttaaagcatagtcctaatccagagagaggccctaacactcttcgattctgtgaaggctgagagaggtgaggaagctgcagaaggaaagttggaagctagcagaggttggttcataaggtttaagcaaagaagctgtctccataacctaaaagtacaaagtgaagcaacaagtgctgggtggagaagtagcaagttatccagatctatctaagataatgaattaaggtggctacactaaactacagattttcagtgttgatgaagcagccttctattggaagaagatgtcatctaggactttcatagctagacagaaaaagtcaatgccaggccaggcactgtggctcatgcctgtaatcccagcactttgggaagctgaggcaggcagatgcttgaggtcaggagttcgagaccagtctggccaacatggtgaaaccctgtctctactaaaaatacaaaatttagccgggcatggtggtgcacgcctgcagtccaagctactcaggaggctgaggcaggagaatcaattgagcccaggaggcgaaggctgcagtgagccaagatcgtgccactgcactgcagcgtgggtgacagaggaagactccgtctcaaaaataaaaaaagaagaaaaagtcaatgcctagcttcaaagcttcaaaggacaggctgactttcttgtgaggggctaacatagctggtgactttaagttgaagccaattctcattgcccattctaaaactcctaggtcccttgagaactatgctaaatctactctgcctgtgcagaacaggaacaacaaagcctggatgacagcacatgtgtttacaacatggtttatacatattttaagctctctgttgagacctactactcagaaagaaagactcctttaaaaatatcactgctcacagacaaacgtactttgtcatccaaaagttccaatggagatttattagggagattaacattgttttcattcctaccaatgtaacatcaattctgcagcccatggatcaaggaataattctgactttcaagttttattaagaaacacattttgtaaggctatagctgccacagacagtgattcttttgatgggtctgagcaaagtaaattgaaaatctttggaaaggattcaccattctagatgccaataagaacacttgtgattcatgggaggaggttaaaatatcaacattaacagcaatttggaagaagctgattccagtcctcatggatgactctgaggggttcaagacttcagtggaggaaggaactacaaatgtggtagaaatagcaatagaattaaaactagaagtgcagcctgaggatgtgactgaattactgcaatcttatgataaaacttgaatggatgaggagccgctttctatggatgagcaagaaagtggtttcctgaaatggaatctactgctggtgaagatgctgtgaacatcatcaaaatgataaaaaaggatttaggttataacacaaatttagttgatgaagcagtggcagggtttgagaggactgactccaatttttaaagttgtactgtgggtaaaatgctatcaaacagcattgcatgctatagagaaatctttggtgaaaggaagagtcaattgatgtggcaaacttcattactgtcttaagaaattgccatagccaccacaaccatcagcaaccactaccctgatgagccagtagccatcagcattgaggcaagaacctccaccagcaaaaaagattatgacttgctgaaggcttagatgatcactagcatttttttagcaacaaaatatctttaattaaggtgtgtattttttttagtcataatgctactgcacacagaaaagactacagaatagtataaagacaacttttatacatatgcattggaaaacaaaaaaattgtgacttgctttattgtgatgtttgctttattgcaatatttactttattgtggtggtctcgaaccaaacttgtaacatctcccaggtatgcctgtatcaaaaattgtaattgttagctactaaaggtggtcaacaatgacaaggaataaaacaggagataaggctacacttcagtatggtaggtagtagccactaggccacgtgtggcttctgagcactgaaatgtgactagctggcactgagatcagctggaagtataaaatacatacaagatttcaagaacttcatatttttttaaaactccgtttaaaataagctattttaaaagataaaatagcttattaatacttttatatagaatattttagatatactgtgttgaataaatcattaaaattaatttcacctgtttgtttttacttttttaatgtggctattagaaaattttaaatttaacatgacttctattggatggtactgctctaaggtgttcaaaagtaccaattgcagaaagcagctgccacctctatgtggacggaaaataaacaaggaatgaataaaaaacttaacaaaagctccctccaccaagccactgagattcatggctcattggatggagcgtgctgccacaggaacacacaaccttccctgtaaagaaatttaccggagggcaatgaccaaaggtgtttcataccaataacctgctggttggctgagaaacttcctggtaggtatgggctaaccaggttatctgtagaagctgtccaccaggtggcatagaaacttatcagagggtataaataggcttacacagaaattcaccagagggtgtatgtaggctgtggctggttcaggagggctgctgaggtgaatgctactgatcctccggcatactcatctgctagcccagggaaaaaaagcacaagtatatcaagaagaaaagcttcttctctcctgctgtgacacagtatcacacagtagggcaagaagggtgggtttggcactaagaaataataaactaattaatgcatactgattttctttattgttttctatttcattgattcccgttcctctttattttttgttttctttctactaactattagtttaatgtgttctttttctatctttaaggtagaaacttagttcttgatttttccttttctaatacaatattgaaagctataatattaagtttcctctaagcactgctttagctgcattctgtaaattttgatatacagtcctcccttggtatctgcaggaaattggttccaggaccccctgtggataccaaaattcacaaatgctcaagtcccttatgtagaatggtgtagcattaggatataacctgggtgtatctatatatatatattttgtgtgtttttgtttctttttttttagacagagtcacactctgttgcgcaggctagagcacagtagtgcaatctcagctcactgcaacctccgcctcctgggttcaagtgtttctcctgcctcagcctcctaagtagctgggattacaggtgtgcatcaccactcccagctaatatttgtagttttagtagagacggggtttcaccatgttggtcaggctggtcttgcactcccgaccttgtgatccgccggcctcagcctcccaaagtgctgggattacaggcgtgagccaccacgcccagcctttaaagactttattttctcaattctctaacgggttcaaacaaaataagaggaaaaaagacctctataattttgtgtcacattcactttcatctccttgttaatatgggaaacaatgatctattgtgagtttttacatcttaaccagagatggaagtccctatctactctttttttttttttgagacaaggtctcactctgttgcccaggctggagtgcagtggcatgaatatagctcactgcagcattaacctcctgggttcaagtgatcatccctcccacctcagcctcctgagtagctaggaccacaggcatgcgccaccatacccagctaatttttaaaaatttttgtagagatgcggtctcagcatgttgtccaggcttatctactcgttagagcaggtttttattttaagcaacacgtagttacctttgaatttcaatacctagatttaacagtaagactgcaaatagcaccaacatattttcatttgagtaagtgaatattcactttgcaattttttttgagcgagggtcttgctctgttgtccaggctggagtagagtggcatgatcttggctcactgcagcctccaactttccaggctaaagtgatcctcctacctcagccactggagtagctgggactacaggtgtatgctaccatgcccagctaatttttaaaattttctgtagagacagagtctcactatgttgcccaggctggtctcaaactcctgggctcaagcacttggcaattttaagcaataagatttgtatctatttttgtgtatcacaattacttgttaatcagaaaggataacatgaacaactaaatgaatataaagttcttggctggacgtggtggctcacgcctgtaatcccagcactttgggaggcaaaggcaggtagaccacttaaggtcaggacttcgagaccaggctggccaacatggtgaaacctcatctctactaaaaatacaaaaattagctgggcatggtggcgcactcctgtagtcccagctactcagtaggctgaggcacgagaatcacttgaacccaggaggtggaggctgcagtgagctgagatcgtgccactgcactctagcctgggtgacaaagtgagacttggtctcaaaaaacaaaaataaaataaaacaaaacaaaagaaagaaatagcactcccaaacaattttaaaaaaaagttcttaagtcataattaatatactgtgaaaataagcaatgtaaaatttgatagtaaaactaaaagttgtaaatcacatatgtcctaggagaaagcatttattttttaaattgacagtaaattaaacagtataattgcataaaaatgtaaagctacctcacaaaataatccaaatacaaagaaggtaaaactctaaaaatttccatccatccatccatcatcctttccttctgtttcataactctagtcttagggtctaaactactatttatatactgaagagtcctaaatttagtccagacttctccctgagcactagacttgaatgccttctcaacatgtacattaacatgcctaaaaggcatcccaaactaaaaatttataaaatgaacttcttattttttccttaaacttgttcctccatagtctgttattccattaaatgggaatccattctgccatgcgtccaggctaaaaacctagagtcatccttgactctcatatatcacatataggcaaaccttacagcctctatttaaaatatatatccaaaaccctaccacttctcaacacctctacagctaccctggtcctggtcatcatcatcttattcctaaataactgccattgcctcctaactgatctttctgcttctgcctctacaacacttccaatcccctgtgtattctccacaaacagccagagaaattcttgtaaatcatgagttaaatcatgtcactcttctactcaaaactctccaatggcatctatttcactccgagtaaaggctgaagctcctaacatgatctataaagccctatgatctggcttccagccacctctccgacgccatttcttcttttcactcactgtgctctagcacactggccttgttgttgttccctaaacaaatcatgcacatgtctacttcaaggcctttgttaagcactgtttcctctgccttccatgctccttccccatgttgcagttagcttagtggaattgttaattctcaaaattctgtcaggtatctggatggttcttttattggtttcactcggatctgctcatgaggctgcaattcgctggcagcttggctggggctggagtgcctaagatagtcaaactcacacatctcagactttggtgttggctgttgtttggtccactctctatatgtggcctcccaaagttagatattctaccccaggctttcttacatgatagaaggagcatcctaagaggggaaaagtagaagctgaaaggtcgcttaaggcctaggatttggaattcacaatgtcttctttgacacttggttaaaaacaagttgtaagggcaagtcagattcaatggggtaaggaaataaactctaccttttgacggaaagagctgcaaaatattgtggatatgatataccacaacccagatgcatggctcactcttcatatgcttgctcaaatgtcaccttatcagtgaggccttctttgattccatataaagtaactttccctcaccttgacatttactatcccacattttactcttctctacagcacatatcaccacctgacattgcatgtttacttatttgtttactatctgtctccttccactacagtgtaagcaccatgaagacagaaattttttgtttcactactgtatctccagtacctcagacacagccttgtatatagcaggcactcaatcagtatctgttgaatacattctatcaagcatgtgtcatgaattaacaaagcaagatccaaagtaacttaaaaaagcataatataaattttactgttgaaaaatggtggctttatatgttcttttattctgtgattttgaacaaaacattttataatgcttcagtgtggccatctatagactttagccatgtgtcactgtttcttagatataatgaggctgggcacagtggctcatgcctgttatcccagcactttgggaggccaaggtggtggagactcctggatcctgaagccaggagtttaagaccagtctggccaattggcgaaaccctttctctgctaaaaatacaaaaattagcaaggtgtggtggtgcatgcctataatctcagctacgtgggtggctgaggcacaagaatggcttgagcctggaaggcaaatgttgcagtgagccaagacagcactactgcactccagcctgggcaacagagcaagactctctctcaaaaaataaaaataaaaatagaaataattaaaaaaagaaatagatataatgagaatgtttttaaaaaatctagatattaattatgcacctagtctctaaaaccaataatttaaactccttattaaaagtttctgcagggcctagaaagagccatcttgttagcctatattaagtcagagtttaacttagaaaagaaactaagtaaaaaacgccagaaaaaatgacaatagtttattagatatatatgtgtttacctaagtgtgtataaaaatgttctgacccattcctgaatctactccttataaacagaataaattgagtgaatgacacagaagaaagatacatactaggggagatatcagtactggagccactgacacaactatcccaattaactaagggtactgttaccaggtctaaactagccttacctccaatgtggaaaaccagattaattacctattaaaaatcctcactacttgctgtactagaaccaaaagacctgagacactaattaagtaactcagctagttaatgacagaagaatcttctccctcagagaaactgtggttgtgatggttagggtgaaggtgggggacaacatgcttttaattgtatatccttttagccttttttttttaaacatatgcacgttgaacctataagcaaaaagtaaaaatcaaaacattaattcaataaaaaggaattaattccctctatggctctagatatggtaaataaatctaaaaggaagtttttataaatggaattttatacagactactatatgtagctaaagaaaaaatcagaataaaataataagtactatatgtatatgtatgtgttcatgtatttgtatattagggcccatgtggaaacccattcctctctgccaaattgataagataggacatcatttaaatacagaagatagtttggcccaataatgtgctattttaggcagaagaaatctcaaaacaaagaacacaaaacacttgctggtttgaaaaatgttgtttcaaaaacaagtaaataagaattttgttattttaaagcaactagggctaggtgctacagcttatgcctgtaatcccagtgctttgggaggttgaaggaggattgcctgaggctagaagattgagactagcctgagcaacatagcaagactaccaaacaaaaaaaaaattagccaagtatggtggtatacagctgcagtcttagctactcgatcctgtagtcctaggatcacttgagcctaggagtttgaggctgcaatgagctacaatggcaccactgcactacagtcagggcaacagagcgaaaccctgtctccccagcaccaaacaaaaaaaaaggcaactccacttaggattcattttatttatatcaaacagatttagagatagggttgaaacaattatcgacacacactcttatattcatgagttgctgatagattattatcattgcttctgatatgctttcttgttagaactctcccaaatacctaggttaaattctaacttgatctattacagttgtgaaccctctttattgaatgtaaattttcacaaacattaaatgtgtctttcatacaagcaaaaaaaaaaaaaaaggctaagtaatgcttatttgattcccagcactggggattgatcttctcattcacataaagagctgttctcttctacattaagaaatacaaatagaaacattgctatttcaaaaatttgatgaatcaaatgattcaagaaaaagcagatatacatttataaagtttaatagtagttgacatggtttgggatctatgtcctcacccaaatctcaagttgaattataatcgccaatgttggaagtggagcctggtgggaggtgattggatcatggtggcagatttccccttggtgctctgatagtgagtgagtgcttgcaagatctgtttttttttttgttttttgttttttttaaagtgtggcacctccccgctccttctctcttcctcctgctctggccatgtgaagttcttacttcccctttcccttccccttccaccatgattgtaagtttcctgaggccttcccagaagccactatgcttcctgtacagcctgcagaactgtgagccaattaaatctcttttctttataaattatacagtctcagatatttctttgcagcaatgtgaaaatggactaatacagtaataaataggaagggatgaatacaaaaagggcaatgaggaaactcagtttctggtctgggcatttccatgagctagttgtatgatcttgggcaactcaattattctctaggcctaattttttcatttggaaaaaagggaagagataagattaggtatcttaaacatttttaaagatttttaagatcctactaagttttttaaaaagcactacagtgctgggcgcagtggctcacacctttaattccagcactttgggaggtcgaggccggtggatcacctaaggtcaggagttcgagaccagcctgaccaacatggtgaaaccctgtctctactaaaagtacaaaattagccaggcatggtggcgtgcgccagtaatcccagctactcaggaagctgaggcagaagaatcacctgaacccaggaggcagaggttgtagtgcgctgagattgcgccattgcactctagcctgggcgacaagagcaagactccatctcaaaaaaagaaaaaaaaaagcactacaaattctgtattattggtaaaatgtccattgttacaatcctttgacccagaaagtcttctaagaattatcccacaaatgtactggcccatgtgagcaaagattcataaatgtggacaagtaagttcactggcatttatactagcaaaaggcctacagagaaaataattaaacgttcagtagaaagctagtttaaaaaattatagccatctacaaaatggaatactatgaagtcatctgaaagaccgaggaaatgatatggaacaacttccaaaagatatggttatgtgaacaaagcatggcagagaatggtgtgtatagtgtgtcattttaacttttaacaaaggggacagtaacacagacacaaacacatggatgtgtgtgtgtgtatacacatatatatatacacacacacacacaaaaatatatatatatacacacacaaaaaattcttgtttatgcaaagaatatttctaattggataaacaagaaactggaattggatacataagaaactggtagtagctgttgcttctgggagggcaacgagcagtttaaggtagaagaaagattgaacttttcattgtaaactattttctcactgtctgatttttaccatgtatagctttttcattaaataaagaaaaaaaacccacaaaatttttacttgaaaatacttatattcgctacattttcaattagtcaaaaaactttatttaccaaatatgtaatattatctgagaaaagattgttttatgcaaatatttttcaaattaccttgaaaagcctgggaaacacatctgctggttgtccacgaatcacaaacagacgggagtttaattttcgtagattggcatcaagatcctcaagacactgaagcaaaaatctagagagaagaaagtattatttaaattattaaaaaatacatatttagaagacataaattattacaaagtcatgttattctaaaagttgaaatgccaacctatcatcttattacctcctattgatatatactttttccaaaaaccatactaatatatattttttaattatagcacaaattacctagtattttaataaaatactgaataaaatcactaattttcattaaataaaagtgactattagcaaaaatttaatttgtgaacataaaaacatacaaagaagtatcaaagcaattaaattggtttcattgtttaaacttgatgaaatattttctgtatgaaaatggcttttcatatagaaaggaaaacttgaaaaatctagaatatcttctgctggggggaaaaaaccagaaacatcctatgtaatgaataagcaagtgaataatttaagaatatcatggtaaaaaggaatctgaggggacaaaaaaaaaagattatgagtacttttttgtaatattgtaatcatttaagagattgaaatcataatgcccattttcaagtttctaatttattaaaaaaagaaactaataagtagatgccaaattatgtggttattaattccctgagtgtagaaaatgccagattaacttctaaaaaaaaaaaaaaagaaaaggtttcatggagttggggtggagattatagactttttcaatgaaataagtagtaacaaggcttacacatgacagatatctaggaaaattctggggcagtaccagaagactgcttactgtgcatcttctgttgcgaagaaatggaacattcccaagaacaaatttaaaagagatgtcacccatggaaggtccaatcttattatttgactcatgttaagtttcatttagattctgttcttttcagctggacgtatcttatttcctattttgcttcttttatgtttttgatctcaaggttaagtatttgtctgcctttttcacaggccacatggtctttcagaatagcaattatctcttacttgtgaagaggagtgattaagaagcagggaaatgcaaattctagaagtgcactatctaatatggtaaccaaaaggcacatgtagccatttaaatttaagttagttaaatttaaaaatcagttccttagtcacacttgccacatttcaagtcctcaacagccacatgtatagctggtggctggctaccatactgaacagtatagctacagaacatttccatcattgcagaaagttctactggacagattgttctaaaaagctgcttggtctagatcattttgttcgctttacacattccgataccatcatttcaccaaataagtcttgttgattttttacaactgtagttattagtgacataagtgcactagtcaggtctgacacttcttcctctttaggagcaccatctgtacagcttgaagagtcaaggtgctatatttttatgaggatgttaaagacatcccaccatttcaccttaggaagtctcatgggtttccaagtaggaagcaaacctttctatccccacatttatattttatcacatcccttttctgccttggtttggagtcacctccctaacacctgatccccatcctaacccaccactaccaatgtacaaatatttcaggggagaagactgttgttgttagatggatagtgatataaaagcattggagtttaataaaattatctccaactatgaataatttatcatgtctggtgacaaatgtttattgggaagcatctaattttatgtatttgcttggcaagaagagttactagacagaacaaagatcgaagggtttttacacagatcaaaaattaagaagttgaaagaactagcaattttaagttttcttaaattgaaacagtacaaaacttaaatgtcctggagggggtaatctaaggcaataataatcccctaatctctgttgtaccattagtttcaaaatcttccccaccagaagtgagtaagaactgagaacagcaagagttctccatattcaactttttggtcaaaacaattctatgtggtgcaagagttcaatgacagtaagatgggataagaaacaaaccaaaaggacatgattaattcataaaatgaagaattaagtatggattaattaataatctttccctttcttaataggctgaataagcattccgaatgcttttaataaacattctttttttttttttggagacaggattgtgctctgttgctaaggctggaatcatggttcactgcagccttgacttctcccacctaagcctctagagtgactgggaccacaggcatatgccatcatgcccagctaatttttgtagtttttgtagaggtggggtctccccacgttgcccaggctggtctcgaactcctggcctcaagtcatcctcccacctcagcctcccgaagtgctgggattataggcatgaaccatcacaggcctggccttaataaacattatatgaaccaaacaaatgcacagaatgatatggactaaagtaatgtgttacaataggaaaagttttgaaacctaagaattaattttgttttggtacttcatgaaacaaaagactaaaagctgtatttaagtatggtgttcttcttccacagatataacttacatctctcatttcacataaaagctgcacagatttaaaaaatagaaacacttaaaaaataatataggtattttgtaatcaaatattttaagtagaaaagatccaaaaagaaaagcaaaagagaaggctaaagtagaacacactatgatgctattctttgttataaggcttttaaaactatttgcatatattactctgataaaataaaatttacattgcatgcatctacttttgtttatatgtgcacaagaaaataattggaaaaatacttaccaagctattaatcatatctccccgttagggagtgggggtttgagataggggtgagaaacagagaaacaaacacatttttttaacttcataaaaaaagtttaaaattgataattagcatacattccttcaaagtagaagaaaaacgagatacactacatatgtatctggtttaatacatggtgaacgtcttttcaaggcaatggacgtacttctacagcatcaattttcatagtttcatagtacttcattgcacagatgtcctataatttaacaagtctatcaacaaattactatccttaaatcaatcctgaaaagtcctatctagtctcctcatctgtaaaattgggacagtaatcggacctgtctcatagcattgttcgtgagattaaataaattaacatatgcgaagctcttagaatagtgcctgcccatagtaagcacaattatatgttatctattactttttagtgttctccttcctttccacttctgtttttgctacaataattctagttcatattatctcttgcttgtatttactgcaatgccttaaaatagatctgcctactaacaatctctctccattctaattcattttatatgcaattccagatcttcatgaggcacaccttcccatacaaaggttttcaacgactcattccctatacaatacacaacaaatcattttgcttggctactaacctagggttctaggttgatttcctacctcatacccctttctctcacaccaaaccaaacttctctttcagcacacattcaatctcctggaatgtgctccagggcctttccttggcttggaatacctttcccaattcctatccctttaagttcatatcacactaaccttaaatcttccatcttaaagtcacttctacatcttctgaacctctgaggtacattatgtccttcagaggatgaaaaaattttacctcatattatacatattatatatataacatatatataaaatatatatattatatataattacatatatattacatatatatataaaatatatatatatatattacatatatatataaaataaaacctcctcctaatggatttcaaattaagtcagttctccccatctctctctttctgagacacagtcttgttctgtcatccaggctggagtgcagtggcacgatctcagctcactgcagcctccacctcccaggttcaggcaattcttgcgcctcagcctcccaagcagctgggattacaggagtgtgctaccaccctggctaattatttttgtatttttagtagagatagggtttcaccatgttggccaggctggtcttgaactcctgacctcaggtgatccacctgcctcagcctccccaagtgctgggattacaggcatgagccatcaggcctggccctaactacagttttcttaatctatattttggtttctatatttggcaaacaaatctcattatgtgccttgtataatttgttgaaaagattagaaacaggatcaaatgacctagtaggggtgtcttgtgtaactgttgaaaggattaggagcctcataaaatcacctagtagagtctctagcacatggtagatatgtatcaaacagaagttgttattttcccttgagaataattcctgtttttttttttttttttttttaaagaaaacaccccatgcatttctatatgtaaatacttgggcatgacaaaagaaaacgtgaattagttggatgcctacacctgtatacagaattactttgaattcacaacttcatctgaatgtgactttgaactatgatttgaaggaaacctttcccagtagcaaggtcaatgtgactataaatattataaaacaaggtacaacgcaattaagactcaactaatctctaagcatataatttttccttgataatacctctaacagcccaggttcaaagtatcaactcagtgatgtgtgtgatttctctttaatgctgaacgaataatgttacttcaaaactatacaaaatctaatgctcaatcctttacccttaactgggaaaggattagatctgttagagttcagattcagtgtgttccaaagaacacaccaagttcaactttaatgtaatagaaatgcatgtgctctgggacactcaatattgaatgaaatgaatgatttatttttaatatattccactgaaaatacatatgatatcatcttaacaggaacatactttcagaccttctccaatttggcatatatattattttcttgaactacacccatttgatggctccgttattactgctattaactacatacaacaggttgctttttaaataggccaaatgatagtaaaactcactatatcccttcatataattgtactgcctacatagaagcacagtcctcatattatttaattacaatactgaacacaccactttaaattgaagaggcattaggtgacaaaatatatatttcttcactttaaacattttaaggatttttttcctccagagatcactatctattgctgttattttaaaaattatatgcagtaagcttccttataccacttccaaaagatgacttcaacatgaatcaacagaaatattttcctaaagtaggtcattgctatagcaaccagtggacggtttagtatactccgtcacaatgacctacttaccagtctgtgctagaacagctttatataactagaatttctagttctgtctatgaaatagtccaaaaaaggcaatggtaagatacaacataatcctattgctgctgaacacaaggcattaagaacatgtaccatgccagaataaagccatgtggttctgtatgctagtttgtaaaatatatcttacacactcagcaataaaaactacacttacaatatctaaacaggaacaactcattgctgaccccaaagaactgattcaaagaatataaactaaaatcactaaaactacaaggagaataaccttattatccacataaaacaagagttaaatgtagaaaaaactaaagttctgtatacaccatcataaagaaaaaaaatggagattctcagtcattaaccaaagtctattatattttattagagatttaaaaaatataacaatttgtgtgtgtgtaaatttaataaaatttacatatgctcttttttctggtttgttacaaatttttagtgctttcatctaacttaattttacctaaattgtctggatatttgtgatacacactttccctgaagataagagtttaatgttcaataaagatgaaatatatattttaaaagcaaactttgcatttgccacactctaaaagccataaaccagtagacctatatcactttttataactaatattttgcaatgccctcttttaaatcctgaaataaaagacctagataatataacatttccatacacacaattttaaagcattaatatcatgctctaattgaaacatataggagaaattaaaggaaagtcattaatattttaaaaagaagtaacatgtacttctagaggtaaatatgtgggcatgatataaggagacaatgaattaaaactcagtgtccacacctacatacagaatcatttaaaatttaacagctacaaaacagactaacacagttgtgttactggcgactcaaacatcatacaccatgagtgatattgcctttggtgatgtgattttctgaaatattgaccaagacaggaaagttcagaaaaaaaagcaaagtacaatctttcctttatttatataggtgataaatacattccagggaaactcagtgtatattaaaattgtgtaaaaaatacctactgtttatacataaagatttaggctctaggttcagacaattatgaataagtttttcacttacattaaacatctggaagaacatttgaaatttatgtgtaactcagaaaaactattttatttacttatttactttagagacagggtctcgttatgttgcccaggctggcctcaaattcctggactcaagtgatcctcccatctcggttcctgaatagtcaggactacgtgcatgcacactatggcacctagagacaactatttattttgagggattactctgagtactgaaagaaatcttccattcttggcttctccttactaattccactagcaccttccaatcattgtgacaactggccggacacaggggctcatgcctgtaatcctagcacttttgggaagccaaggtgggtggatcacttgagcgcaggagtttgagaccagcctgagcaacatagggagatctcatctctacaaaaagtacaaaaaaactagctgggcgtggtggcgtatgcctgtagtcctaactacttggggtgggctgaggcaggaggatcaattgagcctgggaggttgaggctgcactgagctggctgtaatcatgccactgcacactgtactccagcctgggcgacagagtgaggtcttgcctcaaaaaaaaaaaaaaaaaaaatcaatcattatgacaactgaaaattcctctacaaaatttctaaaatgtgtttgaaggagtgatactgttaattacttctataatttcaatcactgatttatgagtcatacaaagataaatgaggttccaatactcacagagcttaaaacctaaaaaagtaacctgaatatgtatattatgtaaataaatactacagaactggctatggtagaataaaacatataaaatacaaatagatatcactaatatgctctgaaaaatcaggtgggagaaatcatttctggatttttctttccttgttttgatatggggagcggcttaggcaaaaatttcaaggatgtggtggtgatggtaggtagtgaccctgaagtatcaatacaatagctggagataaggaaggagaattattggccactggactgtagcctgcaactaggccttgttcaccacttcccactgtccaattcctgacatatagcaggagttcaataaatatctatctaatgactaaataaattaatgaaagcagaagaaagggattttaaaggcttgattcaacagtcaatgaagaaggaacaagaatgggaaagaatattctctgaatgtctattgtgctggatactttacatatattatattcccaacaattttacaaggtatctcattttaaaaatgatggaatctgaaactcaccaaggacatttccatacccaggtaaacaatgaagcagaaaatttaatctggatgtctctgactccaaaccatagtgctctttgtactacataatgtgacttttctacagaatatgtaataatctaagatgttttaggaaaattaatttgacagctttaagaacataacaatgactagtatacagtttttgtcctcaagctgaggaataggcgtgtgtatcaattaagaagaatttaggatataccatggtaacaaatcagtcaaaacaggtcacatggccaagttagtcttcaaaaaggcaggaaagcataatcttcttgcaggaagggacactaaataacagtgtacagtaatgatatctaccacaatatctaagcactgatattatgtgccatgtggtaaattttattatgaaaagtgtattatggtagcccagaagaaacctaactgtgtgggggtggggaagggggcaggggaaggcacaaggaagaaaagatttgagtagagtttagaattaataggtgttgcttaaggtgataaagcagaaatgggcaaccaaagcagaaaaaatagtatgtatgcttaaatcacagaaactcagaagagctgggggttgggggtacctggggactgtaagtattatgctttctatactaagttgtatattctccccaacacaagctttaacatttcaaaatatattcaaatcaatgtcaaaacaaacctgttatcaacttctgttgttgacagtacaccggattaagataccctaacagaaataactaacaaactgagaaacaacaacaacaacagaaaagttcttaaaataattcaccgggttgtccaaaaagcaagaaggcataacaggtcacagggagctaaagtcagctttagccctggggatttctgcagagccctgagaactctgagcttcatctgggttgaagaggacaggagataaagcccaagacccacccaaagtaaggaagctaataatagattcaatataaagcctgggcttccaaaagctttagtaaataagacataaatcttttttttttttttttgcttattatacccagactgctctgaaagatacaaatcttaagtcacagatgaagactacaaagaaacttatctgtctctagccagtttgggatgaaagaaaataaaatctctccttgaatggaaaggaaaaaatagtaactttacagcagtgaatactgacaagtactaccttaaccacacaatcagagtcaacaacaccagtgataggtcaatcatgttgatattatgttcactctgacttaatgtgatgagaaaaccatttcacctctgtgatattgtcccccaaacccccataaccctagtttaattatcaaaaaaaatcagagaaactcaaattgagggccgttctacaaaacatttgaccagtactcaaaaccacagaggtcattaaaaatagagaaagcctaagaaactgttacagaggagacaaaggagacgtatgactagatgcagtgtggtattctagatgggattgtggaaaagaaaaacttagtggaaatctgaataaagtctggagtttagttagtactatggtttctttttcttttcttttctttttcttttgagagggagtttcgctcttgtcgcccaggatagagtgcagtggcatgatcttggctcactgcaacctccacctcccgggttcaagcgattctcctgcctcagcttcccaagtagttgggactacaggcatgcgccaccacgcccggctaattttgtatttttagtagagacggggtttcgccacgttggccaggctggtctggaactcctgacctcaggtgatccacctgcctcggcctcccaaagtgctgggattacaggcatgagccaccacgcccggccagtactatggtttcttagttttaataaaagcaccatggaaatggaaatgttaatattacaggaaacaggatacagagcatacaggaactctgtgtattatctctgcatattttctacaaatctaaaattattcaaaaaaattttattaaaaaaatcctccgagaatgaatcacctcaacgcaaattcatggaaactatgtggtcccaaacacctcaagcatgacaatgcgtttaaagtggtcacaggcttggtgtgctctgagataactgttacagacacacacacacacacacacgtcacaaatcctctctgtattctcaactttaaaactcagacttcaggccaggcacggtggctcacgcctataatctcagagcccacgagttctagaccagcctgggcaacatggagaaaccctgattaaattagttgggcatgatggcatgcacctgtaatctcaactactcgggaagcaaaggtgggaggatcgctcaagcccaagaagtcaaggctacagtgagctgtgatcacttccctgcactctagcctgcatgacagagcaagatcaattttaaattggtatcatttatatgttttgaaattagaaaatacttgaagacttgaaattaagaaaaacagcagaataaatccttaaaaactaaaaagaagaaaatgataaagaacagaaattagtgaaaacagaacacaaattcgtgagaaacagcaaagccaaaatgtattatatgaagagacaataatataaatgtccgacaagaataattaagaaaaaaaatgggagagggaagagtaagaaatgttaagaattttttaaaaagtggggacataatcttagatactgcagggattaaacggaaaataaataattttatgcaaacaaatttgaaaacttagatgaaataaattccttgctaaaactgactcaagaaacttaaaacttaccaaaatggactcaagagtaaagaaagaacaggaataattctaagtcactaaataaattgaatccatagcttaaaatcttacaagaaaaacacaagagtcagttagctttacagatgaattctacaaaatatttaaggaatagataattctatttttacaaaggattccaatctcataaaaaggatagacagaaaaggaatatttaacttattttataaggttagatttaccttgacaccaaaaccagacaaagacagtataaaagaaaattataaactaatttcactcatgagcatattatcacagcaaaccaaatcctgcaatatacaaaacatattatatatcatgatcaagttgggcttatcctcagaaagttaaatcatttaatatttacaaattggttactgtaattcacctcattcatagaataaagaagaaaaactatataaccaattgacgagatgtataaagagtagcaacaaaatctcaattccctttagcttcaataaactagaactagtaggtaacatccctaatctgaaaaagggtacccgtaaaaatacttagggaaaacagcatatgtaatagtgaaatgttgaaagcacttcctttaagatcggaaagaagacaaagatgcctactcccaccgcttctctatgcaatctagtaggcctaactaatgtagtgcaggttgagcatcccaaatctgaaatgcttcaaaatccaacacattttgagtgctgacactgtcacaggcatttgaaccagagtgactccatcttaaatagggccttggtaaaataaggctgagacctgctgagcagtacttccaggaagttaggcgttcttagtcacagggtgagacaggaggtcggcaggactggtatcacaagatacaggtcataaagaccctgctgataaaacagaatgcagtaaagaaggtagccaaaacccaccaaaccaagatggagacgaaagtgacctctggtcatcctcactccacattatacactaattataatgcattagcaagttaagacacccccactaatgccatgacagtttacaaatgccaagacaacatccagatgttaccctatatggtctaaaaagaggagaaatcttcacttctgacaactccccaccacttttccggaaaactcatgaataagccaccccttgtttagcatatactcttgactgagtatactcagtcaagaaacccatgatgctgctctgtctatggactggccattttttgtttctctacttgtctaataaattcgctttcattttactctgtggacttgctccaaattctttcttaagtgagttccaagaaccctctcttaagggctgaatcagaagcccatgtctggtaacatgacattcaaaggaaatgctccaatgaattcggttgctcaactagtaatgtcaatattcagaaatatggggaagaatctgaaatctaaaacacttctggtcccaggctttatggacaaaggatactcaacctgtaacggaagaggaagaaataaaaggcataaggatgggaaaggaagaagcaaaaccatgattatttatagatgataggcaaataagtactatcgatacagaaaaaaataaatacataaataagcgtttcaaaggattaaaatcacttaatttctggcatcaattagactaatataatccttgtaacttatgcctctctgatctcaaaaatcacacagagctatttatagtccagaaattgtattagttcttatctaactttagaaatcactgcattgtgactctaccaggttaggccaaataaagtataagatatacttctaggatttaaaggatctacatacaactaaaataacatctgcctaacgtgttcaaaaacatgctgtcccagatctatgaataatgcttttctgtagtctaacagccctatttcaaatttctgtccttcaaaaagatattaataatgctgaaaaattattccactttttttgatctatgacttagcacatgtaactattcaggtctgtttgaagtttggccaatggtcaagatttttctcgtactgacattactgcaaaaatttagtcacttatgcaatctatccagtaatgtatctattaacaatttattgagagcctattaagtgtcagacattgttgtggtccctggtaataaagcagagaacaaaattaagtgcctgctatcatgaggtttggatgttagatgataattatgatgataatgatgattacagctgcaaacatttagaaagtgtgtataagacactgctctaagcactttaaatgtttatactcaataaccctttgatataggtacttcctccatttcaaatgaggaaactgaaacatatactggttaagtaattttcccaaggacacttgaataataaagtggcaaagccatgatttcaaacccagtcagcttggctccaaattccaagctccttgaaccatacagtatttcagtgctgataatttttatggagaaaactaaaatagagtagaaggatatcggggggtataattttatgcaaagcagtcatagaaggatttattcatatccttccatttattaaacatctccctttgaagattgcctcagaccatctcctcccacagtcttccaatctcatttaattccatccttcaagttaatcagggcaaagactcacctggttggtcagaatagaacagggttatgctgcagtaacaaacaacctcccaaatcagtggcttgacaaaacaaaagttttcatcttgctcatgctgagttcactgcagctccagctagttatcttctaatggtgactttaccgtcccagctattatgaccttgtggttctataatttcaacacaaggcctcctccacagtaggggaagaactgggaaacatacagggctttacattgccttcaccaagtacttcctcacacaattcattggccagaaagagtcacacggcctcgccagactgcaaagagagctgagaattgaaatgttgcatagcccaggtacgaatggtgaattggatattggtgaacactaccacatcatccttgacctctctttctttcatagtccacatctaaaactatggcaaatcttaacagctctatgttcaaaatacatccagaatctgattacttctgactgcctttacctctacagctcaggttcaattcttcatcatttctgacctagatgattccactggccttctatctgatctcactgcttccatacttgtccttactgccatccagtccagtcttcacccagatgccaagtggtcatgtcatctctatgaacaaagtctccaactgcaatgacttcccagtccatttaaagttggtggtttttttttttttttaagtccttaaaatggctttctaggtcctacagaacgaacccgggcaaccaataccactatgactccatctttcttactactctccttctcactcactctgttccagccacatgtcctccttgggatcctgtgagcatgccagaaatgctcctacttcagtacctttgcacaggatgttctttccatccagaatacatttccctcatacatccacagggttcaattcctctctttctttaggtcattgctcaaaggtcatctctgaagtgaggctctctctgaccatcttatctaaaatagacctctccccacctctggcccctagcattcctgagcccccttccttgctatctctttaacatactatataatttatttatgtgttaatgacctgtatctcacccccactcagatgtaaattccatgaaagtaaggtttttgcctcttttattcactacattcaataaatatatatagtttcaatgaatgaagatgacatgtgagcagaaagacacctaagggggtaaatgacctatacagataacagagaaaacagaacatcacagagggaataaaggcccagacacatgggacctcatgactgtttgaggaacaaaaaataggccaatatgcttggacatcaaatagtaaggggaaagaataataagaaaatggtaatcccagcactttgggggccaaggcaggtggatcacctgaggtcaggagttcgagaccagcctggccaacatggtgaaaccctgtctttactgaaaatacaaaaattagccaggcgtggtggtgcgcgcctataatcccaactactcgggaggcagaggcaggagaatcacttgaaactgggaggtggaggttgcagtgagccaagatcacaccattgcactccagtgtgggcagcaagagtgaaactcaatttcaaaaaaaaaaggaaaatgatgttcaggttctactgggagtcaatcacatgtgtccgtgtaaatcatggtagagacttaagtttttactctgagtgagttgggaactcattgaaagcttttgagcagaggttggaacataatataaatttgttttttagaaattattttatttatttatttatttatttattttagagaaagagtctcactctgttgcccaggctgaagtgcagtggcatgatcatagctcactgcagcctcaaattcctaggcttaaacgatcctcccacctcagcctcccaagtagctgggactacaggcacataccagcacacctggctaactttttaattttttgtagctatggggtctcactatgttgccaaggctggattcgaactcccaatctcaagcaatccttctgctttggcctcccaaagcattaggattacaggtgtgagccaccacagctggccctgaatttgcctttaaaaggatcacttgggctgctgagtagaaaataagtaccaggcaaagaaagggcaggcacaggaaaatcacttagaggttactacttctttacaagagagatgatgatgacatggataaaactggtaatggtgaaaatggtaaaagagtggggatctgaatagaaattcaagagctaatacagcaaaggaaatgagatgactaagtctggagttcatggtagaaggctgaatttgagatataaaactggaaatcatcagcacatttgtagtagtcttaagactagatgaaggaaaagaatggctgacagaaagaagcagcttcactttgaataaacagaaggaatgatagagaaggctgaagagagagcagaaaagaggaaagatggaataaagtctacagaagcagtggcaaaggatagatgtatgtattctcagaaggaaagatggatggattgacttataaaagaaatggaggaaggaaaaacagctaaatgggacagagaagcaaagatagaagacagaagcaagggcatgtgggacagcaaaacgaagactaacggaatataaaagcaagaatggataaagacagatggaaaatcgtaagagggtcaaaaagaaggaaataagaacgatgtcagtgaaatgatagaataggaagtcctggactttcctttcatccacagacacactgattcaacagcaatacacagatcaattccctttgtgagaaacaaactagttgagaagctcctgcacattgggagaatgtgaaactagccacactgaaactagcaggagacaccctctcatcaaaatctccactcttggcacagagccatatgattgagacaaaactctcagctcctaggttttccctgaggaagatacatccaatgttccatccctcccagctgctgcccaagagactagcatctgtatcattcaacacagagtgctgggcgtggtggtgcatgcctgtaatcccagctactcgggaaggctgaggcagaagaatcacttgaacctggaaggcggaagttgcagtgagccgggatcgtgccattgtactccagcctgggcaacaacagcaaaactccacctcaaaaaaaataaaataaataaaataaggccttcatcttacactatacacaagaatcagctcaacatggattaagacttaaatgtaaggtctgaaactgtaacactcctacaagaaaacagaggaaaaagctttgtgacattgggtcttggcaatgctttcatcaatatgactccaaaggaactggcaacaaaagcaaaaatagatgacatcaaactaaaaccttctgcacagcaaaggaaactatcaacagagagaaaagctcacctatagaatggaagaaaatatttgcaaaccatttatctgataaggagtaaatttccaaaatatgtaaggaactcctgcaactcaataacagaaaacaacccgttaaaaaatgggctatgcatttgaacaggcatttttctaaaggaaacaaacaaatggccaacaggtatatgaaatgatgttcacatcacaaatcattagagaaatgcaaatcaaaaccacaatgagatatcaccttatacctattagctattgtcaaaaaaataaaaggcaatgtgttggcaaggatatggagaaactggaaccctaatgtaatgttggtggcgctgcaaaatggtgtgatcagtgtagaaaaaagcatagaggttcctaaaaaatttttgaatagaactaccatatgatttggccactcaactcaaggtttttatccaaaagaactaaactaaggattccaaagcaatattagcactcccaagttcactgcagcactattcaaaatagccacaagatggaatgaatccaaaagaatggattaagaaaatattatacatacatacatatacacacacgtatatgcatacatacacacaaatataaaatacacacacaatggaatattatttggctattaaaaagaagcaatccttcaatatgtgacaacatggatgaaccttgaggacattatgctaagtaaaataagccagtgaaaaaaggacaaatactgcatgattccatttatatgaggtatataaactggtcaaactcatagaagcagagaatacatagaatggtggctatctggtgctacaggaaaggggaaacaggaagttgctaatcgacaggtatacagtgtcagttatgagagatgaatactttctttccttttttttttttttagttttttttttttttttgagacggagtctcgctctgtcacccaggctggaggtgcagtggcacaatctcggctcactgcaacctctgcctcctggttcaagtgatttttctgccccagcctcccgagtagctgggactacaggtgtgcaccaccacacctggctaatttttgtatatttagtagagatggagtttcaccatattggccaggctggtttcaaactcctgacctcatgatccacccacatcggcctcccaaagtgctgagattacaggtgtgagccatgtgcccagccaaaagatgaaaacttcctaaaaatctgttgtagaactttgtgactatagttaataatgtattttacacttaaaaatctttcaacagggtagatctcaattattcctacagcaataaaatatatttttaaaaaaaagaagagggaagagtagataggaacaatcaaaccaaaattttagaatcctaaatctgacgtgatattctgtaacaaaaaaggtcaattactaataagtgagttatgaaccttccatgaatctcaaatatattgcatatacacttgatttcatctttgtaagtgagacatatctcttgactttatggatgctatataaacctttaaaaaaaaaaaaaagagatgggatcttgctatgctgcccaggctggtcttgaactctcagtctcaagtgatcttcctgcctcaacctcccaagtgctgtgattacaggcatgagccactgcatctgccctatggatgctatacaactaaatgacagaacctgttctacacttacagagagaaatatgagaggtgaagctaagaattaattagataacatgtagaaccgcctattgaggtacattctttcatttatacagccaacatttgggcgtttactcaggatacaaaaaaaaaaaattctactccttagaatctccaccatttaatgagattaaaatacacaaatttattgttatattaatgaatgcattgtatcattgatgtccccaatgttaaagcacataaaaaaggaaagcaattatactagggaagatctctaaggttttataacagaaagatggtaactaatctgggtctttttatatctatcatggcactttgtgacagcagcttaagttgatctttacttgaagtattttttaacttctgaggttgacttaacactagcataaggctatgtaatttatgccttcctaatctctaaatcacataacagtatttgaaatataggacttttactattccatgtgtatttttagaagctgctgcaacataacactacaggccaaaaatcatgtataaaatatacttctaggctttacaggattaatatggaactaaatgaagtatgttcaacatgtttacaaaagcaaatggaggagctatatatgctggttttctgatattcctatttttacgctagatgaattcaagtttttcagatgctttcatagtggtaggactatggggtgggggtggggaagagtgccaggaaaagaaaaataaagctgtaaaagttgaatacagcacccagattttggtttttaaatatcgtcccccaataagaataaccaagactcaacagagcagttgctgattccggggctgcggaaaggaaaacagaagatgaactggagcatttcatagtgtcagaaaaaagtgctcaagacaaataggattggtgtatgttaaacaacaggatgggtgccaacactggaacaatttaaatgaaataaacagtaatagcagtacattatgacccaaagagtaaaaaaaatatactcatgagtctgtacttttataaatgaatgactgaataattaaatcaatgagggagaaggaacaactcttcattacagaagaattccaactaataaatataggatgaatgaagggaatagaaaaatcatcattagaatagcacataattcaggcaagatctactgttgaatactaaaattcatggttgaatgtttaaggagacagaatatttacaaagtctgaaagtatctctcccaaaatattaattacagaagaaaaatagtaattttacagctgagaaacctggcagacattaactgaaacacatgatcaaggttagtatcatttgtaacaagacataccgataccacatatcccctgatataaaaaaaaggcacatcacttctgtggcatttttcccccaaaatgcataaccttaatctaactatgagaaaatatcagataaaatcaaattgaggagcagtctacaaaatacttcgccaggtaatgatatactgtatctgagtaagatggccaactggaagcccctagcactcatcgccatcacaaagacagacagaacaacaaataaacaaatgtattttgaagaaaatagctaagggagaacactggggtatatcacaggaacagaaaccctggtgagtacagaaacttaggatggccacacggagaatggaaggaaatgccgggcctccaccacctcatcctccaaatgggatcagctgaaagccaggaggaacttctcatggtgaggagataagcaagaggatcccagcaacctccatcaacaccttgaacatgtagagatcttacctcacaggtacaaagtccagctgacggaattacctggagtccacgtaactgtgctcaccgtagagaaaaagcaaacactaggctccacaccctgcagctacagggctactacgctatgccatcgtagaattggaactatggctggagggtgtcttgctctggcggtgagtagccgtgactctccttcatctctgagactaagatgcaactgaaccaccgccccagccaagtggtccaacatccccaagccaagcttcctttcctgtggggccaagcagagacagagccactttacttacccctccacccttgtgcttgagctgaagtagtatcttgcctcttgcaaaaacagtaccttggccactctgagcagtcatgtctccctgaagtctaagatgaagcagtgccctgcatcccaggaaatggtgacttggccacccagaagaatgatcatgcattacagtacctaagctgaagtggagccctacatcccagggaaatggttcctggtcttcccagaataatcacactctaccaagcttgagctgaagcagcattatcaccctctgggaataggtgccttggctgagccgagcagctgcacatctcagagctgagctgatgtagtaccctgcatcccagggcaaaaaagcagtggctaagctgagatactctgctctacaggccaaacagctctagtatcctgcttctgtggagctggactagctacctagagtgtgagttgctgagatacccatctcccttgatggtggggtcagaactgtgctgttccctgttcctcgcagggtccaatgacagctgtgctctgccattctgggtatttgctgccactacatctggcctcccagagggaggatactgctgagccccactataccacggtctagagttattactacacagttgctcatcctctagaacccaaattgccactgagccctattggctcagattcctaaactgcagctgaattttgctccccaggctcaaacctccaaagtaccccttactccatggagtcaggccagagctgtgttctgcctccttcaggggtagaatcatagctacaactcagcttcctgagaccaggctgctagatggtacctgagtcacagattttggttctatggacaaccggtatccaaccctgccacagaaagcgaacctgtactccaagacccagttgccaaaacagggtcatgagaccctgagattaggacctccatctgccccacagctgctctggacatctgcacctggaacccagagctgctgcagctgcttgtaggttgtgtcagacctgacaataagaggaatccccttggctaagtctcctaattgtggggaaaatgagaatagaagaatcccaaaaagcctatgacaccaagaacattaacaatctatgctgctgcagctgctgccgccacaaagttctacagcctaggctactgaggtgcccacagttattgctgatgttcaatgcagctggagcagctgcatggagactataccactgcacctatctggaaagagagtcaccataccctttccaaatggcacactaaaacccaataacaggtgaaagtctgtctctatgaaagatattttaggaagtttggaagagacaactgttctaccagatgcacagacatcaatgcagggaccaatacagacagactattcaatgaaatcaggaaaacaattcacaatataaacaagaaattcaacaaagagatataaataaaaagaaccaaacaaaaacgctgtagctgaagaattcaataaatgaaatttaaagaaatacattagagagcttcagcagcacactttgatcaaaaagaaagaatctctgaatatgaaggtaagttatttgaaatttgtcattggagaaagaaaaggaaataagaatgaaaaagaacgaagaaagcctacaagacttatgagacaacattaagcaaacaaaactttctattatgggagtttcagaagaagaagggaaaaggtgtagaaaaacctatttaatgaaatcatagcagaaaacttctcaagtctggggagaaatatgcacattcagatccaggaagctcaaaggtccccaaatagattcaatccaaatcattcctcacggcacattacagtcaaattgtcaaaagttaaagacaaagagagaattctaaaaacagcaagagaaaagtgtcaagtcatataaaaggaaatctccattagactaatagcagatttctctgaagaaagctcacaggccaggagaaaatgggatgatctattcaaagtgctaagagaaaaaaaaaatgccaccaaaaataccatactcagcaaagatatccttcagaaacaagggagaaataaaatctttcccagacaagcaaaactgaggaaatttatcaccactagataaggcttacaagaaattctcaagggcagccgggtgcagtggctcatgctcgtaatcccagcactttgggaggctgaagtgggtggatcatgaggtcaagagatagagacaagcatggccaacgtggcgaaaccctgtctctactaaaaatacaaaaatttgtcagttttggcttctgttgccattgcttttggtattttatacatgaagtccttgcccatgcctatgtcccgaatggtattgcctaggttttcttctagggtttttatggttttaggtctaacatttaagtctttaatccatcttgaattaatttttgtataaggtgtaaggaagggatccagtttcagccttctacctatggctagccagttgtcccagctcactcatagtgggggaactgaacaatgagaacacttggacacaggaagggggacatcacacaccggggcctgttgtggggtgcggggagcgggggagggatagcattaggagatatacctaatgtaaatgataagttaatgggtgcagcacaccaacatggcacatgtatacatatgtaacaaacctgcatgttgtccacatgtaccctagaacttaaagtataattacaaaaaaatacaaaaattagctaggtgtggtggccagcacctgtagtcccagctattcaggaggctggggcaggagaattgcttgaacctaggaggcggaggttgcagtgagccgagattgcaccactgcactccagcctggcgacagagcaagactctgtcttaaaaaaaaaaaaaaaaaattagttgggcatggtggcacacacctgtcatcccagctactcgggaggctgaggcacaagaatcacttgaacccaggaagtggaggttccagtgagccaagatcatgtgactgcactccaggctgggtgacagagtgagactttgcctcaaaaaaaaaaaatgctcaaaggcatcctacatctaaaaacacaaagacaataatcactatcacgtaaatatgcacaagtataaaactcactggtagaacagataacacaaattagaaaaagaataaaaacttacaactacagaaaaccaccaaaccacaatgataaacaataagagagaaagaaagaaacaaagaatacacaaaacaactaacaaagtgacaggaataagacctcaccaatcagtaataaccttgaataataaattgattaaattccccactaaaaagctacagagtagccaaatggattttaaaaacaaaatgatccaattgtattctgccaacaagaaacttaattcacctgtaagaaacatacagaatgaaagtgaagggatgaataaagatattccacacaaacaaaaaccaaaagcaaaaaggaatagcaatatttacactagacaaagcagaatttaagtcaaaaactaaaaagaaacaaaagctcataatataatgataaaaggatcaattcaacaagaggatataacaactgttaatataatgtatccaacactggagcacccagatataaagcaaatattattcaatctaaaaggatagattccattacaataatagggacttaatcatccaactctcagcattgagaagatcatctaggcagaagaaaatcaacaaagaaacactggacttaaactgcactcaagaccaaatggacccaacagacatttagaacacttcgttccacagttgtagaatacacattcttttcattggcatatgaaacgttcttgtggacagaccacacgttaggtcacaaaacaagacacaacaaatttaagataactgaaatcatatcaagtatcttttctgaccacaatggaataaaattataaatcactacaagaacttttgaagttatacaaatatagggaaatcaaagaacccacttctgaatgaccagtggatcaatgaagaaattaagaaaaagatttaaacatttaaatcatttcatttgaaacaaatgaaaattaaaaaccaacataccaaaacctatggactacaacaaaaacagtattaagaagcttatagcaataaacactgatatggtttggctctgtgtccacacccaaatctcatcttgaattgtagttcccataatcccaaagtgtcatgggaggaactaggtggaaggtaattgaatcatggaggcagttcccaccatgctgttctccttatagtgaatttgttctcacaagatctgatgattttataagaagcttccccctttgcttggcactcattttccttcctgctgccacgtgaagaaggatgagtttgcttccccttctgccatgattgtaaggtttcttaaggcctccccagccctgcagaactgtgagtcaattaaacctcttttctttataaattacccagtctcaggtatttcttcacagcggtataagaacagactaatacaaacacctatgtcagaaaagtaggaagatttcaaataaacaatctaacaatgcattacaaggaaccagacaagcaaaaacaaagcaaacccaaaattcatagagaaaaaaaccaatcaaggttggtgcaaaataaacaaaattgagactaaaaaaaattacaaaagatcaacaaaatgaaaatttttaaagacaaaattgacaaaccaataggtagactaatatagaaaacaagtactattataaaataactgttcaaagcaattatattattttttgaatgctagtatccattcagatttttttttttgagatggactcttgctctgtcgcccaggctggagtgcaatggcattatctccatttactgcaacctccgccccctgggttcaagcaattctcctgcctcagacttctgagtagctgggattacaggcacctgccaccacacctggctaactttttgtatttttagtagagacagggtttcactacgttggccaggctggtctcgaactctggacctcatgatccacccacctcggcctcccaaagtgctgggattacaggcgtgcgctactgtgcccagccattcattcagatttatccacatacttatggtttctattgctctttatatctttctgtatctctgtatttctatatagaatcattttccttttgcctggcaaaacccctctagatttccttcatatttgatctgcagattctgtttatctgtcctctccttttgggatttcaatacaaacatttcagattcctttaccaaataccgtatgtctctcatgctattttctgtattttccatcctattattttgtgtttgaatctggctatttcttctgaactatcagtttatcaattctctcctcagctatatctaatcttctgataaacctatccactgacttgttaacttcagctatcgtatttttcatttctaatattttcatttgagtatttaaagctctctgtcaaaattccctattgtattcaatttttgaaaatattaatcacagctgtttttaaatccataattgataagtctaatgtggatttcctatgagtctaattgtctggtttttttcctcctggtttcagtcattttttgtctttcaaaatgcctggttattttttaccgtgttccagacattatatttaaaaagctatagatatcctcctttagagaaccttaacatttacttgtggcacacttctaaaatatgatctaacaccattaatcacttaagtattaagctgatttccctatggactttagtgcttgtataggatattttactcactctattcctaggatattgcctttcaggggtttcaaccaaaagctgaaatagtccagggctcctcttccttgttagtctctgaactccatttttttccctttcagcccaacacaactgctaaaaattctgctcagtctctcagtcaccattgtaattttcagaattgacttttgcattaaggaaaaaacagcatcaaatgtcaagttcgattatcttggttttccttttcttccagatcttagccccacaaattcttactatcttttttttgtttgttttgggatggggtctcattctgttggccaggccagagtgcagtagtgcgatcttggctcactgcagcctccgcctcctggggtcaagtgattctcctgactcagcctcctgagtagctgggactacaggcacgtgccaccaaacctgactaatttttgtatttttttaagtagagttggggtttcaccatgttggccagcctggtctcaaactcctgacctcaagtgatctccctacttcggcctcccaaagtgctggaattacaggtgtgagccatcgtgtccagacaaattcttattatctgtgtaactctctgatggcttcaaagagatttttaaaaaatattttctcagctttcctatgtatttttagtatacatacctggtgtttggtctaggacaaccaaatcagccacttccagaagtagaaatgcccagtttaacatgtatttagtttgaagtgcctatgagacatccaagaggacttgttaattataaaatgatgtacataattctggaatttaagctagacatctgcaatagtagacataaatttgggacttactgtagaaatggccctaattgctataaaactagatatacaagtggaagaacagttggaaggaagaaaaactaaggcattcaaggaagtaaggagataaagaaaatggagtggttacaaaagacaaagtgggggagacacaaggggaaagtaaaagcaagagagcatctttccataagaaaataggaataatggaaagagaagaagaaaaagctagaaaaaatggaaaggtagagagaaaaacaatgaggagggctgggaagaaagatggcaaggggagggaagtttggaagaaggaaggtaggataggcaggtagcaccaaaaaaggaagggagagacagaataagtgatatgatttggacattgtgtcccctacaaagctcatgttgaaatgtgacctccagtattggaggtgggcctaggggggagccatttgggtcactggggcagatacctcatcaatgggttggtgctatcgtcatgatgcgtgagttttcactctattagttcatgtaagatttggttgtttaaaagaccctggcacctcctcccctctctcttgctccctctcttgtcatgtgattctcctgcttccctttcaccttctgccacaattgtaagtttcctgaggccctcaacagaagcaagtgttagcagcagcttccagtatagcctacagaagtgtgtgccaaaatatctcttttctttataaattacctagtctgagatgttccctcatagcagcacaaacagaaataacacaaaaaggaagaaaggctgacagaaaggacagacctttgtaagatggatctttgtaaagatgacagagacagactaaccagccttggaaggacagactaaccagtcttagaaaggacaaatgggtgtttggatgtcaattatgaaagaaggagggggcagcatgaaagaaaggaagagtggaatggatgagaaagagcaggacagaaagattcagacactttgataaggagacttaacaggaagtgagtatgagagctctagaaaaaagaaaataatgaaagaacaacaaaataaatccaattaagatagccactaaatatgatgtggttttcaaaagaaaggtggagaaacagtttaaaaatttcaaacaagagggttatgaacctgtcatggactgaaaacaaatttcaattacatgcgtttacacatttgaaaataaaaatgttccctaaccatatagctgttatgtaattatatgaaaaacatgtgttatgtagagaaaaaacaaacaaacaaacagaaacaacagaactattcttaactaatcctgtgagtcacattatcttatttaggtaaaaagttacatttaggcctgtattaatttttaaatattcttatagtcctactgcttttatgtcctttttatggtaaaatattagtgaccaataaaatgcagaaaattgtatctgaagcactttcattcactcattctttcaatcaacatttgggtattttcttgagttaaaaaaaatcaataaagctttaaaaatagataaataagaagatacagaattcccatccttgaagcctcccaaatttaatgagaataagatatggatattacctatcaaactgcattattaaagttcatggcacagaggagtcaatctgtcaaggaaggtccataaagtttcacgaagataatctttgatatgggccttttaactatcatagcatttcactttgtgacagcagcataaaatgatctgtaatagaagtatatataccttctagagttgaattacactagcacaagtctatataacttatgccaccatgatttcaaaaaccacatagaggtaattgtaatctaaggctcctactaatttttatctatttttaaagaacactatattgtgactccaaaggggagggaaaatcagcagaacatctacttggggactttaggagacttatataaaattaaataaaatctgttaagcatttgtaaaaggcaaattagaactatatataatgattttctgtagtctaaaagaaatttcccttctcaaaaaaattattcaaaaatgctgaaaattattctgatttttctgacctatgatataaattgtaaacaactatcccaagtttgcacgaggtttttctaacggttacttggtaaggatgatttttaaagagaaagacaagaaaaagaaaatcaagaaggtcataaaagaacctagaattctatacccagtgtaaataaggatggtatcttcagacaaacttgggagagtttaccattagcagccttttactatagagaattctaaaaaatctaacgtaattagatttgagactctcctaaaatgacagtacctctttaccacaagggcagtcccttgaataacactttataatcatttatttattcaacaaatatttattgagaacttatgtactaaagactgtactagatattagaaacacacctgtggttttttaaagtcaaacttcctacaatttgaagctaatattctagaaggagagggagtaaagacagaataatacaaaaacagtaaagcaaactgttcaaatggtaataactgaataacataaagttaaaggggaaactgggacttcagggaataaaggaatggagactggtattttatatgaaacaagtcaagaaaatactcactgataatagaacatctgtgcagaaacctgaaggaaagttggagagcaagcagtgctggtaaggaaacattttgtgcagagggaacagcagatgtacaacacaggtgaagaacatgcatggcactttaaaaagaatactcaaaaaaccagtatggccacagcacagagagtgaaagagtggcaagagattattaggttagaaagttatcaagttccagttcacatgacatcttgtagactatggtaagggctctgccttttactctgagatataagccactagagattgatcctacttgtgattatgaaggatcacaatgagctgaagaggaagaaggagagaaccagagaatctgaagggaaattattcggtagttaatgtggaagcatgagatggtccgaacttggatacattttgaaggcagagcccatataatttaatcaacatgtttaaagtaaaaaaagcaaggaataagaaatggcagatttgaaaaagaaccaaagaaaatctccatatatgaaaaatataataattgaaatccaaacttaacagatacagttaaaaataacatttatagaatagctgataaaaagacatttttaaaaatgaagtacagagaaccaaagagatggaaaatatgaagaaaataaaagagtgcagtaaaaatgtctaacacacgtacaaatgtattttttttttgagacggagtttcactcttgctgcccaggctggagtgcaatggcgcaatctcagctcaccataacctctgcctcccgggttcaagcaattctcctgcctcagcctcctgagtagctgggattacaggcatgtgccaccacacccgacaaattttttgtatttttagtagagagggggtttctccatgttggtcaggctgatctcgaacttccaacctcaggtgatttgcctgcctcggcctcccaaagtgctgggattacaggcataagccacggtggccggctacaaatgtatttccaaaaagagaaaataaagcaaggcaaagcaagatctgaaaaagtaacagctgaaaaactttcaaagctgatgaaagatagcaacagacaggtttcaaggagcactgtaaatccaagagaagtaaatacaaagaaactcagacggagattcatcatcgaaaaacttcagaacatgtcagagaaagagaatatttaaaattagacaaaaagaaacaagatattacccccaaaaaaagtatgagtgggagtggcagctgactataactacatccccaacaggctcagagaaaatcactgtcaacctagaattctatatccagtgtaaacaaggccagtatcttcaaacaaacctaagagagtttaccatcaccagtctttttctatagagaattctaaaagatacatctgagataaaagaaaaatgttccccaatggaagagctgagatgctaggaagaataaagaacattgtaaatagtagatatgtgggtaaatgaatactggccttataaaacaagaataatatattttggtttttaaaaacaaaaacagagaaatgaccagaattagaatatataaatcagaagaaaggtaattagagtttgcgtttcaagggccttgaattatctaataaatagacaaaattattgattaactttagacattaaccaatgtgcttctggtaatttctagagtaaacactaaaagaatagctaaaataatgtgtaattattttattaattaataaatttattaagtctgataaattaataaatctagttattagaaagaaattaatgaaatttaaaacaacagaatttaaaagaatattaaaaaatagaacaggaaggacaaaaagaaaacacaaaataatatgacaataaatccaaatactttggtaattataacaaatgtaaacagactaacgaaaggcttcaattaattaaaaactatcagactaaataaacaaaagttaatatatgctatttacaagagacatctaaaagactccagaaagtttgaaaaaaaaaaaaagggatacaaaaaagttgactataaacataccaaagaaagctgccatagctatattaattataaacataatgaactgtaaagaaatatactataaagtcacgttcataatgactttaaccaggttaataatcatctaaatatatacatattttacacatttctccacacctcgtaatgataagaacaaaagccttcacttcaccaggagaacatatatttaattttagcatttcaaattgtataaagtaaaaatgacagagcttcaaataaagacagatctatgattaaactgtggggattttaacattcttctgataataattgagataagcagaccaaaaatgagtacagaagatttggacaacttattaacaaccttgacctaatggaaaaacaaagaatatcccgtctaataacaatgaagacagcagtatacacatggaacatttttaaaaattcagcatatattggaccatttaaaaaaaagtctatataaatttcaaagaactgaaattatttacagcatagtctctgaccttgacgtatttatgctaaaaattaatactgaaaagacaattagaaaactttgcatgtttggaatataataaatattataagtaacaaaggatataattctaaataattcacagaccaaagaaaaaaatcataacaaaatttagaaaatattttgaactgaataatgaaaataccacattaaagagaatgtggaataaaactacagtagcaattagagggatatttacacacctaaataattgtatcagataaaaaggaaaggctaaaaatagcctaagaattcagcctattaaattgaataggctaaatagggtattcaataggctaactccatttcaataagttagcgtaaaaaaaagcagaacaaagaaataaaattaacacattctgaaataaaaaacaaacctaccatagtgaaggcaaataaagttggttgtctgaaaagacaataaaactaaccaacctctgatgaaatgtatcaggacaaaaggtaggagacacaaataagcaatatcaaaaatgaaaaggtttgggtgtaattgctcacacctgtaatcccagcactttgggagactgaggcaggagaatggcttgagtgtaggagacagagcaagaccctgtctcaaaaaaaaaaagaatgaaagaaaagggcaaaataaccatagatactacatatatttatatcaaacaagaataaagctaaatgggtttcaatttcaagtaacagcttaggttatttagatcaatctaattggtctaaacaaacaaaaatactggttaagatatataaaatatctccctaaagagttggcaagacaataaggaattcccaaaccaaaagctaagtcgaacatataattagtttttgccctaagaacatttgctaataatcccagagaaccttaatagtggttttgacagcctcacggtacaaggacagaaattaaagcctagaaccagctcaagacagagagtctaagatactccaaaacattaagccaagatgccaaaaggctagacatcgttagggaagacgtgaaccagaaacaaaatcctcctccacaccttttgtgaggttgccttggcactcagcagaaaaagatggaaaatataaataaaaagtaaagaatttataggctgtaagcactggccagcccttaggtggattttcatcagaggggcacaagaaatctcaaacaataaatttaaagtgccctgcagtggtaatgactctaatgccattaagaagtaagttcaaattctagagcaagcttgcccaacctgtggcctgcgggctgcatgtggcccaggtcagctttgaatgtggcccaacacaattttgtaaactttctcaaaacattatgagatttaagcacagacttttttttttttaagctcatcagctatcattaatgttagtatattttatgtgtagcctatgacaattcttccaatgtggcccagggaagccaaaagattgttctagaggaagacaaccttataaaaggcctcaggaagttcccacaaataatctttcaaaaaatgagaaaaatcttcaaagcagctagaggataggagtagatgacaaattacattcaaaggagaaacagtttccaacagcaataaaggtaaccagaagacaacagaatattttcaataaactggtaacaaacccagaaacctaaaattctatattcatgaagatatctttcaagaattaagacaaacatatagacattttgataaaagataaaagagtttgtctccaaaagatgtcactaaaaaaaattctaaatgatatattttaggcagaagtaaagtgattacagatgattgtctagtatgtaagaaatatgtaaagctatcatgtaacaataaaaaaaagaaaaaattaagagaaaatgaagtcactgcattagatgcctcctaagtacttacaatacagaagagcaaatagttacataagcaccataatatactgcagtaagtattgtacaatacttagtcatacttttgttaacaagattgaaaaatctacactgactaaacaatgaaaatggtataaagaaagcccaataaatgccaagtagaaagatttatggagtgcctgtcacttaataggcataaataataatcagcaaataatgggttggcaaatcaggaggcaatatggcacaggaatttaaaaagaaagccctgcctacccactcgtgaatgagtaaaacgagcggaatctaacatcaggagtgagggaatagaagaatgcctctttctttctctccaaagttttctcacaaacccacatttcaaagatgagaggactggcatataattgagtaaaactgcaaaaacaaacaaaagcctttaagaaaagtttcagcttagctgggcgtggtggtatgtgcctgtactcctagctacttgggaggctgaggtgggaggatcacctgagtccaggagctgggggccacagtggactatcatcatgccactgtactccagcctgggtgacagagcaagaccctgtctctataagaatgaataaataaatgaaaaaataagaatgagttaattaaggttaggactggtggctcacacctgtaactgcaacactttggaaggctgagtcaagagaactgattgaggccaggagttcaagaccagcctgggcaacaaagtgagacgccgtctctccaaaaaaacaacaaaaaaaattagctgggcatggtggcatgtgcctgtggtcccagttactcaggaggctgaggccacttgagcccaggagtttgaggctgtagtaagccatgatcacaccactgcactccagcctgggcaacagagcaaggccctgtctcaaaaataaaaaaacaaacaaatatataaagtgtcaggaatattcaaactgaagtttaaaaaaaagttaaagatgagaatataactccttttaaaattcatgctcatggcaagaaaattaacaaagagaatacaagcctataactcagaataatataatattaataaatgacagagagaatgcagaacgtcctcttccactagcacctggtaaatacatacacacagacacagatgcacacacacacactcacacgcttcaataagaaactttaaataggagtgtacaaacctaaagagagaacaaaagtccaagataaacctcttggcaagagtaacagaacaccacagacacaatgaatgagctcaagttgagaaaatagttacaggactggagatgaaaaaacaagttggatttttaaaggtggctatcagtggggaaaattccttacaagccagtaagtgtgcttactttcctcaggaaggtaacataaagggttattaaacaaagtttagaagtacttagaaaacagagcttgttctaaaataaaaaactgaattactaataaggtcatgtcaagataacctcttttcactttctgattattagactggcaataacatatgacaatagtatatggcaaagtaaatgatgctttttgcgaagacagaaaattctgaatgttgataagatttttaactggatgaattgtagccaataaagtattgttgaatgaataaattctaacctggaataaggattctaataccaatgagcctatcatgaggctttctgtacccatacagctcttgatgatttcataattattttcaattatacaaaaaagctaaaaggatttggaatctaatcaatcacgttttatattaagacactgtaagcacagatatggcctagggcaagtggtttaatctcactggacctatttcctcatctaataagtggacgaaatcagtgacattcaaactttctggcagtccctcatattaatagtaagaaaaatgatccagtgcaactaacatgtatgtgtttggtgtatgtaactaaaacaaaagtttcataaaacagaatgctcttatgacataatgtgcctaatattttctagtctatttcattatttttaatgtaagttacaaccccccaaattgatatcataaccaaaaatgggacatgaatagagattttgtttatttttctgaaacagggtcttgttctgttgcccaggctggagtgcagtagcatgatcacagctcactgcagcctcaacctccctggctcaagtggcccttctgcctcagcctcctgagtactgaaactagtgggcaccaccatacttgtctaattttttttccgtttttttagtagagatgaagtctcgctatgttgcccaggctggtcttgaactcatggcctcaagcaatcctcccacttcagcctcccaaagtgttgagattacaggcatgagctaccatgcctgatcatgaatacaggtttgaaaaaataatggacaagacttctaaagtcatctatatacagctgtacaatttaataaatagttctccaatttagatatcaaacaaaatccatgatatccaaccagtagatgatgtatactatatcaacataaatagtaatgatgatctcacagtgacagaactcagaattataccaaacaactgaacactgggttgaaaacaaaatgaatctacacaggtaaggctctgcatttaggttcagaaatcctctcaacagagcctggcagcaggtgaaatgaacaagacctgcaggctttagttaacttcaagcctattatgtgatctcagtgtaattcaccaatttattgttatctataaataatactgtttttaataaatatgtgtgatataaataaatattttggtactatgcagatcaaaggtaatctgagatcaaatttaatctggatcagagtgatcagttgtagtccccatccatgtaacataaaagaacaaaatattgatattatatgcgttgatattaatatacattttactgagtataatttccccaatatagtatgctaagtatttttctttatctcatttaatactcaaacaattctatgagatatgtggtgctatagtttgaatgtgtcccccaaaaagcacatgttagaaacttaatccccaatgcaacaacgttcagaagtgggacctttaagatgtgatgaggccaggagggctctatttcattaatgccattatcacagaagtgggttcttcatctaaggacaagttcagcctcctattgctctctctctcttgtcctctctttgctcttctgccatgggatgatggggcaagaaggtcctatcaaatgccagccccttcatcttgggacttcccagcctccaaacccataagcaatatatttttgttcattaaaaattacccagtctttggtactgtgttatagcagcacacaacagactaagatagtattatctccatttaaaaataaagaaacaatcttagaaaagttaaatatcctacccaggtcacacatgttgttagtgggtaaatgctcaaatcaggaactgaacgcaggtctttctgaagagaaactatgaccttttaactcttttttaaaaaaatttgggccgggtgtggtggctcacgcctgtaatcccagccgaggtgggcggatcacgaggtcaggagatggataccatcctggctaacacagtgaaaccccgtctctactaaaaatacaaaaaattagccaggtgtggtggcgggcacctgtagtcccagctactcgggagggtgaggcaggagaatggcttgaacccgggaggcggaagttgtgagctgagatcgcgccactgcactccagcctgggtgacagagtgagactctgtctcaaaaaacaaaaatcaaacaaacaaaaaaaattatttctctttactgagattcccaaaaagctggaagtctgtgtttattaaactcctatttcttatcaaacttttattaaaaagttcattaaaggatctatggctataacaactatttaacatatatgtggaccactaaattcaggtaaattaatagaaaatatattaaaatgtttaataaaatgtaaacatattttaattaataataacaatgatcgttttctaccacaatattttaccagtgtctctttaccttattagtgatggctcactactataagcactcagaagttaattcagtgaaccctaaaaaagctgacagccaaatgcttcaattcaggaaatagtaataaactgattcctaatacagtcttttttttttttttaagatggagtctcactctgttgtccaggctagagtacagagttcagtggcgtgatcttagctcactgcaacctctgcctcccaggttcaagcaattctcctgcctcagcctcctgggtagctgggattacaggcatccaccaccacgcccggctaatttttttgtctttttagtagagatggggtttcaccatgttggccaggctggtcttgaactcctgacctcaagtgatccatccacctcagcctcccaaagtgctaggatcacaggcatgagccactgcgcccggcccctaatacattctttagttgcatttggacttggaaaatatttcttcaaatcctatttcaatgcacaaaaatacacatttttcttaccatatccactagcatatcattaatttctttctctaaacaagtgatcaaaattatccaatgctgggaaggagttaaacttcaccatcacagttcaatctttagaaatcctattatctactcaggcacagtggtgtagtcccagctacttgggaggctgaggcacgagaactccttgaaccctggaagtggaggcggatgcagtgagccaaggttgtgccactgcactccagcctggacaacagagcaagaccctgtctcaaaaaaaaaaaaaaaaaaagaaaaaaagaaaaaaaaaaagaaaagaaaccctattatcttatcctcaacattcaacattaaaaatcctattttggctctattccggaaactaaaaagtcacagaagtaactttttattgacatcgtattatgaataaatgttttcatctcatcctatatttcaaaaacttacatgagcaccttttgtttttataatatacttcagaaatggaaaccaaagccttgactcaagatattttcaggaagatgaaacaattttcacttgattattatagttttaattatattcataatttgtattacattcaacaattaatcatgattaggaagcaaaatgttgactaccaactcttttttctgaataaaacaatgtcagcaattacattacagtacaagttattttattctactatcacttaaaacttagtttttccttgatgctcaaagctagtactgtgtcagcgctgacataatatatattttccagtctaaaaaaagtcacaaaagaatcattaaactaagaatttcttctcctggtttttctgtgataaaatagtaagttatcttgcagatctccctcatacatacaccatagaagtacaaatacctcatttctacaatgcacactgggagttgcattcaaacaaaaggaaatatatattcaagccagtatttaacagtactgactcttttacattgtataccatgaatacaggattatccataacgtcatacgataaaagaatattgtcaaatagcttattctgcctcttcttccagaacagtccagtcaatagcttcataagtgaatttcagtctttttggcaaatatttccctacttcctaaaacattcattaatgattaagtttttctcaatttaaaacttgactatcatttgcttctctgacatttgctatactaggatactgtgtatataaggtagtatttgattttatacaaaactttatttatttttaagttaaaaatatgtatttcatggtgttctctttatttcccagtttgtgaactcaattttagaaacaaaactgtgccagcagtgaggaagatcttggattaagaagactcaagacaccattttggagtcttaatattctaagcaagaaatgcagtgtacacaaatggaacagacttaaagctgttttagaggtggaaaccaataggatttttacatccaagaagaggaggaaacttcaaaaatggcactaagtttctagcttaggagctgagaggatacgctattaattaagaaataaatttggttttaaatattcttggttgagttgtcaattacctgacaaatagataaaaaggactggaactcaggagaattagggatttctaatatatgagttcttttgcttttgtttccctgcctcaccacttaaagctatgtttggggcaagtttttcaatgctgacatggagattaaagggaaagaaaatgcaacaggctagggggcaaatatgttacagggtaatctaggccatgtggtaaatgcaatatataacccagctgggtcatagtttttgtttttttgtttgttttttgagacagagtcttgctcttgttgcccaggctggagtgcagtggtgcgatctcggctcactgcaacctccgcctcctggattcaagtgattctcctgcctcagcctccagagtagctgggattacaggcatgcaccaccacgcccagctaatttttgtacttttagtagatacagggttttgccatgttggccaggctggtctcgaatccctgacctcatgtgatccacccgcctcagcctcccaaagtgctgggattaaggcatgagccactgcgtccagctgggtcatagttcttaatcagggctcattatattcatactggggttggggggacaggggtttgcaaaataaatctcctaagcgccaccctggatattacttctttgatagatctggggtagaaactgagagtatacttatttttttttaagttccctgaatggattgactcaaaaagggttatgagagaactttctgtaattatagaaatattctattacgaccgggatggaatactattcgacctttaaaaagcagaaaattctgtcatttgtgatgtgaatgcatgtagagacactatgctaagtgaaataaactaggcaaagagagacaatatccagaatacataaagaactctcaaaactcagtaataagaaaataatcaacccaataaaaaattagcaaaagattagagtaacacacttcaccaaagatatatagatggaaaataagtacattaaaacagacaacaacaaaatgcaaattaaaaccacaatgagatgccgccacatacttattagaatgggaaagaacaaacctgacaaaaccaaatgttgacaaggatgaggagcagctggtctcatatatagtcagtgagaatgcaaaatggtatagctactttggaaaacagtttggcagtcttcaataaagttaaaacagaagacaaaaatcatcaacagtggaagcacataaaaagaccacaaagctaacaaaactgaaaatcaaaatacagaataacttagaaatagaaatgggcagaatccacacaatatcgccaaataactatgacatgtaggtgtttctaggagatcacaataatttgaaagaaaaacagtgaaatgacagaaaccacaaaaagacaggagagtcaaaaccaatctaacttaattagtaaacttcaaacagtaaacacaacaaatggaatagaaaaagtattcacaaatatgttagaagaaaaataattccaccagattatcatgctaatggagcaacagacattctctaactaaaagaacttgagggaggggcaaaagctggacaatgatatcaagccaaacaacagataaatggagataaaaggactgctgataagttctgaatttatttaggagtaaaaatgggctgggcatggtggctcacaccattttcccagcactttgggaggccaagaggggtggatcacttgaggtcaggagttcaagaccagcctaactaaaatggtgaaaccccatctctactaaaaatacaaaaatcagtcaggcatggtggcacgcgtctgcaattccagctactcaggaatgaggcatgggaattgcttgaactcaggaggcagaggttgcagttagctgagatcatgccactgcactccaagcctgggcgacagagtgagactctgtctgaaaaaaaaggagtaaaggccgggcgcggtggctcacatctgtaatcccagcactttgggaagccaaggcgggcggataacctgaggtcaggagtttgaggccagcctggctaacacggtgaaaccttgtttctactaaaaatacaaaaaaattaaccaagcgtggtggtgcacgcctgtaatcccagctactcgggagactgaggcaggagaatcacttgaacactggaggttgaggttgcagtgagctgagattgcgccattgcactccagcctgggtgacaagagcgaaactctgtttcaaaaaaaaaagagtaaaaataactgggaattttggtgtatagaacaaaataaaacagaactattataaacttcaacaaagtaagaataatctggcactggtggtagaaagaaatacagtatgttaaatgatccataccatgaaagataaggaaattggacgttgcccaaaatgagacacttattcctaacatttcatattttcataaatggaagcaatttctacttcacaaccaagatgaaaaagtaaaaggaacatcttcaatttatctctgcctctgcattaaaaaacaaggaagtacacatgctcaacccagccctataggatgtagtttctattctcccatgcagtaaaattatagaggcattatccactcctgctgtggttgacaagcacagtctatgactatgttgctaaataagtctaattcaaaaataaagtatcataaggctcattctgactacacagtcgtacaacctagtttttactaggaataaagtgaatattatttctgacagtacaaccctcctttgtgtgtgtgcatctctcctttgattagtccgaaactgggaaagtgaagattattgcccatcccccaacaccaactttacagttcagtaaaatcataattctaaaataatttttaaaagtttatcctaagtttagctattcttacattttacttccttgttatattcaagtaaatttacttctttttattttaaaatggtgtacataatatgatcccatcttcatttctctatatccattcatccttttatctttaaatgtacatagagagacccagaatgatttacataatgtttaagatggttatttctagatggtagattaagttttgttttttgttttttttttaagacagggtctcactttgacacccaggctggagtgcagtggcacgatctcggctcactgcagcctcgacctcccaggtccaagtgatccccctgcctcagctccccaagtaacagagactacatgggactacagacatgtgccaacacatctggctaatttttgtattttttgttgagatggggtttcaccatattgcccaggctggtctcgaactcctgagctcaacatccacccgcctcggcctcccaaattgttaggattacaggcatgcaacactgtgcctggcttagattaattttgttgttgttgctgttgtttgttttgtttttgctttttcaagacagagccttgctctgttgcccaggctggagtacagtggcactggagatcatggctcaccacaccctcgacctcacatgctcaagtgatcctcccacctcagcttcctgagtagctgcgactacaagcacatgtcaccacacccagctaattttatttatgtatttgtttgtttgaagagactgagtctcactatgttgcccaggctggtcttgaactcctgggctcaagcaatcctcccaccttggtctctcaaaaggactcaataaaacaaataggaaatagtctacagaagtgtttgcaaactatggcccatgggacaaatctgacctgtggcctgtttttgtatagcccacaagttaagaaaggcttttaatttttaaagggctgcataaaaaaaagaagaatatgagaaagagaccctatgtgtggctcacaaagctgaaaatattaactgtctaactcttcaagaaagttgccagcccttacttagtctatactatcgactctatattgacaaaaggtacaatctactggaactcataattcactgatacacaagagaattttatatattaaggaaatcaaattttatctcacagactcccttttatcccttgggatgttgtctttagatgctgacatggtgatatcggcatgcacaacttttatgattatctaaagttcccaatcttttctttttgattttaggactgcatgttaggaagacttttctcttttcaaaggcaaaaaaaaaaaacttccttagttttcttctactacttttatagttttgtttttcacattttaaatctgtgacatctggaaaagaggcccttccatgactaggagtaaataacagtctatacagaaagataccagactgcagattaatggggggaagaaggtgttggaaaagtgtaggggacaggagaaggaagacaatgaacaggagtctgtgacaaggctggaatcttgaaactgactgaatgataatttataggtttccttctgacagatgttctcaaccgaggatgttccatgggccataaggcagtcagttcctaactattccataagaacaagagcttcagtagagaacaagatccaatcatcattctctttgtatctgaatttatctctagattgttgtatttctctttgttgctattatacacagaatttttcttcctgttatatttgctaactggttgcttatatgtagcaaggggccagccaactatgggtcaagccagctcactgccttctttgtaaataaagtgttactggaacacagacatcctaattagtttcatgctacaataggagaggtgggtagctgagagagagatcatatggcctgaaaaacctaaaatatttatcatctggccctttacattaaaagtttgccaatctctgatatatagggaaactatttgattacaattttttgaggtaaaattgtaatacatataatacaaaactaataattttttctttgagacagcgtctcactcttttgcccaggctggagtgcagtgccatgatcttggctaactgcaacctccgcctccttggtttaagcaattcctgcctcagcctcctgagtagctgggactacaggtatgtgccaccatgccccgctaatttttgtattttttttggagagacagggtttcaccatgttggtcaggctggtctcaaactcctgacctcaagtgatccacccttgtcagcctcccaaagtgctgagattataagcatgagcaaccgcactcagcccaaaattaataatgttaaaatgtacaattcagtggcatatgagtacattgataatgctctgtgactatcacctctatctagttccaaaacatttgtatcacaaatgaaaaccctgtactgattaccttgtacccattaaggaatcactctctatttttccccctgccccgagctaccactaatttgctttctgtttctatgaattcacctgttctggatgtttcatataaacggaatcatataatatgtgatctttggtgtctggtttctttcacttagaatgtgtctgacatccatgttgtagtatctcatttctttttatggttccatcatgtgaagagaccatattttgtttatccattcatcagtggacagacatttaggttgtttccacattttggtgattgtgaatagtgctgctatggacattcatgtataagtttttgttagaatgcctgctttaaattcttttggaattctgtgagtgatattgctggtaattctatgtttaactttttgtggaaatggcaaatttttctacagcagctgtactattttattctctcaccagcaatgtacaagggttccaatttctccacaccctcgccaacaattactttccgtttaaattttttttttttttttgagatggagtcttgctctgtcatccaggctggagtgcagtggtgcaatcttggctcactgcaagctgcacctcccaggttcacaccattctcctgcctcagcctcccgagtagctgggactacaggcgcccgccaccacgcccagctaattttttgtataaaattttttcaataatagtcattttggtgcatatgaagtggtattgcactgtggttttgttttgcattttcctaatgactaatggtgttgaacatcttttcaggtgcctgtagccattgtttgttatatatatattatatatataaagtatatatataatatatatataaagtatatatataaagtatatatatataaagtatatatataaaaagtatatatatataaagtatatatataaaaagtatataaagtatatataaagtatatatatataaagtatatatataaagtgtatatatagtgtatatatataaagtatatatgtaatatatattaagtatatatataaagtatatatacatatatatactttaaacttcgacaaataaaactgaaaagacagcacatcaacagaaaaatgaacaagacaattaaaaggtaatttacagaaagaaaaacctccaaaactaatatgtataagaaatgctcaaacttagtaactagaaaagtacaaattaaaagaatcaaacatcagtttatgcttattagatcagtaaagtttataaagctggataatttttaaatgttgggacataaggatatgagaagactcatgcattgttagtgggaatatagacttgttcagctactgtgaatagcaatctggcatttcttagtcaaactacatatggggctaacctatgtcccagcaattctattgatttgtatatacactccaaacaaatacttaacacagagtcatgtgcaaggatgttcagtgcagaacaatttgtggtgtcaggaaactagaagtaaacaggtagctatcattaagataacagatataatatggtaaaggtctcacagagcattatacagctgttagaagcaatggattagcagtatcaacatgagtacatcttagacatttagtgcttgtgggaaaaaaacagaataagaaatacaacacaatagcatttatgtaagttaaaaataaatgcacataaaacaatatctgttttgcatgaacacacagttacaaaaagataaatatattagaatataaccacaatgtatactgtataacaaacaatgcatttatgtatgggagaagggaaattcaaataggaataaaggaggctaaagaaagaaaacaaggaagagaccttacataaacctgtaatgataatgtcttaaactaattctctgcacctaaggctaataaaaattgtatctagccacatcgctggattctcttatttttatttatttatttatttatttatttatttatttatttatttatttattttgagatggagtctcactctgtcgcccaggctggagtgtagtggcgcgaccttggctcactgcaagctctgcctcccgggttcacagcattctcctgcctcagcctcctgagtagctgggactacaggcacctgccaccatgcctggctaattttttttttttttttttagtagagacagggtttcaccgtgctaaccaggatgatctcgatctcctgacctggtgatccccctgcctcggcctcccaaagtgctgggattacaggcgtgagccacagcgcccggcctggattctcttattattaatagtaccttttcagttgattctcctagatattttgggatataataatattgtcctaaaaacagcaataaattttacttcctcttccatttttataccttttatactgcattagttagtacctctggcacaataagtaatagtgatgacagccagcatttgtatcttgctccagactttgtagaacttctaaattttacccattaagcatgatgctgacttttgagctgatttggtagccttctatttctggtttagtactaaattttattaggaataaatattgaactttatcaaaagtattttcagcatctatggaagtgatcatataattatactctgatctactaatataatgacatattaatatatttccaatactgaattattcctgcattttcaacatgaatgtaggatatacatttaaaatatgcttctgtatcctatttgataattctacacattgtttcctcttcttttatcatgttttagaacaatttatatatcactgaagtcacatgtttcttaaactttggtagaacccaactatgaaactatctaagcctgatgttttttgtggaggtaactctttgacaatattctttattccttccataggagttatgctttgaaaagatcaataaagtataaaaacatctagcaagtcgaagaaagaaaaagaagaaaaaaataaatatctattagtaatgtaagaaagggactatcatagcaattgtggtacttattaaataaaagatatggtatacaactttagcaatacatgtgagaatggaagactagatttaacggcaggtattttaggaaaatatgcattaatagcaaattcaattatcaaactgactgacaagaaacctagaataaccaataaacacaaatgaaataaaaagtatgtcaaagatgatctaagtcaggaattgtttcactgcaatgaacagaaatctactcaaactaggtcatacaaacaaaaaaaagcattggaagaatataggagtatttcatggaaacttgtgctcaagtagtatagtcaagtctaaggattctggaatgttagaacccaactcctttttggaattgaattctctcttgtttgttcctttctgcatatgtgttcattcttttgtctttctacaaccacctttctatgcaaagatatctattttttatgactactcagtgccaaggcccaataccaactgactacagtctctgcatcccttttccaaattccaaatgggcaaagcttagctcaggtatcaattattgactcaataaaccttccagaggagaaagaatgaaagtagattacagagtcaccagctactaaattagaggctaaattcatgtattaactaggggtttgatgtgggcagtttgatgtgtggactggacaggaatctcgaaattgctataaaaataatctgactcctctcaaaaacccctgacccaaattgctttataggtgaattctagcaaaggtttatggaacacagaagtcctatgttatttatactgttgggggcataaaaaggataggaagttactataaggctaacatgatctcattgttaaaattaacaaaattagctcccaaaagaaaaatatgaattaatcacacttgtgaatagagatgtcaaagtttccatgtaaacacacattcatattaacacatatgtgcatatatgcacatttatattttcatattttaaaactactaccagtgttgtatttcttatcttcttatgggtgatattacacagacactttcttcgtatcatttgaattctttactatgattgtatttttcatcagaaaaaatccacattttaaaaattaaatagcctagaaatgatcgtaaaatattaaaaatttacattaacacttatatttacttacctcactgaattggaaatgatccaataagtagtgttggaataactggccatcattttgtggaaaatgatcatcatttggggaaaaagaagttagagtgtaacctcagtgtcaatgtaaattctagatggaacaaagatttatatgtgtaaataaaactctaaatgtattacaaaaacattgtaaatatttatatcatctttgggtgggaaaggggcattgaggcttatcgctaatgatataaaccataaaagtttgaatacaaaaaagtttaacatgtaaaatatatttttttatttctctctctctctcttttttttttgagacgaagtgtcactttgtcacccaggctggagtgcagcggcgtgatctcggctcactgcattctgtctccctggttcaactgatcctcttgcctcagcctcctgagcagctgggatcacaggcatgagccactgtgcctggcctaaaatatactttttaaaaatcataatcataaagactgccattactggctgggcacggtgactcatgcctgtaatcccagcactttgggaggctgcagagggcagatcacttgaggtcaggagttcaagacaagcctggccaacatggtaaaatcctgtatctactaaaaacacaaaaaaattagctgggcatggtggtgcatgcctgtaatcccagctaccagggaggctgaggcagaagaattgcatgaacccgggagacagaggttgcagtgagccaagattgcaccattgcactccagcctgggcgaccaattgagacagagtccgtttcaaaaaaatagaaaagactgccattccttttgtcttgctatatgctcctctttcagtattctcacccattaccctaattttaattatcacctctcaaaagactgtttccaattaaaaatacacacctagtcccaacttctcttcctagcttcagtccctgctaaccaactgtatcgggatatcccactgttaccctaacctcaatacacctaaaacaaactttgatacacctaaaattaagcttatcctaatttctaaactagttccttttaactttgttatgtctctcttcatgggatctcaaaatataatcagtgactcctccttttccaaaaacctacatgtcactctactctgatggttattcttctttttaattatcttcctttcattcaatctttcctttctattcccacattaccccaaattatgcccctaattgcaaaaaatattaacactaagccagacaattaaaaagggtattttaacctcaaaattagaatctgaccccataccatacataataccaataaaaggcttggcagcacattctctaagacatatacactgtagcacagtaatttaatattaagtcattctattacagccttttaactcctgctggcctacatcacttaaaacaagaaaactaaataaaaatacgtgtcattaagatatttaatttgttgttgctgttgctattgagaagacagataggataagataaaaatggcaaaagtaaccagagtcaatagaattctcttttttttaaatagcattttttaatctctaggaaaccctaatatccaattatttaaaatatgcaacccaaaccaaataaaaatatttgagaatgaattttatgtcaaatttcaaaaacctatcgttatatcttttataatactaaaaattattttggtattaccatcacagaaatcatacaattctagaactagaagggaccttggcaattatgtagttaacatacattaaaactactaagctgggctcgatggctcacgcctgtaatcccagcaccttgggaggctgaggcgggtggattacctgagttcaggagttcaagaaaagcctggccaacatgatgaaaccccgtctctagtaaaaatacaaaaattagccgggtgtgatggcgcatgcctataatcccagctacttggaaggctgaggcaggagaatcgcttgaaccgaggaggtggaggttgcagtgagccaagatcgtgccactgcactctagcctgggcaacaagagtgaaactctgtctcaaaaaaaaaacaacaaaaaacaaaaaacaaaaactactagtgatctccaatttatcaattcacacaaataaccaaatgccttctataccctgtgcaaagcatacagaggccatgctgactgatggacatggctaatttcagtttgacaaaaataaaataggctactgctttctaataagtccaattcctattccaatcagttaaagttctagacatatgaagagtcagttgtgtttctcaaacacgttcatgccagctgaacttattttcatcacgtaatttaaattttatataaactgagaatataaaaagtaaagttttatagaaaatgaaactgaatgcttcaaaaagccttgataaaaggtgaatcaccaaaaaagtttgtctaattaactatctgtagataagacagctaaactagatgggaagaaaaaaatgtactaaaggaattctgtattcaagtttgcttcaccatggtcttgaaggttttaatcaactttaacgaataataggcaatatcagtctgcgggtgtaatttacacaggaaagtcaacttgaaattccatcagcaaaatcagcagaacaatactcatttatacattcaatacacaaggacatactgacacccaccctgtgccacgtattgagccaccagacctaactatggttttaaaaatattactctgaattccacatggaacagatgggaaaggtaggcacaaaaatggaagtggaaaacttaggaggcttttacagtaatcttgtaaaaaatgctggtggcctggatattatgatagcagtgggagggtgttatttgaatggatatgagatttaatttgaagggaaaagctctaacaattgttttaggactagatatgaagtttgagtacaaaaagaagaaagggtagctcctgggtttttgcagaactaggtgaatgttgacatttactgtgatatagagaagccatgggaggtagaggagatggagacaaaatcagcttaagatgcttattttgaatccaagtaaaaatactagataggcaaatctggaattcaagatagaggccagtgcaggtaatacacgataggaaattatcaggtattcaagtatgcaactagatgagatcacctaaagaataaatgtggataaagaagtgagcaaaagaactcagacctggaatcaagccttacatcaaaaactatcaaattaatgcacacttttctattttttttttaaatgatttcctttttcaagtaactgcaggttccaatggtgtcacataagagacgatttcttagaaactcccttttcaggctggacgcagtggtgcatgcctgtaatcccagcactttgggaggctgaggcaggcagattgcttgaagtcaggagttcaagactagcctggccaacatggtgaaactccatctctactaaaaatacaaaaattagccaggcatggtggcacacacctgtaattccactagctactcgggaggctgaggcaagagaatcaccttgaacccaggaggcagaggttgcagtgagctgaaatcatgccactacactccagcctgcgtgacaaaatgagaccctgcctcaaagaaaaaaaaaaaaaaaaacctctcttttcatgtaagtacactgactcatgtatcttcaagaagctgatctaatttggatatgtgtccctgcccaaatgtcatattgaaatgtaatccccagtgttggaggtggggcctactgggaggtgactggatcaaaagggcaggtttctcgaattatttagcatcatcccttttggtacatctttacaatggcgagttctcatgaaatctggtcatttaaaagtgtgtagcacctccccccgactctcttgcttctgcctttgctatgcaacatgcctgctccccctttgccttccaccatgattgtaaccttcctgaggctccccaaaagcagacgctgctatgcttcctgagcagcctgcagaaccatgagccaattagacctcttttctttatatataactcagtctcaggtatttccttatagcaatgcaagaacggcctactacagaagcattctagaattcctcctctctcagtctcatatctcacacccagcactccccaacacatacacacaaacacacacacacacacctctagaactcacactcatcacctttaccccttttcccacccctttaaagttgtctttcctttgtgctttcacaattgtatttgcagatttccacagaggtcctttttaacattgtatgttctaattgtcctttagtggtgtgaaagtttccttacaggcaagaaccataaccttcatctttgtatctccaatgacttgcacagtacctggtagataacaggctctcactgaatgttttcctgaatgactaaatgaagggagagagatttacccaaggtcagtcccacggccatttaataggaaagtaagaattataaagtaggtcttagtacagtcagatgttctaaacttacttcagtctgtcattcaaagaattacatattcaggcctcaccttatctatatattttatttcttatttatcatcctgtgaatacactatgctcagtcttgactaaaagttatctatatattttatttatttatcatcctgtgaatacactatgctcagtcttgactaaaagtctagttatctaaccaaaattcacttttcctcagcctgttcagaacctatgccttgagctaatttcttacctctctcataaaaaatccccctcacattccaacctgaatcatttcccccactcccctcccctcacctgctacacacacctttgttaacatcctatacaatctgatttctatccttacacctacattgaagtgttatctcaaagttcaccaaaagcctttgtaacagataaagtataattttcaaaacagtaaaattatgactctcatacaaacatgaaatgaagatctggcaaaaaatttacgtaattcattgattaaggaagaaagaaataagatgttaaaactgattcaaataagaatctgatttactatttctcaacttacaaaattcattttcatggcacaaacataatttgcattggtatgggcagaaaacatttgtactgctttcagttttctacaacttaacttttatccctttttacagagttgtgaaacagccttgtcaatcaaatacaaagatgcatatcccttaatcagaatcatataactcctggagggtcctctaaacaacatctagcattctagatatgcaataatttccttttcccacctctaagtctttgataatttttcctacataattgtcaaaactcatcctaacctgcctcctgtagtgcaaggtaaaatcactcttgccacattcagtttccataatatggcactctcctggatcctctttttacctctctggttctctttcgcctccttcaccagctcctattcatcttaaacatagtattcgctgagttttttcactgggcttttgactaacataactttttatggctgtatccaatctcatccaggcatgcttcatccattacttatacaggaattattcccatatgcacagatccaatgtctataattcccagagtgaaatttctattttctccatttctcatgttgatatcttagcagtgcttcaaattggtcaacaacctaaactcactcttttcctcacctacctatggtctatttctgtgtttcctaacttaatgtctaattgtcacagaggcacaaagtatgaggatcttacactctactttctccctcaccctcctcctctgtgaaactgtgttttccaggcagtcacctaagcttttcactgtacctctacaggcttcctcttatatcttccccttcctcatagcctttccccttgtttaagcctgtattatctttcacttgaactgttgataaagtctccaaactagtatcttgactctctcttctaacattcactcagctgctaaatttatatttccccaaacaagggcagcttttctgaactatacccacttatctgagttcttatataataggcaacaatgttgttttaggatatccacctacttcctactcattttacttcagttacttcagttcagtcaagctgattccaccagtgaagcacacttcagctaagacaatcataaactcatgatgactagttcagaaactggcccaaaagagccaatgaagtgccataagacttttgctgagacttctgggccaaaggtgtatgctttttgctgagataaatgccattgttattgctatattttgccaccagaggacagcctatttgagaagtcaaggcagaataagtgaagttcagagatgcaaagagaaatgtgatcctggtaacatcttctgagtcctggtatcaagcgatgtccaaagccagtttcccttaggttattcaattacatctaccaataaactttctttttgcttaagcctgtttgactcaggcaaccaactagcaaacaaaaaagtactaaacaacatctcctatcttttcatgcaccacatgactcagctacatcagcctcctcaccactatcagaatactgtgcctttccttaagctattctttcagtctggaatttgcttctctctgcttggaattcccttccctccatgccttgcttattaagatccactttacacttcaagtttcagtttaactgcctcagtgaaataatcaccagagactagaaagaagcagagggccagattacacaaggatttgaaaccatgctatggctttttgaactttaacctaagggtaaagaaatgtcattaaaaggttttaaagcataaatgacatgaccagatttgcaattttaaaaagatcactctacttgctgtgtagcgaatgaattagagaagggcaagggggacaatgatttgtaagctacccaaacaacctaggcaaagagaatggtgatatgggctaaagagacaatggagagggaagaatgtatttatgtaactattttatttctgaataaatcttcctctgtactataaactccctgagggcagagaaattacctgttgactatcatgctatccacagaaattagcaagtaattggcacacagtaaggactcaaatgggcaaatggaagtatcatttgtgaagacagaaaacacaggaaaactcagtttggggtttgtttgtttttgtgcaatagagaaggatgaagatgaactctgttttggacaagctgagtttgaggtaatgtcatatattcaagcaggcaaatgggtatatatgatacatacaaacacacacacacgtccggggatcaggaaagagatttgcgctgaagacactaacttgagaattctgggcatagacgagtaaatggtaacggactttatgagaggagataagattgcctagaaatatgtgaaatgaaaagagggtggagatcacagacctcaggggcatttaaaggttgaacagaaaaggagaagctaaggaagaacactaatagcgctggcaggaaagcacagaagagtcctttaataaagccaagggaagaagaggaaggtgtggtcaaatgtgtcaaacattgttaaaaaaaaataaaaaagaaaaaaagaaaaaagtcagggaatgggcagatttaaagtatcctttggataaaaatagttttggtagagtgggtgggagtgaagccggacatgccttagtttggattgggttcaagggtaagtagaatataaagaaatgaagtcagccactattagacatcttgctcaagaaattggctacaaagaaactgagatacatagttgcaggagtggaacacagttaatgctaagttctgttcctttgttgttacaggttgtgtatgttttacagaatttgatcttaagcatgtttaaatgttgattggaggcaacctaaaaagaagaaaaagtagaagaaaaggtaagaataaatataaaaaatgagcaaagtctttgaaatggagcacagaagaagaaactcgttttgaaaagagacagcagtatctcttccactgaagttgtatactagaaggaagaactagtaaggatgtaggcacatttatagatttggttactgaaaattaagagagcttacaagtcatagcttcaaatgtgtaatgaacatgttgaagtttaaattctaaaacaaatctgttcattgagaattttttttaagttatgagtttaagatagacattaacatataaattatataaagtagctgtcctatccctcaaccttagatttataagaaaaattaaaacaatatttaatgcctactatgtataagccactatgctgtggagaacacaaaaaggctctttccccagatacatgtatagcctgtttcctcttcctttaggtccctgttctcacattctgctttatttctctccattgaatttaccaccacctgatacattatttttgtcttactgtccgttttccccccactggaatagggcagcaactttttctgttttattcaatactgtatacccagcatcaataatactgcctataatggatagggacacaaaataaacttttgatttaagaggcaacttctcttcaggaaggtactatctgttaagtgagagagagattatatacagaatacatccctgctatggtctgaatgtctatgttcccccaaaattcatgttaaaacctaatcctcaatgctacagtattaagaggtggggcatttaggaagttatttggtcatatgcattgtactgtcatgagagggattagtgcctgatatagtttacatatttgtccccttcaaatcccatgttaaaacttgatctctaatactgcagatggagcctagcaagaggtatctgagtcatggggacagacaaacacaaaaaactggtaccaggaatggggtgttgctataaagatatctaaaaacataaaagcagctttaaaactaaagctgcttaggggttgcaatcctagtctctgataaaacagactttaaaccaaaaaagataaaaaaagacaaagaagggcattacacaatggtaaatggatcaatgtaacaagaagagcaaattatcttaaatatatatatgcacccaaaacaagagcacccagattcataaagcaagttctcggagacctacaaagagacttagactcccacacaataatagtgggagactttaacaccccactgtcaatattagatcaatgagacagaaaattaagaaggatattcaggacttgaactcaactccggaccaagcagacctagtagacatctacagaactctctaccccaaatcaacagaatatacattcttctcacaccacatagcacttattctaaaattgaccaataattggaagtaaaacactcctcagcaaatgcaaataacggaaatcataacaaacagtctctcagaccacagtgcaatcaaattcgaattcaggattaagaaactcactcaaaaccacacaactacatggaaactgaacaatctgctcctgagtgactactgggtaaataaagaaattaaggcagaagtaagtaagttctttgacaccaatgagaacaaagagataacataccagaatctctgggacacagctaaagcagtgttaagagggaaatttatagcactaaatgtccatatcagaaagcaagaaagatctaaaatcgacaccctaacatcacaattaaaagaactacagaagcaaaagcaaacaaattcaaaagctagcagaagacaagaaataactaagatcggagcaaaactgaaggagacagagacacgaaaaacccttcaaaaaaatcaatgaatccaggagctggttttttgaaaagattaacaaaattgatagactgctagacagactaataaataaaagagagaagaatcagatagacacaataaaaaatgataaagggatatcaccactgatccctcagaagtacaaactactatcagagaatactataaacacctctatgcaaataaactaaaaaatctagaagaaatggataaattcctggacacatacactctcccaagactaaaccaggaagaagtcacatccctgaatacaccaataacaagttctgaaattgaggcagtaattagtagcctaccaaccaaaaaaagcccaggactagatggattcacagccaaattctaccagaggtacaaagaggagctggtaccattccttctgaaattattccaaacaaaagaaaaagacggactgctccctaactcattttatatgaggccaacatcattctgataccaaaacctggcagacacaacaaaaaaagaaaatttcaggtcaatatccccaatgaacatcaatatgaaaatactcaataaaatactggcaaaccgaatctagcagcacatcaaaaagcttatccacacgatcaaggcagcttcatccctgggatgtaaggctggttcaccatatgcaaatcaataaatgtaatccatcatataaacagaaccaatgacaaaaaccacacaattatctcaatagatgcagaaaaggccttggacaaaattcaacaccgcttcatgctaaaaactctcaataaactaggtattgatggaacgttactcagaataataagagctatttatgacaaacccatagccaatatcatactgaatgggcaaaagctggaagcattcccattgaaaactggcacaaaacaaggatgccctctctcaccactcctattcaacatagtattggaaattctggccagggcaatcaggcaagagaaagaaataaagggtattcaaatagaaagaaagtcaaattgtctttgtttgcagatgacatgattgtatatttagaaaattccattgcctcagccccaaaactccttaagctgataagcaacttcagcaaagtctcgggatacaaaatcaatcagcaaaaatcacaagcattcctatacaccaataatagagagtcaagtcacgaatgaactcccattcacaactgctacaaagaaaataaaatacctaggaatccaacttacaagggatgtgaaggacctcttcaaggagaactacaaaccactgctcaaagaaataagagaggacacaaacaaatggaaaaacattccatgctcatggataggaagaatcagcatcatgaaaatggccatactgcccaaagtaattaatagattcaatgctattcccatcaagttaccattgactttcttcacagaactagaaacaactactttaaatttcatatggaaccaaaaaaagagcctgtatagccaagacaatcctaagcaaaaagaacaaagctggaagcatcatgctacctgacttcaaactatactacaaggctacagtaaccaaaatagcatggtactggtaccaaaacagatacatagaccagtggaacagaacagaggcctcagaaataacaccacacacctacaaccatctgatcttgacaaaaacaagaaatggggaaaggattccctatttaataaatggtgctgggaaaactggctagccatatgcagaaaactgaaactggaccccttccttacactgtatacaaaaattcactcaagacgaattaaagacttacatgtaaaacctaaaaccataaaaaccctagaagaaaacctaggcaataccattcaggacataggcatgggcaaagacttcatgactaaaacaccaaaagcaatggcaacaaaagccaaacttgacaaatgggatctaattaaactaaagagtttctgcacagtgaaagaaaccatcatcagagtgaacagacaacctatagaatgggagaaaatttttgcaatctatccatctgacaaaggtctaatatctaaaatctacaaggaacttaaacaaatttacaaaaaaaaaaaaacccatcaaaaagtgggtgaaggatatgaacagacacttctcaaaagacatttatgtggccaaaaaacatgaaaaaaaagctcatcatcactggtcattagagaaatgcaaatcaaaaccacaatgagataccatttcatgccagttagaacagcgattattaaaagtcaggaaacaacagatgctggagaggatgtgaagaaataggaacgcttttacactgttggtgggagtgtaaattaggtcaaccattatggaagacagtgtggtgattcctcaaggatctacaaacagaaatatcatttgacccagcaatcccattactgggtatatacccaaaggattataaatcattctactataatgacacaggcacatgtatgtttattgtggcactgttcacaatagcaaagacttggaaccaacccaaatgcccatcaatgatagactggataaagaaaatctggcacatatacactgtggaatatgaagcagccataaaaaagaatgagttcatgtcctttgcagggacatggatgaagctggaaagcatcattctcagcaaactaacataggaacagaaaaccaaacatcgcatgttctccataagtaggagttgaacaatgagaacacatggacacggggaggggaacagcacataccggggcctgccaggggttgaggggcaaggggatggagaccattaggacaaatacctaatgcatgtggggcttaaaacctagatgacaggttgatgggtgcagcaaaaccaccatggcacatgtatacctacgtaacaaacctgcaggttctgtacatgtatcccagaacttaaagtattaaaaaaaaagcaaaaactaaagctgcttacaagagcttagagaactcaaaacaaaacaaaacaaaaacaaaaaacctcatacacaagaaaaactttaaaactttttagagactggttaagaggttgtgataaaaatgctgattaaaatatagacagtaaaggccacgttcatgagatctcaaataaaatttttaaaaactaaaacaaaaaaatggccacattatatgttatgcttgttaacaaaaaacttggctacattgtatccatgcctaggactttgtaaaaggctgaacttaagagtaatgacttaagctacctggcaaaaaaaagtttctaaacaacaaagcgttcaaaaggtgacatggctgcttctaacagcctactatcagatatgggagttcaaaaaaaagacaaagttaaagctaataattaagagaaaaacagagcatacaaatttgaaaaatttacaacctaaccatgtggtagagggaagttttcaggagagaaatccaaactacctagccccaggtaccaggccctgacagaacaggttgttaaagcaattaacatgaataaaagagagccagttgttaacagtcaagacaatggggaaaagcccccaagacattccagaaatcaaggctaccccttccatcacaggctcagaggcctcctcgggcaaaatggtttgggaggccaggcccagggtgttgctgccttgtgcggtcttgagatgctactccccacgttctggctgctctggctgcagccagggctcaaaaggccccaggtactgtctggactgccactccagtgggtgcaaaccataggccttgatggtttccaagtggtgttaagtctgcaggtatacagaatacaagatccatggaggtttggcagcttccacctagatttcacaagatatgtcaagaagtctggctgtccaggcagaagcctgccacagcagagctcctacagagagattctactaggctggtgccaaggggaaatatggggttacagtccccacagagaactcactgtagagcagcgggaacaggggcactgccctccaggacccacagtggtggcagtctaactaaagccaagagaagaagagaaaggtgtggtcaaatgtgttaaatactgttaagaaaaagaaaaagaaagaaacaaagaaagaaagaaaaagaaagaaaggaaaagaaaagagaaaagaaaaaaagaaaaggaaaagaaaagtcagggagtggaaagattaaaagtatcctttggatgtaaacagcatacaccctcagcctggaaaagtgacagacattagactccaatccatgagagcagccatgtgggctatgcccaaccaagccatagagatgcagctgcccaaggttttgagagctcacctcttggaccagtgtgctcaggatgtgggagggagtggaaagtgaggaagtggaaagattaaaagaatcctttggatgaaaacagcacacaccctcagcctggagaagtgacagacattagactccaatccatgaaagaagccatgtggtctgtgcccaaccaagccatagagatggggctgcccaaggcttcaagagcccacctcttggaccagtgtgctcagttatgggacaagagtcaagcgagattattttacagctttaagatttaatgtctgcccttgtaggtttcagacttgggtgggtccctttttgttggtcaatttgtcccttttaaaatgaaaatatttacccaatgtctgttccaccattgtatcttaaaagtagataacttgtttttgatcttacaggttcatagctataaggaatctgccttgagtctcggataagattttagactttgagttgatgttgaaactagttaagatttctggggactttgaaagagatgattatatcttacaatagaaaaaagagggtgggcatggtggcttacacctataatcccagcactttcagaggctgaggcaggagaattgctttagcccgggagtatgagacagcttagtgagatctcacctctacaagtaataaaaaaaattacctggccatggtaatgcatgcctgtggtcccagctacttgggaggctgaggtgggacaactgcttgagcccaggtggttgaggctacagtgagccatgatcacgcctctgcactccagcctgggcaacagagtgataccccgtctcaaaaataaaaataaaaataataaataaataagacaagatatttggggggctagaagtggagtgatatagtttagatatttgtccttttcaaatctcatgttaaaatgttatccccaatgttggaggtgagaggtgtttggaacatgagataagatccctcatgaatggcttggtgctatcacgtaatgagtgacttctcactctattaattaacagaacaattaattattaaaaagagactggtatccctcccctctctctctcgccatgtgatatgtcagctccacttccccttccatcatgattaaaagctttctgaggtcctcaccagaaccagaggctgaagccatgcttctagtaaagcctgcaaaactatgaaccaagtaaacctcttttctttataaattacccaccctcaggtatccctttataataacacaaacagactaagggagtgctcttataaaaagggctgcaggaacttgtttaccccttctgccatgtgaggagacagagaaagcatcgtctattcagcagagacactgaatctgctggtgccttgattctggacatcttccaaaactgtgagaaataaattcctgttgtttataaactacctagtctaaaggtattttgttatagcagctcaaacaaactattaataaaacaatactaacattcacaaatgagggcagcaaatgctaagagtgatgtgaggagcaacagcaaaaagtggtgcaagagttcagaatactgctaatcatcccagacaagcacagagttgtacaatcatccatcaccttctagaacagtttcatcatctcaaaaagaaaccttgtgccccttagctatcacctcccaactccctagcttccccagtcctaaggagccactagtctgcttcctctctctatacatttgcccactgtggacattccatataaacagaatcatataacacatggaattttgtgactggcttctttcgtttagtttgtttttaaggttcattcatacatgtagcgtatatcagtacttcattcctttttatggccaaataatattccattatatggatataccatattttgtttacccattcatcaactgatggccatttgggttgttcccaccttttggctattatgaataatgcttctgtgaatgttagtgtataagtttttgtataggataatttttctaagagatgcaaattttcataaagcttgtaaatttacccaaatcaaaaacatgttattctgagacaatgtccttcaaattttttgttgttgttgtttgtttgtttgttttttaagagatagggtctctctgtgtacccaggctggagtgcagtagcccattcatagctcattgcagcttccaactcctgggctcaagtgattctcctgcctcagcctcctgagtagctgggattgcaggcatgagacattgagctctgccaaactttttttttttaaatataaaacatcctttttaaatgaaaggatggcaatatcaaaaagtggttttgttaatgtgcttattaggtagaatactatttaaaattttgcttttctgttaaatccaaaagtctaaaaagtgttgaccgaagaaaatacaagatagcttctaaagaaaactaagagggttttccccctggagttgaaatcacatattgtaaacagcagaaaatgaaatacataagccaaaaggtagatcttgccaggctaaggaatttgggcattatcccatagtcaataagtaaattaataaagctgtttaaatataaaattattgactccaagatatcactatattcaacaaacaataattgagctactactatataaaaagcactgaatttggtactatgagtgattccaaaaagacttttgcctctgacactaccaaaaccactccagataaaattccaaatgacctaaaattgctaaatccaatttttatttttcagttctcctcttgacctatcggtagcatctgacgtaagtaaaacactcttccttgaaatattttccttctttcttttttttctttttctttttttttttgagacagagtctggctctgttgcccaggctggagtgcagtggcacgatctcgcctcactgcaacctctgcctcctgggttcaatcgattctcctgcctcagcctcctcgagtagctgggattacaggcatgtgccatacgcctatctaatttttttgtgttttttactagagacggggttttgccatattggccaggctggtctcaaactccgggcctcaagtgatctgcctgcctcagcctcccaaagtgctgggattacatgcctgaccaaaatactttctttacttggcttctaagacaccatactcttctgggttttcttcttacattactagtggctccttcgcagtctcatatgctggttctttcacagctccacaatttataaacattaagagtattcaaggttcagcccttgcaccatttgcatctcttgtctatctcattttattaatgctgtcagtctcacggctccactagaatgtagctccaacagggtgagaattgggggctgttttgtttatactggatctctagcacctaaaacagtgcctggcatatagtaggtgcttgacaaatatttgttcaataaatggttggatgaataaatggctttatatattatctataaactaatgaattctccaatttatacttcctgcctggatctctgtcttgagctccagatacatccaactgcctatttgctatctccatttgaatgtgtaaaatacatctcaaacttaatgacttaatgaaagagaactccaatcaccctcccaatggcttctccagctggcttcactttcttagcaaagtgtagccccatccttccagtttctcaagccaaaaattttctcaaacagtaactaaactgctactatataaaaagcactgaattttggtgctttttatatagcaccaaactataagtccttttttttttttcttgcgacagagtactctgtcactcaggctggagtgcagtggcacgatctcagctcactgcaacctccgtctcctaggttcatgcgattctcgtgcctcagcctcctgagtggctgagataacaggcatgcgccaccatgctcacctaatttttatattttcagtattaatagagacagggttttgccacgatggccaggctggtctcgaactcctggcctcagcctcccaaagtgctgggattacagggatgagccaccgcgcccagcctaactccttttctttctctctcactacatatccaatctgccaacaaataccctgtattttgccttcagaatataaccagcatctgtttatttctcaccacgtccacgattattactatgattcaagccgttatcatctctcacctggatgaatgccaacagcttcttaattggacttcctgcttcttgtccacctccactccccaattcagaaccacaagcagaaaaattcttttccaaacttatgtcagatcacattacttctctgctcataatcctgcagttattcccatttcactaagtaaaaacccaaatcttgaaaactgcttataaggctctcttcaatctggccctaagtcaactctgacctcatcgtctactatttttccctcacttattctgctccagacatactggattcttctgctgttccttccaaaggtcaagcatatttctgccttttcccttactcttccctttgcctggaatggtcttcccttagatatctgcatcccaccacctccttcaggtctgctcaagtgtcaccttctctgtgacttttcccccgatcatacttaaaattgcaaccccatccctacccttgtattctttatccctttactctgctctatttttttccacaatacttatcaccacctaaaatactacatattttactttctgcttgaagacatgactttctgtctttcactcactgctatatccctagcatttaaatcagtgcctggcacatgctaagtgatcaagagtctatctgttgagctatgcttttatttccaccagggggcctaacaatcatgtagcctggtgtttcaggaaaagatcataaagcatctctaagatttctttcagtgctctgatccctagaaggactacaacttgcctagaaagaaaaactgtgctttgtctcggcaaccacaaggaggagttgagaaaaagaaccgagcagagaaaccagataatgctgtttcccttgcttttcccacagtaacctcaaggtggaagaacactggatctggagcctgctgtactgaatgaatgatttttctccatactatgagttacctagacacaaacgtaaacaggaaacatcacaatccttccgaatgccacaaaaaggccaagggaatccatatacaatggccactaaggacaggaaaggtgtttctttaactccagcactaagaattctccacaaattcaggggaggagctccagttagcacagaaagacacataactcactgatgaagaccgagtgtttcaggtcgtcagtactctttggccagagaagtattaagtcaattctatttaatacttagggcacctaaaattcgtaagcggtataagcaagacagtcccacgtctaaattcacagatttggcggatcgcatggaattcattaacatcagactcattaaacacccaaatccatttcccacgggcttgtgactcaccgccacctgttgatgcccacattggaggagccggcgaaccaggggtccaggatgtagacgcagcggatggtgtcggcgccctgaatgcactccttcagggcggggttgtcgtggagccggagcccctttcggaaccagtgcacggcgttcacccccatgccggggggcgcggcgggtcctccacggagaaattcaaggaaggaggctccggctcatagccgacaccttcgcttccaagagaattgcctcacccggggcgtgaggaaagggcggcagagggggaacaggaaaaaatgactccgaggaggggaccggagaaggcgggggcgccggaggcgcagtggaaagatgaatggaggttgcctagtcggcggagtccgggtgtgacgccctttaggagcccgcgcccgccgcaaccgcctggaggcgacgcataacttcgagggcctcggacctccggagcctgagcaagttccaggagctcgagccgccacgacggcccgagccggcacggacggccccaggagattcgtcacggaaacctcgccccaccaaggcggcccctaaagacaaaacggcccgcccgaggtgagtcaccgaggagaaccggaggggaatgagcccctgtcggcgacgctgtctctcggcccgggagaaaggaccgggaacggaggctagaggcggtggtcgaggccgctggacggttgccggccggtgaccggtcccgaggctgcccgggtgactctgccgccgccgccgcgtcagcggcctcggccccgcccccggctcctcattggagggcgcgctcccctcgtgaccaccggcacctcacgtttctgaagtgtgtttactacactggctcggaggggtaatctgctcgcgcttcggtcgcttttggaggagcggcagccgcttgatcccaaacttgttgaccctcgtccacacgctgaactcactgcctctgcccctttcctgtgccgactggtggccgtcccttggaagcaaatcgcgttgaccacaggccccttgtgagggaaggcttagccccgccccc

SEQ ID NO: 2392 - DNA, 468068 bp, Homo sapiens
cctcggtggcggcggcggcggccggctccaggccgggttttggcgccgcccgcctgctgcctcctggcggctcctgaactccagccccctctctatcagccgctcactccgtctcaatatgtctcaagatggcggccaatgtgggatcgatgtttcaatattggaagcgctttgatttacagcagctgcaggtcaggctcctccgcgctcggcctcgcgcccgggggtgggggctgcgggcggtcgcggcctccgccgggggccccgggctggcccagccgccggggggcccgcggcggcggggaggaggggggtgccgggcaccgcggggccgagtcggggccgagtccctcccgctccccggcccccattgatcactcgcttgatcggaaattgatcctctttgttcaattcatcgatcagcccaagatggcgccgggagccgccgccgccaccactgcccccggtgtctgcccccaccccgggcgcccccccgggccccgcgccgccgccgccgccagcgccgccgccgccgttgccgccgcgggaccggggagggggcggccccggcggcccgcggggtgcgcgcgcgagcggggagcggggagcgggcggcggggggcgggcggcggcgggcgccgggagggggccgcggcccggcggtggcgcccgcccgcccgctcgccccgcgcccccggcccgccgtattcccggggaaagtttgtggggagttgctgcggggggtgaagcgcctgcctctccaggaggagccgccgccactgccgccggcgcggcggagctggggctggtggcgctgtggtgccgccggctcgggggagggtcagagcggccaccggcggcggcggcggcggcgcggcccggctccggccaggcgggcgggtggccgggcaggcgcccgcgctcgctacccccggccggccccggccgccgcccccggctgtcaccggcccgggccgcgccgccgctccggcaccccgcgtgtggctcccggcgcggacccccgggtttgtttacgtcccggggagcgccccggggccacccgcgcacctcgcggccgccgcgctcttttgtgtgcctgtgtcggtgacgcggacctgttcctccgtggcggacccccgcgggggctctttggggaaacttggcgaggggcggcgggggtgccccgcgcgcagtgtcgctgggtcccggtgtcccggaccgccgggtgcgggcgcgggaggaggaggctgcaactttcccctaggcaggccccaagctgttcccccgggtgcccgggcagtgtacgctgcctccccgccgccggtccgagccgcgatcgccgcgcgcctgggggctccggcggcccccggtgacctgcggcgccgggtcccttccttgcgtcccctcggggcttctgccctctctgcagggcccgccatggagcgcgcggcgggtgcgctcggagatgccttctcgggccgggttctcgaaagcagagccccgggggcccgttgggaccgtggcatgccgggcggtggtccgcgcgcggagtccccggcgccgcggggggaccgtgccggggctccccggcccgcgcccgagtcgccgccgtgcccaaggggcgagtgcctgcctgccaccccccgcccggaggagcggcgcacccttagggtccgccccgcacgtgccagctcggcgcccgcggcgccgggacagccccgggactctgccaggtggatgttgtgcgtagccggagccaggttgaaggtgagcggcgtgtgggccagaagtcccgaggttgcaggcgcggagggaaccggggatgtcggggggtgcccgggtcccgcggcttagaatgctctagggcggcctggtgctctgggaggggataggagggttcctcagggcccctggggaactgcagctactcccaactgctaaggtgtgcgtgaagataaacttggctgaactttcctaacctggaggactggtgacagtgacctaccgcaatacctttgggagcaaagctcgagatgcaggcttgtatcaaacgaagcgggttggattaaaacatatttaaatggaatctgacaactttaattgtatatgcttgttttctgctcttgcctactaagaacgataaagccgagtcatagtcgttatgaaatttcctgaaatttctcgcttaactaggaagaagactatgcgaaatatgtatttccgataagattaaaacttaaaggagtttaagtatttattgactaaaatagattactccaaagtgtctattgtgtaaattagattcctggatgtaatgaacacagccgaatggcatttttgataaattggtctaccctgttttagtaaaaatagctcccttttaccataatttaattcctgtgcttactgtaaaacccgttgtggagttttaaggacaaacattattattatttttctctcttgtcttcctaaatgtgacatcctagcttaatatcaatgaagtgtcttttttaaagcatcctggcaaaattgcctggaaaatggatttggtttctagagttactagattttaagaactctaaaccttcctgtcccccatattagctacttcttcaggggatcagggctccagggttccatcgaaagtttccatgtcagtttacttgcactttatgtggatattaagaagaaatcaaaaccaaaccccaaaacaaagtcccttatttgaacttcattcctctttactcctttgcttttggtggttgctaacgatttggccttagatgatttcctatgggtttgcaaactttagtcgaatacggaatgtcaaagttcaagtctcaggccaatctggttctttctctgggcggtgaggaggcctttggagttggtgtctggttaattcccaccgatagtcagtgagtcaatagaacgagtttgggagagaattcattagttccagatttttctcatttttccagacctctttatactgagattgggttgccacctgggggtaaagaggctgatcggtctttgcagagagaaatccaggttggagacgtcagcgggtccaggtgaggttgggccgttccgcagttctgcaaccctggctcactgggttcttgtccctcggcttcctgggtcttgaagctgctgccttggcacaggagtgtgtgctcaggaagagaatttctgaagattgtgttttattccgtttcctttttagtcccaaaggcttgtggtatggaagtttcagtgctttggtattgctaagactagttggacaagttttttatcctatctcagacttgtaaaaaccaggttttcttttctttttaaataagaaaagcactgttgtataaatttgtcttttaaatacatatttgaaaggaggacactttctaagacaaagctcatggcactctgtatgttagtggagctttgaactctttgggacggggcccgccaatgactgccttccctttgggacattattcccacatggtgaccagccttcccctttaagcagcttctgcaaaagtaaacttgaaaagttgccttctttttcagaatcaaaaaacaatttcagttttgctgaaagtccattttctgatggctttttttccccctgttgtggaagtgtgtatgttactggctgtccagtactgtttgccataataagtatattattttaattaaaatgtcccatctagtaccctttataaaagagcagttcaagaaattacaccactgctgctcctgcttttgttttcttggttcttttaatatgggtgtctttgaggttggatgtgggaaggggtcattggcagttgatttaagttttttcctatgtgaaactctttttttccttaaaggtgcaagtggtgagttaatgcaacaactcctggtacagttgagtccacagagagccctttgactacatcctcggcttcgtgtatcttctgtcggtagttagccaacctaagaaagctgaaagggccaaatagtccaataccttcaggaatgattctctcctaaatccactgagctaaccttaaaaatgcagtctggtgaactgtgctgagcctgaaacctttaatggctatttaaaaagtctcctgtttttgtacaattaagacaaacccatcagggtttatatgggagctgtgaaggaacagtagtttgtgctctctgattcccttctgggtctacctgtagcagtaaacaatcaaaaccactcctgaggctgtactcactttctgtgtcttaggagagaacacaagactagaagtagaaaatccacatttgtttcagctcctctgtaatgccccaggaacgtctgtttttagtgaaatgaaggaaggacacgtttgttaggggaaaactcatacatttcgtaagcagagaaattcatcatatgaagaatcctacagaggtaggttaaattcctacccgtgcttccatttcaaatagtttacacatttgtcacatgtaaatttcacagacaggtatatctgacgaattgtaacacaaatggtatgtaaaaggcaactctaaccattattcaaatatacaggatccaggatcgtgagttattgtagaaattacttaagacctatttaaaattattgaatacataactttaaaaaatgtaattgctctatgaaaagtgacttttattataattgtcaaagacagaaatttgtctgtcttgtccttttgttttgtctgaagccccgcgttatcgctgcagagagagagttttggtttccaccgaaatttccctgcctccgattgtttaaaccagacccttaatcttattttaacatatttaaaatgttcacaaaacccggaagaattgttttgtgtaagtagcaagcgagtgtagcttaaacactcaagcaattctggtatctaattggaaacaggtggaattcttggaatcccatgtttgagtctttttatagcaaagcccagggacacttttcacttatagccattcgttttgtcgaagctatttgaagaggggccccacagcctctccttatgtcccactgttgcttacctggacaaagcagtcgtgctgggcgctttaggaactggatacctgtgaatgcctggatgccgagagaagtgtgtgtgtgtgccgataatggagtgaaaaaggaatctaatggtatagttagacaagcaatttaatatctgcattgttatatgactttagagcaaagaatttgtgaattcatttgtgatttctgacttgatgaaccttgactgaccagagcatgtaggtacattttattataccccaataatgatatagaattcagagagaagatactcccccccgcccccaaaaaaattctacatttagagaatataagctccaccagcaaccataaaagtattaacttggtgagggggatattttctttctttttttttttttttgagacagagtctcgctctttcgcccaggccggagtgcagaggcactatctcagctcactgcaaactccgcctcccgggttcacaccattctcctgcctcagcctcccgagtagctgggactacaggcgctggccaccaggcctggctaattttttgtatttttagtagagacggggtttcaccgtgttagcccggatggtctcgatctcctcacttagtgatccgcccgccttggcctcccgaagtgctgggattacaggcgtgagccaccgtgcccggcccctattttcttttcttttctttttttcttttttcttttttttttttttttttttttttttgagacgtggttctgtcgcccaggctggagtgcagtggtgcgatctcggctcactgcaagctccgcctccagggttcaggccattctccttccttagtctcccgagtagctgggacgataggcgcccgccaccatgcctggctagtttttttgtttttttgtttttttttttttttgagatgtagtctggttctgtggcccaggctggagtgcagtggcgcgatctcggctcactgcaagctgagcctcccgggttcacgccattctcctgcctcagcctccggagtagctgggactacaggcgcccgccaccacgcccggctaattttttctatttttagttgagacgaggtttcactgtgttagccaggatggtctcgatctcctgacctcgtgatctgcccgcctcggcctcccaaagtgctgggattacaggcgtgagccaccgtgcccggccgatgttttcttaaatattaatggcagggccctctggattgactgtgttatttgacccattccagttttcaaggcgtggtcttgaaaagctgtcgatcaccctggttttgggatgtgtttcagaaccaagtttcgatggtgtgtcagtgttggattttcctgctgaggacagctaaggtttggtatggagcagttttggatttgctgagctgtaatcagtccagcttctctgctgtcttctgagaaggttgatggaggagagtggtctttggcggggatggaggtttccctgcaggaaatgaaccaggactgaggggaacctgtgccgttcccctcatttgtcctgcgcctgaaacagctttgaagcacctggcttgtgacttaaaagatttttaaaaagcatttgtgctgccctattcgggtattacacagtgagggtgaaccattcttttcgaaagacgtctaaggccgggcacggtggctcatgcctgtaatcccagcactttgggaggccaaggcaggcagatcacttgaggtcagaagttcgagaccagcctggccaacatggcaaaacctcatctctactaaaaatacaaaaattagcctggcgtggtggcgcatatccataatcccagatactcggcaggctgaggcatgagaattgcttgagcccaggaggtggaggttgcagtgagctgagatcgtgtgactgctctgcatgcagcctgggtgacagagcgagactctgtctcagaaaaaaaaaaaaaaaagacatctaatttgttgtaaaacctgtcaagaaccttccctttaaaaagctaatgcctctctaataaaaataattttaattttgttgtaattaaattcagagaggatgatgttagtgcacaaaataaagattgtcaatttctttattttaatccaacggcatttcctaactgcaggaggcccaggaccgttggcagaaattttgtgttgattagagcctcgggccatgggaagtgcaggtactgtggccacaaagttcgtcgcccaatccctggctgaccccacaagcaggactggtacagatcccaccctcaggggtcttcctacacagagaaacataatcacacaggtgactggaacggagccaaggatggtggtgttcctcctagggatttactaacactgccagcaactcaagaactagccagccgggagtttcctagtaagtgaaactgacttggttctgcttcctttcatgaaaacctttgtgaaaatgagcccaataaggggtccgaacctttataaagcacacgaccccccagagtggaccgggccctggccgactccatcagccgaagcttgagatcttggatggtctggatggtcttgaccgtgtgtgattgatgcagttaacaaagcaggaaattaacagagcttactctgagacaccagggaagtggcttgttctttcttggggttactttgagtggatgctggcacactgcttgttttcttatagatacctttctattgggctgtgtttattcaataaggaaatgcagttaacatttttttaacaagtaaaccatgggttatgaggtgttccgagtttggttaagggaaaaacaaattgacaaattagctctttcttaagtgagtattgcgaaacagtgagaaatagaatgcctgtcgtaccgtcattaaaaatttatctgggtgttgacagctttttgttaaatgtaagacattcagatcctgtccacccagcatatgaaaaaaccaaaccaaaccaaaccgaaaaacaaaatgcaacacaaaagcttctttccatttccccccaaaagcaagacaatttttcttaaactggggctttctccctaatgaattgccatgattttgttttctctaacatagtttaatatctttaagacagaacgaatatcaactctttttattttattttttgagacggagtctcactctgtcgcccagcctggagtgcagtggcacaaactccgctcaccgcaacctccacctcccaggttcaagtgattctcgtgcctcagcccccccgagtagctgtgattacaggtgtgcaccaccacgcccagctaatttttgtgtttttagtagagacagggtttcaccatgttggccaggctggtttcaaactcctgacctcaagcaatccacccccttcggcctcccaaagtggtgggattacaggtgtgagccgccgtgcctggcctccactctttttagacacctttgttgagttgttgttttgggcctgtaagtttctctggcttattaccactttcccctcctgtttctagggaagaaatgattatttagataaaaaataatttgataaaaggtagcagatgataccaaaggtaaatctttgtcttgaagagcctgaagctgtgagcattggtaaagccgtgggctgcagtgagggaagggccggcttggagccgccctcagcctagcctccgggtgttacctggagcccttgctgtcaggacggcctgtcacttctcgcccttctcctgccctgccaagcctgtcccttcctgtgttgtgacaacttttttttttaaacaagtatttctacagctccattattttgagattcttggaagaaagatactatgtaaatgaaaattaaaaataaaattctcgctggagggaatcgtatacatgtaacgtttttgatgaggtttggaaaagactttcgttctccctctggaactgggaacattctgtggctcccgtcaccatttctgtgtcactctgaaaggtgtggcagataatggtgaaacatattattttctgtttttcaccaagtagttgacccagaacttgaacccatgcagtcctgggtccagtgaattatttctgctgcatacagttctgctgtgtcctcgccgagagcgtagtcagcaaccgcccggagaataccaacctttcaaaagaaaaagggctggagtccccaacatacagagattacagctaaaattacgaccagagctgttaatcaaatcccatcttcccttcctattcacacagtagagatgttataagtcatacaggtttgagacagaaaattgagagcagaggagcatgtgtttaaaccagcatagaaacattcatttaccagaattgctttatttcagccgtatctcaactcgttgcttacacagtaacgcatgctgtctcgtcactcagccaagtgggagacaagttcaggtttctgctccatgggatccaggagcctgcagtcaccgatgagcctggaggaccacaaggtggccagggcccttggagagctgtgctgcggaatcgtaaagctaccatccggagctggccgtcccagagggaaggcttggtcatctcttcccctccacctggtcctcagccctggtcccgcagtttgtcatcccgcagtttgtcagcatcgatgtgggactgggagaggaaggatattgccagttatggttgaatgtcattgtcaggggagtaagaagtagtttgtgattgttttacgtggctctgtgttggtatataattatgctgtcatcttaaaacgccctgataccttaatgaaatctgtgtgtgtgtgtgtgtgtgtgtgtgtgtgtgtgtgtgtgtgtgtgcgcgcgcgcgcgcagttagtcttcggggctgcttattgtgtgtgagagccaagtctttctaacacacgagctgagtgcgtcgtcttttacttgtttcaaaactgcccattcgaaacaggtcgcaatccattataaatgcagctgccagattaatcttcccgaaccattgatttcatcatgccattcctctccttaaacatccatggtggcccacttaggcacagagtggagaccacatttcttagggtagcagacagagttcctgatagtcctttctgccccacctaaaccttttccatcccagctagaatgactccagaatcttgcttatttgggggagctccctcctcctccctctgtacatctgagcttcaagcctacttcagaatttttttgtttttttttgtttttgattttttgaggcagggtcttgctctgttgccggctggagtgcagtggtgagatcatagttcactgaagccttgacctcccgggctcaagcaatccttccacctcagcctcccgggtagctgggactataggcatgcaccaccacgcctggctgatttttccatttttttttttagagacagggttttgccctgttccccaggctggtcttgagctcctgggctccagtaatcctccctccttggtctcctaaagtactgggattatagaggtgaaccactgcgcccggccttcaagcctatttcatgcattcctttttcttttgcccctgtgtgcccggcagtagtgatggagacttaaaatagcagtggcttcccgcctagagggcggacaggactggcaggacgaggctgggatggatggagcagtgtgtctgagcctctgggaaggctgcaggaagggcttggaaggcgggtcggggagtgggcagggggcgcccactgagttctgtgtgcttggggaggtgtgggagacagggctttccagcagaacagtcgtggggtggccggggatctctagggctcccctctgagcttgggttccctccctctgccctgattatcccttgggtacccaccacaccatcgccacacaggcccccactctctgccttgtgtgtccgatttaggactcattcagctggttaagaatgcaaaattaattcttttttttaatatagtgaaagcaggtagattatattaaaatggctgtgttttgaaagctactgataggtacacctatggaatagatgtttctttttcagtcccattaattatctttctgtgcaaagtaacataagtgttactttttcagtcccattaattatctttctttgcaaagtaacataagtgttggttaaaatacagttgacccttgaacaacatggggattaggggctgatcccttctgctgttccccctaccccacctgcacagtcaaaaatccacgtataactttttttctcccctcccctccttctcttctcttctcttctcttctcttctcttctcttctcttctcttcttttcttttcttttcctttcccttccttttcagacggggtctcattctgtcacccaggttagagtgcagtgacataatcatagctgactgcagcctggacatccggggctcaagcagtcctcccacatcagcctcccagtagctggaactacagacactcaccagcatgcctggctaatttttaatttttttctttttttagagacagggtcttgctttgttgcccaggctggtcttgagctcctgggttcaagtaatcttcctgtcccagcctcctaaagagctgagattataggcatgagccaccaggcccacataaaacttttcattccccaaaaacttaattactaatagcctaccgctgatgggaagccttaccgataacataaacagttgcttaacatgtattttgtatgttaatatgtgtgatatactgtattcttagaatgaagtaagctaaagaaaatgttattaagaaagttgtaaggaagagagaatatatttactaatcagaatatagaatggatcatcataaaggtcctcattctctttgccttcatgttgaggagtctgaggaggaagaggaggcgttggtcttgttgtttcaaggtggtggagatggaagggctggagcaggtggagggggagtcgggagaagcaggcccaattggtataacttgttttttttttttttttttttgagatgggagttttaccctgtcacccaggctggagtgcggtggcggatctcgactcactgcaaccttcgcctcccaggttcaagtgattctcctgcctcagcctcctgagtagctgggactacaggcacccactactacacccagctaatttttatagtagagatgggtttcaccgtgttggccaggttggtctcagaattcctgacctcagatgatctgtccgcttcggcctcccaaagtgctgggatgacgggtgggagccaccatacccagccccactcaatgtcacttttattatggaaaaaaaaaaatctgcgtgtaagtggccccacacagttcaaacctgtgttgttcaagagtcagctatatgtataattgtacctgtggcacatagaacacaaaaagatccacatttttaaaaacagcattgggcagaacaattttttgacagaggtctgtttgactctgctgacagcctgagtgggaggaaacttccccatatgaacgaacggggaaagtgcatgttgtagttctcaaaacccaaaaaaatctaagagaaacccagcagcaagaaacacagaggtttgggtgtcagcatcggaggaatgtctcacgtctgccttgtcccccagaccccgtccctgtgtctgggcaaaggcacgccccgctccaggtcggccccatttcagagcagtggccctcataggctttgtgcctcttcatttagtctaagaaactacctaggatatttttgtagaggtgacatcactgtctggctgcagaagcatttgcttggatttggggaagtgagggctgggagaggagggcttagagaggcaggatgcccaggcccattgcgggtggctgatggggggtgggcttagcatctgcagggacagggtggagggagaggagccaccccaggcagggggaaggggtgtgccccctttgggatatggaggttttggggggctggtgggagggaattccaggggtcgagcccctggggaaaaggaggctttaaggtcagtggaaaagtgggtgccaaagtctggaagatgagttgaaacctggagtttgaagcccggggaggattttgttggagtgttggctggtgctggagagttttgcatcacttggggtggggtggggtgaagaattaacttgaactggcacagcacccctttgtcttgactttccctgttctggagtgaggacggcttgatgtttcagcaaaaggagtagtggagagggagaatatttgcttgtaggattgggttccacataccatatctacagttttacatccactggtgacaagacaggagcttttctatttttgttttgtatttttatgtttttgtgcactaacagtaatggtttcatgggaacagatggcggacggacacgggcttaggctcttggtttatttcatgttacttgcatgacagccctatggagctgcgtacctgccataggtgagaagccgggagttggggttacatcccggactttgctgagctccaggagtgtttttcctcccgacctgcgctgttccctagacaaccctcagccgaagcagtggggtcatcgggtgactcagaagggacctcttctcaggggccgcccaagatgagcttggctgggtctgggtcacttagcagtgagcagcaggggatggaaatggggccggggtgggtgggcttgaggggagcactttctcagggacgcctggctggagccttgccctggcaagacttcaaactcagccccgcagagaagggtcatctgatgatagaatcacggctgccccatcattcccattagcaaacttcatctgatagttggggtacggttgtggctcaggctgtaaggagcccccctgttgcattactcactatcctcagatgccccatccttgcctgaagcaagtttgttgggacagttttggggaactgttaggagagaggcctggtcatggggccggaggggcccagaggagcggcctgccctatctgtgggcggttcggtgagtgctagatggggtgtctctttacaagactttcctctgagatgctggggctatgcccctgggtgctggggagtgaattgcccgtagatactgatacctgtacttaaccctgtgacggtcaagaccagatccccactctccaagcccctgggaaactggttgatgtagcccctgcagtgataccgcactcaaatccatgcagatcccctgacatggtcggggcagcacccaccacgcaggcttctgttctgagctacatgggatgttgggcgtgtgttttctaagagactgatttcataagacatgtaccagtggccgactggcctgaaacagcctggtcacagcgacatccctgagatcttagcttcttttcctcggggaattatcattggactggaaaactgaggttttgggccactctggattcagatgcttttgttgttgttgttttgagacagggtcttgatctgttgtggactgcagtggtgggatcatagctctctgcaaccgcgaactcccaggctcaagtgatcctcctgcctcagcctcctttgtagctgggaccacaggtgtgccccaccatgcctggctaattttttttacatatttttatacaaacagggtcttagtatgttggccaggctggtctcaaactcctaggctcaagtgatcctcctgcctcagcctcccaaagtgccgggattatataagcgtgagccaccacgcctggcccagataactcttgcctgcctgatttttttataatgatgcactttgttttgttaaaaatttataaatttaaagacaaaatatgcaaaaatgtgccctggtctcagaaataacacagcacattcgagtgaagttgttggcagttccgtgtgttttggggtgattcatttttttcataggttgttggggccgtgcatccattcgtgttctgagcacactccatggtacctgatgactcgaatggatcctgttcaagcccctgggttacccaaagaaatatacttctggcctgctggttggtcagagaatgcaggacacattggggtatcgcgaggtgtccaatggcagcgggttgggtgtgtctgctgtgtgaacagggcaggggtttgggaagatggactctggctgtcttgctccaaagacttccttaggctgttgttgagcatttattgagtgtctcctgtgtgccgggcagcattctagcatagggattgagtgaccagacagtagggaatccttgcccttaaggaactgacattcttttttttttttcgagatggagtcttgctttgtcgtccaggctaaagtgcagtggtgcaatctcggctcactgcaacctctgcttcctgggttcaagtgattctcctgtctcagcctcctgaatggttgggattacaggtgtgcaccaccacgccgggctaattttctgtatttttagtagaggcggggttttgccatgttggcctggctggtctcgaactcctgacctcaggtgatccacccacgtcagcctcccaaagtgctgggattacagccgtgagccaccatgcctggccggaactgacattcttgcaagggggatggaagacaaaggcaaggaataagtgagtgcccagtggcctgggaacagacggagcaggactgatacacaaagccccacagagtcacttctgtcttctgaaggccctgagaaataactttattattattattattattatttagagacagagtctcgctctgtcgcccaggctccagtacagtggtgtgattatagctcactgcagctttgacctcccgggctcaagctatcctcccacctcaggttcccgagtagctggaattacaggcatgcgccaccatgccaggctaacttttttgtattttttgtagagatgggggggtctcactgtgttgcccaggctggtcttgaactcctggcctcaggcgatcctcctgccttagcctccgaaagtgctgggattccaggcctgagctgccatgcctagccccgatttttaaactgaagagggatggttcagttgttggggtgtgtcttagaggatccttctggaagccccacatggaaggcgggctagagtgaggagggaggggtgataatggaaccaggagggtgtggtggtcatggcccagtgagaggatgccaggctgtggccgtgccagactcagtgtgcctggccctggcatttcaggcagggaccactgaggggtgatgggagagatggggctgggtgagtggcatttccacaggcatccagaggggtgcgaaaaactgaggttggggaacagcaggggcagggaacagcctgtggagggtgtggtcatcagtgtcccccaccgacatggcacatccagcgagcccactgtgtccccagcacctgcggtgcagggggctggcaccttcaggggcgggcttcgtgcagacgtccacccagtcagtccccacaggtttatcaaacacaagtggggcgacaggacccacacttcggcgttggacgtgactcacgcggggagttggcttggagttcctttattcatccctatttgctttctgtctgtaatcctttgtaattccctggtttcatgatgtaattctaatggaaataaacccgaacctttcaaaattatgtaattaattgcattcagcttcaatgacaatgactaattatagtgatacctggtggcaaggcaggtacctactgctggggggctcctgtctgcttggtactaggactgccacttctgggcgcgtcggagcggctgcacagggggtcagctggctgtcctgtggcctgctccggtgcctctggtccccatcttaccaggagcagcgccatggccatgcagggaggggccggagagggaggtggtgtgcagggaggagctgcttaggggtgggagggcttggacttgtctgcaggttaaagagaagtcttgctgggaaagtaacttcggggctggttccctgagagcattcttatctgattcatgtattttcctgagaaaaagggaggagggtgcgttcgactgaacgtgaagcgttcaaggatcggaaaggcaagccaggtacagtggcttacacctgtaataccaacactttgggaggctgaggcaggaggatcacttgagagcccaggagttcaagaccagcctgggcagcacagtgagaccccatctctacagaaaaaaaaaaagaaaagaaaagaaattagcccagcatggtggctcacacctgtgataccaatactttaggaggtcaaggcggaaggattgcttgagcccagttgttcaagaccagcatgggcaacagtgagaccctgtctctacagaaaaaaaaaaaagaaagaaattagctgagcgtgatggtgcacacctgtgatcctggctgctcaggaggctgaggcaggaggatcgcttgagcccaggagttggaagctgcagtgacgtatgacagtgccattccactccagcctgggtgacagagcaagaggaagactctgtctcttaaaaaaaaaaaaaaaaaaaaaaaagaatccaaaagcaagcttatggagaagggagaaagtgcgacagtcacctcggggcgtgggagagcagaagatggatgtcaggttaaaaaccattactgtgctgtagtatttccaggaggccaagtccagggctctgggacctgtacactgcggcatcagaccctaaaacagagctctcaggttttcgccttcccaggaagtctgcatcctttttgcagactggttttattctgtgttaggaggaggcgattttgctaagaaatcttcactgcaattttcccccccaaatcagggcacttggcatctccttctaacggggggtgcagagtctgtcctagaatgggacgcacagtgttcacacgagtaccgagtaggtggggtgctgggccggcccctctgatcctgtcctaccctgtgcagccacgtgcctttccttatccccagacttctgttgtcacgattcttccagggaagaatctggaagtggaatccacagggcggtgcccagggatggcctttagtgcctagtgttctgtttcagagagaggcctcttatttatttgaaaagctgattgtttcttttttttttttttttttttttttttgagatggagtctccctctgttgcccaggctggagtgcagtggcactatctcagcccactgcaacctccgcctcctgggttcaagcgattctcccgcctcagcctcccgagtagctgggactacagacacccgccaccacgcccagctaatttttgtatttttagtagagatggggtttcgccatgttgcccaggctggtctggaactcctgacctcaggtgatctacctgccttggcctcccaaatgctgggattacaggcatgagccaccacgcccagccttattttctatttttaaagaaagagcaagactgaaaacatttgcatgcacagtgagttttaaaaagttcctttttttagagaggaccaagaaggtgcagagtactcttgaaaagaaattttttttctgttctaaacgtgccgcttgttgccctggtgcagagagcagttcttttgatacaatacctccgtcccgtaacttttttttaaagctaaaattcatataatgtaacatttacctttccaaagtttaaaattctggccaggcctgtaatcccagcactttgggatgctgaagcgggcagaccacttgaagccagaagtttgagatcagcctggccaacatggcaaaaccctgtccctactaaaaatacaaaaattagccaggtgtggtgagcgcttgtaatcccagctactcaggaggctgaggcaggagaatctcttgaacccgggaggcagaggttgcggtgagccaagatctcgccactgcactccagcctgggtgacagagcgagactctgtgtcataaataaataaataaataaataaataaataaataaagtttaaaatccataggtgtttggtatactcacaatgtcgtgcagccatcaccacgatctagttccaaaacgtttccaacaccccgacaagaaactcccatacctgtcagcagttaccatttgtcctccctcctgtacccccggcaccccgtaaccattcatctattctctgcatctattctctgcctccatgcgtctcgggaatcatggattacgtgaccttcgtgctgtggcttctctcacgtagcacagtgtttgcggggctcacccacattgactcatgcacctgtctgggccgcattcttttttatggctgaataatattccctggtatgggcataccaggttttgtgtatcctttcatcagctagtaaacattcgagctgtttccacttttttggccattgtgaataacgctgctgtgaacattcgtgtacaaatgtttgtatgaatgcagttttccattttcttaggtgcaattgccaggtcatatgtagtcactctgggctttgctttttgagtctgttgtattttatttatttatttttttatttttgtgggtgcgtatatttatggggtacatgagatgttttgatacaggcatgcaattcataataatcacattgtggagaatggggtatccatccatcacagatttattctttgtgttgccaacagtccaattatacacttttagttattttatttgtttgtttattttgagttggagtttcactgttgttgcccaggctggagtgcaatggcgcgatcttggctcactgcaatctccatctcccgggttcaagcgattctcctgcctcagcctcctgagtagctgggactacagctgccatgcctggctaatttttgtatttttagtagagacgaggtttcaccatgttggccaagctggtctcgaattcctgacctcaggtgacccacccacctggcctcccaaagtgctgggattacaggcgcgagccaccgcgcccagttgcttttagttactttaaaatgtacgattaaattatgatcgactatagtcaccctgttgtgctgtcaaatactaggccttattcattgattctatttttttgtagccattagccgtcgctacctccctgcattgttgcattttggcctcttatgtgtaagtcccgtttgttctccagaatgctgcttttaacacccagcccgttccatctctctctcttctgccttgggtgtcatgctgtctcttcctcagatttctcctggggtgcaggtgctcccctgcgaaccactgctgtgcacaaagtgattttgtgctcaggcaggtggatcgcttgagcccaggagtttgaaaccaccctgggcaatacagtgagaccccatctctacaaaaaaaatggctgttgtgcagtttgggatgagagttggttgcccccgcggtcctcccttcccccaaccccacctgccctccttgctcagcaacaagggacccccttcactggactatgaagcctgagggttgtctaaatcaatccttggccaggcgcagtggctcatgcctgtaatcccaacactttgggaggccaaggcgggtgcatcacctgaggtcaggagttcgagaccagcctggccaaggctctgagagcagcgagactccttctcaaaaaaaaaaaaaaaaaaaaaagaatcctggctgttccttccccacggccagtgggcattacactttgttttggctggagaaaccgggagtgcccgttgtctgcctggagacatgcctgtgggagaagaggctgcccccacctgctaccatcatcccagcatgggtgcggtggggggcaggggagacagagtaaaaatcgcagaggacatggggcagaaagatggaaggaacctgggccctcgatggctctgagtgagtcagtcctgcagtgccccgtccccatttttctgtggcctgggaaagtcaaatttcctcatcctttgtagttggccattgtgttatttggagatggaagagcattctgaaacaagccactataatgaaaatccaggtcgtagcaacttgccgtgcacggctttggcttggcatggacttacagtgacatctttgagatgcacttgtccggggtgcaggtatatttgagagtgtgaggaggacatatgtcctctaagctctgttttctaaaggcagcagaattccatttgccaagccagatgtccctcaatacgttagatcccaccaataaaacattaagcaattacaatggttaatattcactaaagtataattagaagctggcgtaaattgtgaatgaaattggcgggttccatacgttacagtgaaataccaaatctttttttagttgtgtatgtgtatctcagtgagtctgtcaactcagatgagtgaatcttacctcctctgtggatagaaacgagctcaatttcaactcagttcactataattttaaatgtttaagaacatcttgccagttgttctatcatgttaaagttactgaaatctggctgggtggagtggctcatgcctgtaatcccaggactttgggaggctgaggcgggtggattgcttgagcccaggagttcaagaccagcctgggcaacatagtgagaccctctctacaaaaaaaatccaaaagtagctgggcatcatggtgacgcacacctgtgttcccagctactcaggaggctgaggtgggaggatcacttgaagccgggaggtcgaaggtgcagggagccatgatcgtgacactgcattccagcctgggtgacagaacgagaccctgtcaaaaaaaaaaaaaaaaaaaaaaaaaaaaaaggataccaaaattctcaagtcaaattataagggttttaacattcccatttctacaccacgtgcaagaaaaacaaaatccttgttttctgcctgcctttatggtccgttctcattttcagccccctttcctcattctactctattaattatgcctttatatggatgcaaacttgtaaaatatgtggcctattttgtgtgtatacgtggttttaattcataagtgtggcactgtgccctaaatctttttctccttccttttcactcgtcacatttttttttttttttaaatgacacagagtctcgctctgtcgcccaggctggagtgcagtggcacaatctcggctcactgcaacctacgcctcctggatttaagtgattctcttgccccagcctcctgagtagctgggactacaggcgcctgccaccatgcccggctaatttttatatgtttagtagagacgggctttcaccatgttggctaggctggtcttgaactcctgatctcaggtgatcaacccacctcagcctcccaaagtgctgggattacaggcgtgagccacctcacctgggctcactcaccacaatttttgagatcttgttgtctatgtcattccctgtgaattttgtttgttatgacagccgtattgaaatccatcttcagggccaggcgcggtagctcacgcctgttatcccagcaccttgggaggccgaggtgggtggatcacctgagatcaggagttcaagaccagcctgaccaacatggtgaaacccccgtctctactaaaatacaaaaaattagcagggcttggtggcgcatgcctgtagtcctagttacttggaaggctgagacaggagaatcgcttgaacctgggaggtagaggttgcagtgagccgagattgtgccattgcactccagctttggcaacaaaagtaaaacgctgtctcaaaaaaaaaaaatccaccttcagaattgacctgtgttaatctgtccagactgccgtaacagaataccatagatggggtggcttcacatatttacacaacacatatttatctctcatagttctggaggctggaaagtccatgatccgggtacgggccaacgtggttcctggtgcgggcccttttcctggcttgcagatggcctcgtttttgctgtgttgccacatagcagagagtgtgcgcaggcaggcaagccagctctctggtatctcttgttttaagtacactaatcccatcatgagggctttaccctagtgacctcatctcatccttacgaccttccaaaggccacacctccaagtaccatcatattggaggctggggcttcaatgtatgaatttgaggggggtggacaacacagttcagtccgtagcagcaccctagctcacacgtccatttccctggggctggtcaccctcggtggtatctgacccccctcccccaagcccctccatgcacagcactgctaggaacgttcttacacacgtcccttaccagtatccaggaaaagccttgctggatccagccagatagtggtccttctttcacgaagcacctccagatcgcttcccagcgtggctgccccacttactcccccacccacagtcgtgagagtttctttcccccacaatctcatccgtgctttgtggagatattttttgccagtgagatggttttaaagtggtacttcagtgttgtgtcattttctctgatcaccagggaagtcgatctttgcgataagcctcattttatacttgtcagcttttcagatttcgccttttgtaaattgtctggtcatatattttgtcctctttttttttttctaaatggtttaccatctttttgttgatttgcaagagctccttgtatgtttcacatgcgaataatttgtcaattttctttcttttttttgttttttgagacagagtttgctcttgttgcccaggctggagtacaatggcgcggtcttggctcacttcagcctctgccacctgggttcaagcgattctcctggctcagcctccccagtagctgggattacaggcatgcgccaccacacctggctaatttttgtatttttagtacagatggggtttcaccatgttggtcaggctgatctcaaactcctgacctcaggtgatccgtctgcctcggcctctcaaagtgctgggattagaggcgtaagccaccacgctggccgttatagttttttaaattaaaaaaatttaaaattctaatagattattgtggtatagaggaaacaattggtttttgttgatttcgaagctgggaagcttgctgttaatatttttactaattaacttgattctgttgcattttctctggaaataatatatgcaaaataatgcaagtttttatttgttcctttccttctgattcttacagtggagtgacttgctggctagaatctgaagtactcaattacatggtggtggtgatagaggctgcccttttctttctctttctaccaaaggagatttttggtagaaggtttaaccaggtgaaggaactaccttaactcccctttccatagtttttagagaattttttttggtataaataggcgttatcctcttgcaaatacttttccttaaaacctattcatgtccatgcagtttttatcctttagtttatgaatgtggtaaattacattgattgactatatgatgttgaatcatttattgctttctgggataaactcttcttcctcttgtattttaaaaatattgttggatttgatatacagttttcaaatctgtgttattaagtgaaattggcctataattttcttattcagttggaattgaggtttactagtctcatgaaatgggtaaacattgtgttggaacaatttatataacatgaggattatctgtatcttaaaatttgatagctcacctttgaaaccatcagggcctgagactttagaatggtggctgggaggcatttaacatttcactttttttgtttttggtctattgaggttttctattctttattttattttattattattattatttttttttgagacggagtcttgctctatcgcccaggctggagtgcagtggcgcgatctcagctcactgcaacctctgcctcccgggttcacaccattttcctgccttagcctctcgagtagctgggactacaggtgcccgccaccacgcctggctaattttttgtatttttaatagagacggggtttcaccgtgttaggcaggatggtctcgatctcctgactttgtgatccgcccgcctcggcctcccaaagtgctgggattacaggcgtgagccaccacgcccggcaggttttctattcttatgccaattttggcattttataattttctaaaaatgttttcattttatcttggttttaaaacttaactgttctgtgatcatagtattttttttttgtaaatctgttttgaactctagctgtctcccatttctacattctgtatttctgaatttatttacaactcttctctttatttttagttgtacatagaggtttgtttatcttactgatcttgaaaaaacagcttttggtcttgttaatcttgccttttttttatgtggcttatttctcaccattattttactttctgagtgcattttttttctaacttatttttttgaatactcagctttttatttcattttatttatttatttatttatttatttttgagacagcctcactctgtcacccaggctggaaggcagtggtgtgatcttggctcactgcagcctctgcctcccgggttcaagtgatcctcccacctcagtctcctgagtagctgggagtataggcgtccctgccaccacgcccagctgagttttgtatttttagtagagacagggtttcaccttgttggacaggctggtcttgaactcctgaccttgcatgagccacccacctcagcctcccaaagtgctgggattacaggcatgagccaccactcctggccttgaatactcagctttttaaattggggttctttcttgttttggataaatctattcaaaactgtaacatttctgctaagtattattttagctgtgttccacaaattttgacatgtagtgctttcatttttattcattttgtaattttctattcattttgtaatttcccttataattttctctttaacctaagggttatttaatactgtatattttttagatttttgacacttttctttaatggcttttaaaaatgttgttgctgtcatttttatcacatatggtcagagaacatagttcacataatcctggttctttggaatctatgaggtcttctttttggtgtcttgcacatggtggatttttgtgaattttccatatgtgctcaaaaagaatgtgttttttgagtagaaaaaaacgttatatatgcagtatacaagtgacatataccatatagtcatacagtttgtttggtatatggaatacattcatgtcactgtttctttgataattttcttcccatagttttttttcttctttctttctttgagacagagtctcgctgcatcacccaggctggcacgcagtggcgtgatctctgctcactgcaacctctgcctcccaggatcaagcaattcttgtgcctcagcctcccaagaagcgagaattacaggagcacatcaccatgcccagctaattttcctagttttagtagactgggtttcattatgttgctcaggctggtctttaactcccggactcaagtgatcctcttgcctcagcctcccaaagtgttgggattacaggtgtgagccaccatgctgggccttcctacagtttttgacagttgttacattatattaggttaaggctgtactgttacattgcatgtatgatcatgatcatgatctttagattttcctgatgtattggttttttttttttgatgtctgtatagactcttattatgtttttcatgttaaattctattcgttttgacattaaaattattctattttttttttttttttttgagacagagtctctctctgtcgcccaggctggagtgcagtggcgcgatctcggctcactccacctcccgggttcacaccattctcctgcctcagcctcctgagtagctgggactacaggcgcccaccaccacacccagctaattttttgtattttttagtacagacggagtttcaccgtgttagccaggatggtctcgatctcctgacctcatgatccgcccatctcagcctcccaaagtgctgggattacaggcgtgagccaccgtgcctggcctattctcctattttttttgtttgtttttggtttccatttgtttgatgttgctttttctctttaattatttccaatccatatcattttgctttcattgcatttgttgcagatctgtgatgtaagatcttgtttttaaaacccaggttgagaatctttgataagtgaatttagctgagacacatttctggtagttgtgttatattaggatttctgccatcttattttgtgttttctgcttaccattacttatttttaaaaaagcttttcttgtaatgctttgtagggttgaactttcttctgctggattttaaagttgtgcaatctattttattcttctagagctcagaattgtgattattcttaaaattattaagagccacttatgtgattagtttttcctatccatttcttttttttttcttttagaatataattgatttttaaattcacttacttgtttcaactgcctggagtagggattcctgtcagtttctaaaggctattaatatctttgtctttctgtcaaacaagttaagtgatagggacctcgtttcctcccttcagcctgttgagatcgtttagattctaggataatggtgccatataggactgtggccctcgggtgtgcagaatcagcgtcaccaggtattagactttcagtattaatgttctctccttgctagaatatgtgaacaaatgtgaaccttttgaaagagccaatccttcaggatggatccagaatggctaaccaggcctaaatctaaaatagagccagacggccatttgcagattggaagtcacacacttagtctgagttccctgaaaacctgcacctttcttaagtttgggactttcagagctcacctgacccaactagtctgagttcaccagccctggccaatcagggctcagctgtgtcaaccaatcagccctaagcacgtttgaatcattcataaagaaatctgactgggaacctgggtgggcactgttgctattaacaaacaccgtccccctccccgcccccgcccccgcccccaaccccagcagcttctgtttacacggaaggctgcatctccctggtttgcacgttgtccacgggaataaagtctctttcctccagattccttttcagagcacttttgttaagtattttaaatgatagtgcatttaaagaagtctttctgtgataaacttcctgagactttaaagtctgagtctatacttattccaccctcatatttaagtgatacattagctggatgtaaaattgtaggtcaaaattctttttcttcaacacccagattattcccctgttttctttttgcacagagagtcacggttgagaaatatgaggacagtgtgattcttactgctttggagggaagtctggtttttctttttatccctgtcttcattcttttttctttttatccttgtcatcgttcttcttttttctttttgtttttccgagacagtctctctctctgtcgcccaggctggagtgcagcagcacgatcttggctcactgcaacctccgcctcccgggttcaagtgattcttgtgcctcagccttttgagtagctgggattacaggcgcctgcccccatgcccggctaatttttgtatttttagtagagacagggtttcaccacgttggccaggctggtctcgaactcctgacctcaagttatccacccactttggcctcccaaagtgctgggattacaggcgtgagccactgcgcctggcctgtctttattctttaatgtcaccaaaatgtatctaaataatgatttcttccacctacctatcttatttggcactttactgaccctttgattctgatgtcttatttttttcttttattctagggagttctcatacatttatctctccaaatattttctctcctctctttattttttcttctttctaggacacccactgtacaggtgtcaacccttcttctgttgtccatctctctctctctctctttttgaaatggagatggggtctcactatgttgcccactctggtctcaaactcctgggctcaagcagtcctcctgcctcagccttccataatgctggaattacatgtgcgagcccccatgcctgacctgttctctgtatctcttaacattagcctcattctcaaacatgaagagagtagccttggtgtagactggccacgaattggcgattgttgagatgggcgattggtagtgagggtacccatgaattggcgattgttgagacaggcgatgggtggtgaggtactgtttgtatgtatttgaaatactgtctgtgtatagctccagttgaattacctcctactgagacccactggccttagcctgtggtgtggggatgaaagtggggagggaatagaggaggaggctggctagataggcttggggctggctgccaggacagttaacatgacttacatggcacatcgtacatttctatggaacagtgctgttccgatttagccccttgctaggcaaagtgattcatgaaccagcaacagtggtatcacctgggagctcgttagaaatgcaggatctggccgagcacagaggcttatgcctataatccccgcactttgggaggctgaggccggaggaccacttgagttcaagaccagcctggccaacgtggtaaaaccccatctctactaaaaatacaaaattagccagatgcagtggcacatgcatgtaatcccagctacttgggaggctgaggcaggggaatcgcttgaccccaggagtcggagatttcagtgagccgagattgcaccactgcactccagcctgggtgacaaagggagactccatctaaaaaaaaaaaagaaaaaatgcaggctctcaggccccaccccaggcctcctgagacagaatctgcatttttatgagattgtcaggtgaatcatatgcacatgaatgtttgcacattaaatgagcactggtctggatcctttaaaaaggaatgattggttttatttaattcatattttaatagagtgactcctcccttatcttccaagttgagctctcccagcatagatggcccagctgccagggctgatgcccatagtctgtgcataaacaggggagttcccgagcccttttccaagccgcttttaaatgcaactcctttttttttttttgagataggctgttgctccattgcccaggcaggagtgcagtggtgcaatcctagctcactgcagcctcgacctcctgggatcaagcgatcctcccaccacagcctcccacctaagccccctgagtagctgggactacaggtgtgtgccaccacacccagctgattttattttttgtattttttgtaaaggcgatgttgttcaggctggtcttgaactctttggcctcagcgattctcccacctcagcttcccaaagtgctaggattgccagcgggagccaccctacccagccgaactcctttcttacacgtagttctgacagtatcgatcatccactcttcaaggtgctaatacattaaaacagcaaattggaagtaggccaaggaggtgctagtggcagccccacggacagtagcaattaagaccagttgctagcttgatagtgggagaccagaaagactaaaaataattgcaggctgtgttggtctggtatggatgctgacttcctgacatgtagctaggtggagtggctcatgctgtaatcccagcactttgggaatccaaagtgagacgataacttgaggccaggaattcaagagcagcctgggcaacatagcaagaccctgtctctacaaaaaaatttaaaaaattaaaaaaaattagctgacatggtggcacgcacctgtaagtctcagctactgaggaggccgagatgggaggatcgctggagcccaggagttcgcggctgcagcaagctgtcattctaccactgcactctaggttgggcaacagagcaaggtcctatccctaaagaaatgacaaaataaacagtcaaccacctggtggagaaggtagtattttcaccaacgctgtagcaaatgtcaaggccaagacaaacacttgtttggaaaatttagttttggggaaactcctctcctctagtgtgctggattcatgatatattgttacctggaaatggcagccctcagtggataagaacctggggttttggagatgacccatgtttggcggcacctgatccctatcagcagccatgcgtcccactgtctaggcagtggccaagggtgctctgtcttggacggcagacagcacatctgatttggaatttttgttccagcacttcttagctgtgtgactttgggcactgctgaacctgcttcctccgtgaaacagccagtgataaaactatttactgtgtagaggattctgtgagactcaacgtatggcagtgcctgatgtactattctaaatttatttttatttttattttagagatggggtcttgctgtgttgcccaggctggtcttgaacccctggcctcaggtgatcctctggcctcagcctcccaaagtgctttttcattttctcctcaaaatgagaaagtaaagtgttatggtgttggcagctcacccatagaaactgctttaaaggccaggcatggtggctcatgcctgtaatcccagcactttgggaggccaaggcaggcagatcacctgagatcaggagttcaagaccagcctggccaacgtggtgaaacccatctctacaaaaataagctgggcatgatggcgggtgcctgtaatcccagctactcaggaggctgaggcgggagaatcacttgaacccgggagccagaggttgcagtgagccaagatcacgccattgcactccagcctgggcaacagagcaagactcaaaaaaaaaaaaaaaaaaaaaaaagaaaagaaaaaataaactgctttatattaaaagaaaaataatggtcataatctggccttaggggctatagcatcaatggtgaggcctagatcgcccaggtcactgggtgtgtattgacgttgtttacatgttttatttcttttatgctttttcccagagattgatttttttttctcccttatgtgattcaaaatatctgcttacacgttaaacccagctcagttggcataatgtctttttaaggcacaagccagcttcctgggtgtgagcagcttccacatcaaatgttcagtgggcaaatgaaacatgtgagtcacacaacacttggcacctctgtggcttttaatatttggtggcaaacttcctaccgcgaggagaaaattttcaaagtggaagtcctttcagatccagatggcaaaagaatttgttgggcgagggatcttgattcttaatgttgaggggactaggaatgtttgaattttctcccccttgtattttcccagcctggtaggcctccatgggggccaaatttagttgcgaatttgcccacttttgtgcagagtgaggctccatctatggaatgtgcttaaccataaggatcagaaaaatttctagtagctttgttaagtgcacagcaaacagaagacaaagtgtggccgggtgcggtggtttatgcctgtagtgcaagcacttagggaggcagagatgggaggattgttgagcccaggatttcaagacccagcctgggcaacatagcaagacccccttctccaggaaacggaaaaaaaaaaagagtttgaaaaaagtgtgtagactaactgaacacttgcaaggcaattttttttttttttgactgtctggagagcttgggttccatgaacacaatacagctcttgttccacgtgacttacaagttgggccccgggttttgttttcttggccgagatcttgaagactgtctccaagtaggtgtttcttccttggcagcaggtttggccagttatgtagtcagccctgtccttctctgaagggtgggtagttgagttgggggtatgagaggggtgacagtggatcatcttagctttttttctatttcacgtcattgttcatggatacaagtgcaggtttgtgacataggtaaacttttgtcatgggggtttgttgtacagattacgtcatcacccaggtattaagcccagtatccattagtttttttttttttttagttatttctcctgatcctctccctctttccacccttcactctccaaaaggccccagtgtgtttttcccccctctctgtgtccatgtgttctcattgtttagctcccacttataagtgagaacatgcagtatttggttttctattcctgagttagtttgcaaaggataatggcctccagctccatccatgtccctgcaaaggacgtgacctctttcttttttctggctgcatagtattctgtggtgtgtatgcgccatgttttctttatccagtccattattgatgggcatttacattgattctatgtctttgctattgtgaatagtgctgcagtgaacatacatatgcatttatctttatgatagaatgattgatattcttctgggcctatactcagtcatgagattgctggatcgaatggtatttctgtcttcaggtctttgaggaatcatcacactgtcttctataatggctgaactaatttacactcccaccaaccgtgtatataagtgttcccttttctccacaaccttgccagcatctgttactttttgactttttaataatagctattctgaccggtatgagacagtatctcattgtctcatgcaattttttttttttttttttttttttttgacagggtctcactctgtcgcccaggctggagtgcagtggcgcgatctagatcttggctcactgcaacctccgcttctgggttcaagctattcttctgcctcagcatccctagtagctgggattataggaatgtgccaccatgcttgtctaatttttgtatttttagtagagatggggtttcaccatcttggccaggctggtctcaaactcctgacctcaggtgatccgcctgccttggcctcccaaagtgctgggattacaagtgtgagccaccatgcctggtttatttcattttaaaatgcaatttttctgaaggtagtcattgtttttgcatgttttcttttcttcaaaacatttttcatttgttaatcaacattttataaggcttaatattaaaaaagaaccaaccccaccccacttctccccactctcatttcctacacccaagagcagccctggttttctttttctttctttctttcttttttttttttttttttttgagacagggtctctctttgttgtccaggctggaattgccgtggtgcgatcatggctcgctgcagccttgaccaggtataggaaatgagagcactgtgcccggctaattgttgtattttttgtagagatggcatctcaccatgttacccaggtggtctcgaactcctgggctcaagcaatcctcccgcctccgcctcccaaaaagctgggattacaggcatgagccattgtgcccagccagcccctggttttctaagtagcaggcttataccacttgtctttgatatttcagtgttaggtgttgacttactgatgtgttttatgagacatggatgaggattctggcctcagaaaaggctgcctacgcctctctctttctcagaatagtcacatttcacctgtaattccagtgctttggaaggccgagacaaaaggatcaccggaggccaggagctcttgactagcctcggcaacattgcaaaactctgtctctaccaaaataattaaaaataaaaaaattatccaggtgtggtggtgtgcacctgtaagtcccagctacatgggtagctggggtgggaggattgcttaagctggggaggtcaaggatgcagtgagctatgaccacacccctgtactccagcctgggtgacagagcgagagtctgtctcttagaaaataacaaataaatacatttttaaaagcatagtcatacttctctttttggctcaatcaattttcaaatatacagtgtttccatagctatgactttgtaaatattagtattctttgtacactacttaatgtatgcctaaactctcctccagcaacatagatctcttaaaatatggaaggccatcagtgaggtagggtttcatctttcttggtgacagcccttcttggcccccctattctgcccagctgggtctcccattcctcatcatctcgggggcttcctcccatctctctccagctttggatctcctgactcgtgtacgccatggctttgttcttcctggttaacctctcatttgctgcggggatgttctccgattgcttcctgatagatggtgaccatatctgcgatccgacaagatcttctttattctgtcctcaaatcccaggttggaaaacacttcctgcagaatgggaaagatttggctccccgttttctagcatccgtcaagggcgttctgcatttttgtcctttgttctaacaccttgtagagttgtctttttcttcttcttctcagatttcatgaacacgcaccttggcgtggttcttatggcctggtctctgttttctgtcttccagagttgcgttagtcagatgttgcactttgtggcctgatctgctaatttttcttacttttcatttgtctttcttctctcttttttttttttcttttgagacagcgtctcactctgtcacccaggccagagtgtggtggcaccatcatggctctctgcaacctccactgcttgggctcaagggatcctcctgcctcagcctccccagtagctaggactacaggtgcacaccaccacgcctggctaattttttaagtattttatagagatagggtctcactatgttgcccggactggccttgaactcctggtctcaagcagtcctcccaccttggcctcccaaagtgctgtgattacaggcgtgagccaccgcacccagccttacctttcactttcatgcctctgtcttttttgatgtgttttctgcaggaatttctcaaccttccagtctttctaaacttttatgcatcttattttagatttccaagttttcttattctttgaacatttttatggtctgttctttcatggaagcatcatcttttatattcctggctacattcatcacagttttttaaaaagtttttggccaggcaaggtggctcatgcctgtaatcccagcactttgggaggccaaggtgggctgattgcttgagcccaggagtttgagaccaacctgggcaacatggcaaaaccctgtctctactaaaaagacaacaattagctgggcatcgtggcacacacctgtagtcccagctacttgggtagccgaggtgggaggatggcttgaacactgaaggtggaggttgcagtgagccgagatcacaccactgtactccagcctgggcgacagagcaagaacctgttgcaacaaataaaaaaattttaaaaaagttttcttctgttctctgcgttggaattttttttttttttttttttttttttgagatgaggtttcactcttgttgcccatgctggagtgcaatggagtgatcttggttcactgcaacctccacctcctgggttcaagcatttctcctgtctctgcctcccaagtagctgggattataggcacatgccaccatgcctggctagttttttgtatttttagtagggacagggtttcatcatgttgcccaggctggtcttgaactcctgacctcaggtgatccacctgcctcgtcctcccaaagtgctgggattacaggcatgagccactgtgcttggcctctgcattgaattcttactgtctttactttgtaaaatgttttttaaaaatatataaacagttgcataccatgcattttggttgcaaaatataatacagtgaacacccaggaaccctccacccaaccctaagaatcagagctttgccagtcaattgcatccacctgtatattcctcccacctcctattccctgccccctctctgggacaggtgacccatcctaagtagtgtatttattatgctcttgcctaaaataatgtattttctgcacccatgaatagatgcttaagtagtatatgattactcttccctgagtttgagctctataaaaatggtattattctgcaatagacttgcaggatttgccttttgaacttgagttactgcaacattatctgtgaggttgtctgttataactgtggtccatttattttctctgatgcttaaacccagttgtgcggctagacccaaatttctttagcctttgtcctgtcgctttgtctgttttcctcgtttccctctttgttttggtcccagttagaggtttcctcaaatgcctagtgacgtgttgttgtttgttcatatatcagagcatggcaatagaaagggtgtgtgtgtgtgtgtgtgtgtgtgtgtgtgtgtgtgtcggggtaaagagcagttttggtggcccccaccgtaagtaattaacccaggtgtctagttgcggggagcccccaggcatgggtatcagtggctcattctcttggactggtcagtttctctagcaaggagccctcagtgttcctgctgggtggtgcagttgggaactgttagtctgaccacctgtcttctaggcaccaggctggggcatgtgctgggatattcactcagccccctgcccatggtcatgagaaaccccagtcttctgcccacagtgcaggagggacctgaccgcagtggcattttgcacacctgcccggcctccaagtcctgcagctcgaatgagcttgcttgctgcaggcggcctgctccatcttgaggcttgtctggaaaggcggcttcggctttccagtgctttccagcgctttccagcttctgagattttgggggcttttcatttgttcttgctttcctgtcctctttgtcaggtgagtttatacctttctgttccaaagcaaacaggatcgtctgccatgttgaactggatgtcggacaattctgaaatgtgtgcatggggcaaggctgtgtgtgatgataccagtttcataggaaacacttcggttttggttttgtctttcaaagtcatcttttgtgagcgccttctagccgggctgccagcgggtaacatatgattaacacaagtttggagtctgtctgcagagcaactttatgaaatgctcagaaagccagtctcctaagcataggagcctgtttggtggtgatgggatgaggaagcagtgggggctttggcaccagaggcctgggctcaaatcctgcctccatcatttaggggttgggcatctccattcccttatctctgggtggcgagaacttcctaagttcttagtgtttggaagggaccccctccataaagtgaggtgcctcttggccactgctcagccagtgggggctgttcctaacagttgcctcctccgattgctggagtaagaaatgacaccctgtctcccatttctgtggcaccccattctcaacagtgatggttctgcctgtttttagtcacacacacctgcacacttcaaaggactaaaaatggactcagttttctttctttttttttctttttgagatgaagtctcactctatcacccaggctggagtgcagtggcatcatcttggctcactgcaacctccgcctcctgggttcaagcgattcttgtgcctcagcctcccaagtagctgggactacaggcatgtgccaccacacccagctaattttgtatttttagtagaggtggggtttcaccaggctggtctcaaactcctgacctcaagtgatcctcccacctcagcctcccgaagtgctgggatgacaggtgtgagccacctcgcccggcctggactcaatttggattgcaatgccccacaatggtgacctccctcttctctgttaatgcatcctcttccctcttgcttaaaaatttccccagtgccgtggcatcttacctcctgctgaagtgtgtgctgatgctttgctgggggctggaccccgtcccttggagcctggcccaggccctgcctcccagtgaaaccctggccgcctttccaacctcagaggctctatctcctcccaaaccctgtagcccttccagttgctggtcactgacttccattaattggcccggtggccttgcctgccagggggaccatgaggtgaggggccgtgtcctccgagtggtctctttctccagggtgctggggacccaagaaatgcctggtcgtttctcataggttgataaggaaaatgaggcctaggtagggacaggcaggatttcacctgaatttacaagatgatgcaatggaagagtcttcagtatattttcacgtattttagaattgagttacaacattcattttggtactttctctgtgttctccccatgtgttaaaaagcagcttaaggccgggcgcggtggctcatgcctgtaatcccagcactttgggaggtcaaggcgggtggatcacgaggtcaggaattccagaccagcctggccaacatggtgaaaccccgtctctactaaaaatacaaaaattagctgggcgcagtggcagacgcctgtaatcccagctactcgggaggctgaggcaggggaatcgcttgaacccgagaggcggaggttgcagtgagccaagattgtgccattgcactccagcctgggcggtagaaggagtttccagctcaaaaaaaaaaaaaaaaatgcagcttaagtgctggtttagcgcctgtaatcccagcacgttgggaggctgaggcgggaggatcacttgagcccaggagtttgtgactagcctgggcaacatagcaagaacccgtctgtacaaaaaataagaaaaattggccaggtgtggtggcgtgcatctgtagtctcagctccttgggggctgaggctgaaggatcgcttgagtccagcaggaggtcaaggctgcagtgagctatgatcaagccattgcactccagtctgggtgacagagtgagaccctgtctcaaaaaaaaaaaaaaaaaaaaaaaaggaaacaagaaagaaaaaagcagctaaattctgctggaagtgtgcagtaaagcacaagttttcagccatcaacgcagggagccgttaatcacgacccataataaccagaatgttattccacggttgcggtttgtttatttcatcagagttgcgtcttcacctatttccctccctactcttaattgtttatccaagttagtgttttccattctttcactgaaggctctaaaaatggtcccatcaagaagtctggtagataatggaagacgaagtggactttacagaaagatgaattttcttccctagagctggaaaacccttcagcgtgtcatgcgttccccagccaggacagacaaagccacgcaatctgtttcctgcaggcccagaggggaaggcttcctccttgtggttagtgacttcaaaagctgtcctcactagagcaagtccaactcttcctctagttctgatgacttcacggcagccaactgagctgctgaacgctgtttttttctacgcagaaaccctcccgactttcacgaggagttgacaggttttcctcttcactcgggctcccttgtcatcgttaaactgaaactgctttcttgtagccaaattctgtggtcccttttcggcctcggcctccttgacctctctgtgtccccaccttggctctcccacgcctgccagccgtaccacaggccccgggtgtgaaccctccctccgcggtcatgcagccacgcctctgctcaagctgtgcctcctcctgggcgcaccctccctctcccatccttcagcctctgaagtcctgcccagctccggttcctgtttctgttaggacgaggcccttcagatcctctccagcaggtggactctgtcctgccccgtaccacccgccgcgggccacttttgggcctgcgccatgttcctgcccttaccccgcccggtgttagcgtcacgtgggtcctgatgtcctccctctcccaggcctctgcttatctgattgggggctgtgcttgactctgaaacccgggcacctcctacagggcattttgcctgtcacaggcctagcattcaatacctatcatatttttgaaatatctgcagaaataaaaagaaataactattttcttcttcaggagttaagatgcgtggccaccaagtacttttcaatacataaaatatgttttcagcacagaaaggcctttcaccgctcttacttacatagtctgcttttggtatgatggggacggatgaaaaatgaggactgtaggcctccgaagtcagctgttttgaattaaagcagcgcacgctttgagtcaggtgaagcgaggatggggtttcacccgttgaggatgaatttgctgggttactttaaactggaactgttcttttcagaaatgagtgaagcaggaagggaaagacggagcttgtctggctgggtcggatgaccccctttgccaggccgtcacccctctaggttgagttagctcagaataacttagctgtgctatagctttgcataattgcaaggagctttgtttcgttttattttgcagggaatttttttccccccttagctcttcctcctggtgtatttgtagaaatcagcttcatcatggtcatttaacagtaagggctgggggtggtggctcacgcctgtaatcccagcactttgggaggccgaagtgggaggatcacttgaggtcaggagttcaagaccagcctggccaacatggtgaaaccccgtctctactaaaaatacaaaaattagccgaatgtggtggcacgcacctgtactcccagctcctcgggaggctgaggcaggagaatcacttgaacccaggaggcggaggttacagtgagccaagatggtgccactgcactccaacctgggcaacagagcgagactctgtctcaaaaaaagagaaaacagaacatactatttttgttgtttctgaggagtagggtttcttaccagggaacctgctttaaaaaaatgcagtatgtagattccttaagaataaagttaagcagcagctaaccaagcacatggctaaaaacccggccaagagcattgtagtatctggttttggggttggtggtggggatcccattttagaggccgactttggtttgtgatggttaggttttactttcttaggtctcagctcacatgtccccttctcagaggagccatcctcacccatcccttcttggtccctcccgccttccctgactttttcttcttcaatgacttatctgcacatgatcccctacttataaaacctgtgtcttccactcctctcacccgaaagaatgtttgaattctgaaaacaatgactttgttcttagcacccacaacagcaaatgctcagtgagccctatgttgagtgagttagttgtgagctgtggtggtttagtgagggtatactttggcccttagaatgcgaatgccttttttttttttttttttttttgagatggcgtcttgctctgtggcccaggctggagtgcagtggcacgatcttagctcactgcaacctccgcctcccaggttcgagagattctcctgcttcagcctcctgagtagctgggattacacacactcgctaccatgctcggctaatttttatatttttagtagagactaggtttcgccatgttggccaggctggactcaaactcctgacctcaggtgatccgcttccctcggtctcccagggaatggctgtttaatcacaagaaagtcttcccttcatgcgttgtgaaaaccagcagtattttaattgaagaaatccggtattgtttggctttctagatttggaagtaggtcaggtggctaatgattgaaaatggaccggcaaccagagggcctttggaaactctagctcgacttcaggctatagttttgtttatgcccttgtcactaaaggcactgcccatgagagctgggtttgcagtccctgctgagcctggggttgagagcagagccctagagtaactcagcaaaggcatccctccctgcacctgagctgggggagaggcggcttatgattaactcagcgatgtctcaaatgccatttctagaggctgaacacattaacttttaaaaaatgatttaaaaattaccaattgaccgtatccggggctgaacctgcgtgattcagcttcttttaaaaatatcttttctcaacaaattgcttccttaacattttaatttgttgatcatcaaggaagcttgccaaatattagctgttcttttccatttcctaccgcctcaagcttcccgtatttggcctatttcagtggagctgtaaggtcactccctatttttcttcccaaataactgtatttattactgtcaggtattggcgggtttgatccagctgtcatcagaacgtttggaaataccgttttttgccagaatgctgatttaatgatctcatactgacatggcttgttctctctgcagacttgataacttgttgaatatgttccctcttcttattgagcaatggtgctttttgaaaatttttcccagccagaaggcttcatgggtagtatctttaagatcctagcagaaggttgcttttctctctctctctctctcagtcctttctttttctcttttctttgcttctttccttctttcctttttctttcttttctttcttctctttctttctcttttcttggcttatttccttctttcctttgtctttctttgctccttccttccttccttttcttccttcccctttctttttccttccctccctccctccctaccttcctcccttccttccttcctctctctttctgtctctctgtctctgcctgctttttcctctctctctctgtctctccccccttctcccctctcctatcctcttcttccttttttctttttttggaaggcccagattagtagcagagactctccttgaaggggatagatgcattgtcgctgtttggtattttgaacagattcttaagaaaatgttttcctggtggaagatttcagacacacatgaggtgagaataatgaaccctgtgtgctgcccccagcatgatcagttccaaactattggcctgtctagtttcatctccgcccctgcctactcctggaattttgaaaaggacatcatattattttctccataaatatttcagtatgtatctctaaaagataatgtcacttcgaaaaaaatacctaataccacgatcacacctaaaacataaatgaacaatatgaaggatgagtttctgctgtgtggcatggcagaatgatgctctgtggggtcccaggggagaggtgagctaagttcagtgtgtcacctgctgtcacctgccatcacctgtcccagggcctggggctagccactgctcttttgtgagcctcagtttcttcatctataaaactagaggattgtactagtctgtctgtctttccttcctttcctccctttcctgtcctgtcctgtcctttcctttcctttatcctctctctcttttatctccccttcctcccttccttccttccttccttccttccttccttccttccttccttccttccctccttcccctctcttcttctctctttcctttttttaaagagacagagtcttgttgtgtcacccaggctggagtgcagtggtgcagccatagctcactgcagccttgacctggtagtctcaagtgatcctcccacctcagcctgtgaggttccgggaacacaggtgggcaacaccatgcctggctaatttttaaattttttgtagagacaggctagtcttgaactggcctcaagcgatcctcttgcctcaggcccccaaagtgccgggtttataggctgagccactgcacccggcctgcactagttttttttgtctctagaaatctgcatctctgaatgtgttaggtcctgacctgctttagaacggatctcagccaccctgctccttcgaacccacatttctgccccgtgtctgctggtcgcaggaattggcacattttcctttagctgcgcccaccagtccttgcacgcatactcctggtcacttttttaatgtctggcagatggtttcaagtgcaatggcgtctctgcgtaatagttgattctctaaagaacagagtctactaagtggaagctgcgtttccacatttagcagttagctgttaagagccagtaacaggtgcaaatttgcaacccgttttttccccaatcttttggaatggaaatggttcagtcatttgaatttaacaaactgcctgcccggcatgcactgcagatgctgggctgcaaagctggttttggtgctggttggccccctgggtgcccctgtctactgagggtgggacaggcggaggactgggggctcagtgctgcagaggcacatgtagggtggggtggggtggggtggagaagaagtcctgaccagtcctgatttggtggtgctggtgcttatgggctagtgagatttctgcatgcccaggctggctggtagccatgtgtcagtcactcataatcccagtaccagagttatcatcacccctaacttttttttttttttgagacggagcctcactctgtggcccaggctggagtgcggtggcacgatctcggcttactgcaacctccacctcccggagtctccctctgtggcccaggctggagtgcagtggcacaatctcggctcactacaacctccacctcccgggttcaagcgattctcctgcctcagcctcccacgtagctgggattacaggcgcctgccaccatgcccggcaaatttttatatttttaatagagatggggtttcaccatgttggccaggctggtctcaaactcctgacctcatatgattcgcccaccttggcctcccaaagtgttggggttacaggcatgagccactgtgcccggccacccctaatgttttgatttatttcctttgaatttttttttctctgaataaatggattgatgatatctattgacatagtcagaaactcaagaaacatctatggagcatctagccatggagcagacactcctgttggtctcgggggtgtgtggcgggaaggtcagagtccttctagtcctccaagagcttccagtctggtgggtccctagaatataatacattgtgtgttgtcgtaggcgggacttgcacgctgtgcagttggctttacggttgacaccaggccaccagtggcctcctccgcctgcccttccagcctgcggttgtccttcagctgctgcctgtgaaatgtgatcctttccataagtccccagcacagagactgggaaggcagtttctaagaaggcccttctgttgggctggctcagaacctgccccctttcctctgacttgcctataaaaaggtgggtttttcctcctgcctataaaaaggtgggatttcacactgacataatttacatcgagggacatattaaacctggtgtaatttgcaagtgtgccctgaacacgtttcatcatcaggctcgttgtggagaccacggtgtccctttccttcccatcgtaagtccccggtgtgtgtgtgtgtgtggaaagtttagagctcccaaagtttagagctcagagaggataaagacccgtattactaaacttatcaggaaaatgtggcttcagattattttttttcacagcaataattgcatttcatgtattttttttttttacttattacagaaaatttcaaatatatacccaaacagaagaagatcatgaatgcttttgtgtccatgactcagcttcaataataattatttacttgtcgctggccttgtcttatctgtaactttctcatcgctcacccgacttaaattttgaaacaaatcccagacatcatatcttttgccatccacagatacatcagtgtgtatctctaaaagagaaggactttgcaaaaagtacaaccacaataccattagcacaccctcgaaaaatgacaaagattcatcaatatcagctatccaatatcaaactgccactttcccacaaatgtcataattaaaaaaaaatttgtttcaatcagaacaagaaaatccaagtgagattcaagagtcccgctgggactggttcatgtgtctttgtcttttgagagttcttttttttttttttcttcttttttttttgagatggagtctccttctgtcgcccaggctggagtgcagtggcatgatcttggctcactgcaacctctgcctcttgagttaaagcgattctcctgcctcagcctcccgagtagctgggattataggcatgtgccaccatacccagctaatttttatatttttagtagagacgaggtttcgccatgttggccaggcttgtctcaaactcctggccttaagtgatccacccgcctcggcctcccacagtgtggggattacaggtgtgagccactgcgcccagccagggctctttttatattgcaaaactgaaactctgcacccattaaacaataacactccatttcttccccaccatgccctggcaaccatgattccactttgtctctatgcctttgaccactctaggtccctcgtctaagtggaatcatacagtattgtctttctgtgactggctcagttcacttagcacagtgtcaaagttcctccatgtcgtagcttgtgtcagaatttcctttctttctaaggctgaacaatattccgtggtgtgtgtataccccattttgtgtattcattcatcaatcagtggatgcttgcgttgcttctaccatttggctgtggtgacactgtgtgaactctggtgtgtatatatctcttcaagacccagttttcgtttcttttgagtttatacccaaaagtggaattctgtttgggttgcaccattttaaattcccaccaatggtgcacaagggttccaatttctccacagcctcgccagcatttgtcattttctggattgtttttttttttttggagacaggatctcactgtgttgcccaggctggagtgcagtggcacaatcatggctcactggatccttgacctcctaggctcaatcaatccatccacctcagcctcctgagtagctgggactataggtgtgcaccaccacaccccgctaatttttatatttttttgtagagatggcgtcttgctgtgttgcccaggttggtcttgaactcctgagctcaagcgatcctgctgccttggtctcccaaagtgctggggttataggggtgagccaccatgcctagcctggatttttttcttttttaatggtagacatcttagtgggtttaaggtggtatctcattgtggttttgatttgcatttccctaatagatagttatttttatttttatttaaagggagtctcgctctgtcgcccaggctggggtgcaggggtgctatcttggctcactgcaacctctgcctcctaggttcaagcaattctcctgtctcagcctcccgagtagctgggactacaggcgcacaccaccatgcccagctaatttttatatttttagtagagatgaggtttcaccatattggtcagactggtctcgaactcctgacctcaggtgatccacctgccttggcctcccaaagggctgggattacaggcatgagccactgtgcccagcctaatagatagttatttttaatacttatttaagcttcatgtttcaactgggggtgcttcatgatatattaatatttaatgagccaccttaattatttctaaaaaagtaaaaaagggaaatactatctcccacatggtattattcatgatgtatatcttttttttaaatgttttgtagaatcggaccaaaatcagaccaatcctctcagtttatcacaaagataccaaaacccagagagaatgaggctttgccttagcctcggccctgggagatagaagaggagcctggggcctgggttccccctgccgtggctgcccagtccttccgctgacaccatttcgaggtccccttgtggaacttctgtgggaggccaggtgcacaaagtccggtttgttgagctacagatgcccgccagcagttgctgttattatagactggttgttctgatttgtcaagaaacccagaacaactgtttttcttctttgcagtggatgtgtgtgcacatgaccttttgagaacatatttcctgatgtggtggaggcactgatgttcgtgcagactagctaagttaaatcttcatttctttcagctgaaattgcctggctgctcctttaagaagtgcactgtgtggagttatcatgtttctcatgctgttaaatgtttactggcaatcctgtctactttagcgtattgttgtcaaatgacaagggagtcccctgtcagagagcaatgacacagcctgtacttttgggggcagccagcgtccgagcgtttccacattcattcttacgcagttggtaggctcaggatgtttgtgaacgccgaagggtgtgcgtgcaccctggagtgtggagatactagcatgctatttaatgatggccaccacgggacgtgcgcactcattcattaagctaacgttttatggtttgttgagtgaaagcaggcacaatggtaggtagtgggtactggagcaaatgactgcaccggccctcatgggacttccatttcagtggattcaggggaaagcagcacgtgtttttgagagaccttggcaacgcaggcgaccttgacgtcgaccaaaagaagagagatttggaatgcttgttttacagcctccggtcaaaaaaaatcatatgggaccctttattgcagactggaacatttatttcaaggtctcaaattaaactagaggaggccaggcatggtggctcacacctgtaatcccagcatgttgggaggctgaggtgggaggattgcttgagcccaggaatttgagacctgtttgggcaacatagtgagaccccaatctctactaaaaaaataaaaattaggctgggcatggtggctcacgcctgtaattgctgcactttgggaggctgaggtgggtggatcacttgaggccaggggttcgagaccagcttggccaacatggcgacaccccatctctacttaaaaaaaaaacaaaacaaaaattagctgagtgtggtagtgcacgcctgtatttccagctacttgggaggctgaggaactagaatctcgaacctgggaggtaaaggttgcggtgagccgggattgcaccactgcactccagcctgggtgactgagtgagacgctgtctcaacaagaacaaaaactaaccagttgtggtagcacttgcctgtagtaccagctatttgggaggctgaggtgggaggatcacttgagcacaggagttggaggctgcagtgagtcatgatcataccgtggcattccagcctgggtgacagagcaagaccctgtctcttaaaaaaaagttaaactagagtagataaatgagcaggcatagttgtttgctgatcattcaccgttgagacaatgaacagctcgttaaataaattgttggtaacaatgaaatcaggagaatttcaatcctgagtcagtgtacacaatacaaggcacaaaacgttgagttaaaggtggttctactttgccctctaagcattttattgacttcaaaacctacaaaggcggcgccatggcatataggaatataggaataaggcatataggaataagaagtttcaaaaagtttcataaaagttgtatttggggctgggcatggtggctcacgcctgtaatccctgcgctttgggaggccaaggtgggtggatcacttgaggtcaggagttcgagaccagcctggccaacatggcgaaacgccatctctactaaaaatacaaaaactagccgggcgtggtggtgcctgtaatcccacctacccgggaggctgaggcaggagaatggcttgaacctcggaggcggaggctgcagtgagctgagattgtgccactgcactccagcctgggagacagagcaagactctgtcttgaaaaaatagaagtaaaaaaagagagagagaaaagcaaattacctgaaatccagaaagatcagagaagggaaggaatggctggagtaagtgttgatcagcggacacactcaagggtttcgtaatgtgctcgccctgccccaggcatcaagggaggtgctcactctgtgcactctgaatcccaccaggggcccacctgccaccctgttctcacctgtgaccactcacggcagccacaagaggcacaggtgttaggtctgccccagccacaacacctcagcacgtggtgtgtggcttcaaccaggtcaccgtgggcacactgggaggggagggcttctgtgcggccacgcttaataaacagtctgcctgggaaactgagcatccaaagtgccctctgaaggagcgggatgctgctgcccgtggtggctccgtcacacgcattctggaaggtacctcccggtaagcaacctgatgtttcatctgtcactgttgatgcatctccatgttagagaattaagcatatggaagcaaaacacctcaggaatacagaacgcattcatgatcaccacggaaaatcaaatcaactcaaagtccaaatgcaactttttttttttttctgagacagggtcttgctgtgttgcccaggctggagtgcagtggcacgatctcagctcttagtagagatggggtttcaccatgttggccaggctggtcttgaactcctgacttcaagtgatctgcccgccttggcctcctaaagtgctgggattacaagtatgagccactgtgcctggcctctcttttttaaaaaaaatagagatgaggtctcgctatgttacccaggctggtctcaaactcccggcctcaagcgatcctcttgccttcacctcccaaagtgctttgattacaggcgagcttttctctttttaagccaacttgtgagtagaatcattcacttgtgcctttagctgttgtctctgtgttgaggaatccagagtccagtccttctagacttatctggggacccgagtttccttctgtagagttaaaacctgttgcatccatccccagtccctttacggcacctgtgtaggcctgtagtggagctggcttttgtcctttgctgtccctggctgagccttggcctcatcttgggccagcgcctcctcccctgggctgctgtgatgtgttggcatttcctgggtagagtcttgtacttgctgttttctcctgtctcagtcttttcccccagggacctggcatgtctgtgtgttggggaccctttgctcatcttacacactgaggacaggcaccttagcgcttggtgccctgggatggaacagccactggacagccagccctgtgccctgtgtccactgcaaacctgatcctgttttttggagcccttcacttggcaatgagaccttcatgggtggggttactgaagcaggagttggtttaagttaaataccatcagccgcaaagctcagaatggatgatgaagtgctttaggggttgacagggcagagctggctgtagggagtgatggagagaggctcccaggaggggaaccctctgacgtgggagttaaaggactggggccatttgtcgtggggggatgggagcagtggcttgggaagggacagaacgggagcaagagggccttgcgcactgatgcttttgaggactgaatctgaacgggagagtggggagagggctggaaacctgggcgagaacaggagaggagaggcccctggatgccagcagagctgtaggcatgatctgggccatgccctgggagacgcttccgcaggagatggtgcggctggggtggagacttcctggcttccgagggcgggcgagggggcaaagggcctggggcatggacttgggcaggtagcaaaggccagaaggagtgggagtcattccacctgggatgtgggaatggctggtgggggcaggtagggggagaccaggatgagccccatgtgcgcgtgacctgtggcagaggggctgtgtcagagccccggctggcgagaggagcatcactgtgtccagaggacgcggtgcctttcagaccccttgagtaagagacagagtgggtctgtcctgtctaggctgagttttcattgcccagcacagtgcctggcacacagtaggtgcttaataaacacgtggactgaacacaagaggttgaggggaaaggtcggaattggccacaggtctcctaatgcctggcatgtgcgtcaacgcatctctgaggatggaatttaaaggcaagagctggaggcccagggctgaggctgtggggtgagcacagcatttgcggggcgcgggaagggagtggctggtggggcgggggagggaaaccagcacgttagaaggtcagccaaggtcaggcggccagcagggcgggaggaggcgttggtgtgcacacgcggggagcctccgtgtcctcaggacaccatggaagacggcaggacacacgtgcgagccacagcaggtgggcgggagctcacaggctgcagaggaagcgcaggggaggcgcaggggaggccaggctctggcatttcccaggaatgtaaaccccggtttcagctttccccgtggctcccctccgccaaatcttaaatcctcttgttaagacgcgctccgcccctgtgtccttatttcccaccgtggtgggcagcttgtctgccatccccttccaggtgccccgcagaaccaccacccttgggaaggcggctcctcgtgccccccctcttgtgccttccctccccagtgccttttctgaccccctcctgagaccgcctccctgtgggccatttgagcacctgtagctttccatccggtgtcttcacccctttgctctttgtagctgtctcaccccgctgcagcttgtgaggccatgcaggccctgatgtttagtgttttttttgtttttttttttttttttaaagacagcatctccctttgtcacccagaccgttgtacagtggcaccatcctagctcactgcagcctcaaccttctgggcataagcaatcctcccacctcagactcctgagtatctaggactacaggctcttgcacccaccacaccgggctaatttttgtattttgttgttgttgttgttttgtggagacagtgtttcaccatgttgctcagtctggtttcgaactcctggcctcaagcaattcacccgccttggcctcttaagtaccgggattacaggcatgagacattccctaatgtttagttttaaagagggggtggtgctatttatctccaggctcaaagcagggcattctttccttaggatctgcgatactccagtcaaggctgtttcttttctgccttttgtaaaactcttgtctagaaattaatggatgagggaagctagggactcttctcagattatttcttgtgaaaacctcaagagtctgaatttacagggaaatcttacaattagctcgatgtggattacagagcggcaaacaaccttaagtggtagagctggttctgcaagatttttccaaccctttgtggtctagttttcatttttccccttttaaagttgttttcagctaaagctgtgaggacagtatagagttttgccttgtaaaattggtagtgagtaattttagaatagatgcttatgaagtctgtaaataaatagtaaggcgcctcgcctagttccacgcacatgtcagtttcgtaactatctccccaagctgagctcacctgccagtgccttggatggacctagccaccaggggctgcagatgagtaggagagcgggtgttgcccagagcagggcggacacccctgttccctgtcatgttttcttctcaaaacctgctgcaggccattggagagcattcctgttgctctctgcacccctctttctgaagcattttactgtgtgatcctagcatccgtggttcaggagatcctgctacattttcctgactgccttgctctgcccgggaatacctggcttatcagcagaatacaggcctctgcttaactgaatttggtcctgtagtgaggactaagaagtgatgtactcagttacatgataattctaaaaaataaaaaaaagcctttttttttttttgttaacacccatcatagtggcagaatcttaagtctgcatgtagagggggttggcagggcagtagaagcagggggccctgtgtcctgttggtagaagagtgagcagaatggccactggagagccacttggtggaggtgcctgcagcacagcgagcagcctccttcccagatgaagcatgcatcttagaggcgaccttgggcacgtgcacagtgagacaggtacaggagtgtctgttgtcatatattccatgggagtgcaagagccggaaggatgcagatgtgcatgggtggtgctggcccccatcaggtggcatctagtagaagtaagtaagggtggtggtggcatgtgtggtcaccttgccagcgtcgcctcgcacaggaaagggctgttgaaaatttgtgggccgggtgccgtggctctcgcctgtaatcccagttctttgggaggccaaggcgggtggatcacctgaggtcaggagttcaagaccaccctggccaagttggtgaaaccccgtctctactaaaaattaaaaaattgactgggcatggcagtgtgtgcctgtaatcccagctacttgggaggctgaggcaggagaatcgcttgaaccccggaagtggaggttgcagtgagccaagattgcaccactgcactccagccttggcgacagagcgagactccatccccccaaaaaaaaaaaaagaaaagaaagttgtgtgcagcgtgattctgtgagttcaagatgcaaagcaatgactttacattattaaagatctagcagacatagaaggatattttatttatttgtttatttatttttgagacagagtctctctctgttgcccagtttggagtgcagtggcatgatcttggctcactgcaacctctgcctcttgggttcaagtgattctcatgctgcagtctcccgagtagctgggattacaggcgcccatcaccacgcccggctaatttttgtatttttagtagagacggggtttcaccatgttggccaggttggtcttgaattcctgacctcaaatgatccacccaccttggcctcccaaagtgttgggattacaggcatgagccaccgcgcccggcccatagaaggatttttttggggggaaagaatctgtaaagtgattattttggaggtggagaggagaaaatgagactaaagaagatagagtgggggcttctatgattttttttttttttttaaatagatatgacaaaatgataaaatttggtaaagctatgtgttaggtacataggaatttatacttttctgtatgcgtgaaatattacgaaaaaataaagccacatacactatctgtttttgtgtgtgtatgtgtcaataggatttaggccttttttgcacttctaggttaaagttttcaagatgagggtattttttccccctctctgttagagaatactaaagttatgttggttttattttttattttatttatttacttagtttttacaatgtaccattttaatcatttgggtatcctttttaaaatctctgagcttttttattttttattttttttgagacggagtctcgctctgtcacccgggctggagtgcagtggcccgatctcagctcgctgcaacctccgcctcccaggttcaagtgattctcctgcctcagcctcccgagtagctgggattacaggcatgcactgtcatggccagttaatttttgtatttttagtagagacggggtttcaccatgttggccaggatggtcttgatctcctgaccttgtgatcctcccatctaggtctcccaaagtgctaggattacaggcgtgagccaccgcgcctggcctcagcttcttttttttttttttttttttaatttttattttaagttccatagtacatgtgcaggatgtacaggtttgttacataggtaaacgtgtgtaccatggtggtttgctgcacctaggtattaagcccagcatgcattagctatttttcctaatgctatccctccccccaccccatatgttttattttattttttatagagacagggcctcactatgttgcccaggctgatctcaaattcctggcctaaagcgatcctcccacctcagcctcccaaaatgttgggattaccaagtgtgagccaccatgcctggtattatgttggctttaattatatttgtggaagaacttctatgttctctttccttattttaaatattgggagatagatgaaacattttaggtttctctacatttgaagaagaggtatattttcttaggttcttctttttgtgagacagagtgcagtggcacgatcttggctcactgcaacctccacttcccgagttcaagcgattctcctgcctcagcctccggagtagctgggattacaggcgtgcactaccacactcggctaattttttgtatttttagtagagacagggttttgccatattggtcaggttggtctcgaactcctggcctcaggtgatccgcctgcctcagcctcccaaagtgctgggaatacaggcatgagctaccgcgtcctgccaggttctccttttgatagaataatataggtacttgcctctgtttctattcagtatcagtgaattatctacaggaaaatgaacacaggaagactgctgaagtaaagaggcccacagtgcctgcattcccttgcctcatgtagtcttagactattcaggatgctttgaaaagagtaaactgtaaatcatatttcatattctttgggccaggagtctggaatggtttcatattgcctgtgaaacaagagatgcttctcagaatgagatttctggcttaattgaattcggattattgcaggcaggatgggagtgaaatggtacattcctttcatgccagttgtggagaggatctccgtgcaggccgttgatagaataatatcctgtgcttccttggtgtctctctctgaggaaataagggcttaatatgtcctattcaattaatcctcaccgcatccttaaaggtgactggaaggcagatagtattaactccattttacttaaaaagcagcggaaacatggtgatttggaactccctgggagccctcgaacttttctctaaactccaccggtagctgaggagcaggacacacgcacagaggaaggacatatttatggcgcatcgccttggtgccaggcaccgttgggaactttttaggatcgtgatgtctttgaattctcaggacgtttctgcgaggtggtgggcggtatcatcctggtttttcagggagaagtcaagtcactggcccaggtcctcaagctggccagtgtggcccggtctgaccccgaggttctgcccgggtttctgtccctccagcctggcatcgtgaactcaggggaaacagatggggaatctgttgttgtaacaaagattctaaggatttgaagcaaaatcaacacactcagttgtagagggtaccacgtggttgataccattgaagacaattgcacctaaatgaaataatttgatggcgtggagtccagtttcagagcgtttgcatcacaccttctgacaccaggctggggggccgcctgtcccagagcatcgaggacagacaccgctgctgttagacctcattccacccctttagtggggacccaccgcgcgctggccgcaagcctattttaatttgtaacaattctgcttgatgacaggaagacgtcaaaaaggagaaatcaggctaactggggctccttgtccacttggggggcatgtctcagtgtcttgcctggggccttgtacacaccctctcttaccgggagtaaagtgaggtttagaaagattacctttgtcctgggtcattcttccttaaatcacagctaggatgcaaacccagacctctctgatgtcagtttgcaagctctttcaggtaccgtcagccacatgccaggccttcagtggggtgatgttttttgttgtttttagaaaatactgctattcactcatgggaaatagggacgagggcttagatttcagctgctttgcattagacaatgatttctcttattataagcagagctctctattaaccaaaaacacttggctgttagacatggtgtttaattgctgttagaatgtatttttgtcacactgccctataataagccaaagaactgtttgtgccaaacagtgaagggaagctaggggaggatgaaaactgtgcctgctactccacctcccttctttcgaggtcgtggtgttttgtttgctgttttagctgtggtgtgtgtgtaccactcgtacctttcacaggaggacacctcatctgaataccagtcaggacctgagacgcgttgagcccctccccacagtgcccacgggtaggtgcgccgctctctgccccttccgggagctctgctttttctacctttagagatttctttcatcctctattacgtaggcctgactttttgcctaataaaggaaaaacaaccatctatttagcactctttttttttttcccaaaatggaaatgactttctctctgatttttacaaagcaaaaaatgagagtaaagattaagaaactacaagaaattatggtgaagggagtaaagatggccatgaatcctatgactgccgatggtttggtcccaggatgcattattcagatattttctccctgtgggcttatgtaaacagaaagctaggtgagtggaagtaacacgtcaaatactgatttgtggctgggtgcggtggctcacgcctgtaatcccagcactttgggaggccgaagtgggtggatcacctgaggccaggagttcgagactagcctggccaacatggcgaaaccccatctctactaaaaataaaaaattaaccaggtgtggtggcacacgcttgtagtcccagctactctggaggctgaggcaggagagtcgcttgatcctaggaggcggaggttgcagtgagccgagatggtgccactgcgttccagcctgggcgacagattaaaaaaaaaacaaaaaaaaaacctgatttgcaacaattttgtgtcctagcctagagtttaccgtgctattgaaaatatctttcggctgggcgcgctggctcatgcctgtaatcccagcagtttgggaggccaaggcaggcggatcacgagatcaggagatcgagaccatcctggccaacatggtgaaaccctgtctccactaaaatagaaaaaattagccaggcgtggtggcacgcacctgtagtcccagctactcaggaggctgaggcaggggaatcgtttgaacctgggaggtggaggttgcagtgagttgagatcgggccactgtgctctgacctggcaacatagcaaaactccgtctaaaaaaaaaaagaaaaatgaaaaagaaaatatctttcaatgatagttaatatatatatacacacacacactgtatttgaagtgacatgttacatggttttccactatatgatttctcatatttcatcaaattgatcctcttgaactcctgacctcaagtgatctgcctgcctcggcctcccaaagtgctgagattccaggcgtgagccaccgcacccggcctctgatctttttttcatctttttcctagtttctgacctcactaccactctgcaccacgttgggatgggtatccttgtacatccgtgcagcttttctatgatttttaatgtctgattattttcttaggttaaatttctaaaagtagaagtgaacagcgtgtgcacatttttatgactttgggtacatttcattacattactttccagaaaagttggaacaattcatagcagtaactgcactgaatttcttgtattacttacctatttttaagcaagtaatataatctcttggttccaaaaacaaagcataaagaaaagtctcctatctgcctacctccccacccactgttgttgattttttggtgtgtatccttccagagtttcattatatacacagaaacaaataccagtgtcaccctcctttgtatgcacatagtctagcatgccatgcacactcttgtgcaagtggctttttattttttaaaattaacaggccaggtacagtggctcatgcctgtaaacccagcactttgggaggccaaggaaggcggatcacttgaggtcaggagtttgagatcagcctggccaacatggcaaaaccccgtctctactaaaaatacaaaaattagctgggcatggtggcgggcacgtgtaatcccagctactggggaggctgaggcaggagaatcgcttgagcccaggaggtggaggtttcagtgagccgagaccgtcccactgcactccagcctgggtgacagaacgagactctgtttccaaaataaataaataaaaattaacagtgtttcttacacttttcaaatcagtacattaaaatccctccaattgtgtgtgtgtgtgtgtgtgtgtgtgtgtgtgtgtgtgtgtgtgtgtttattaaagcgacaccattgttcaatgatatgaataggtatattttatatacttggttccattttgatagatatttgggttgcttccttgaagaatgttgtgcgtacaccgtttgacacaggtgcaagcttatctgcagggggaagccgatttgcaggactcattcctatagggagaggggccaggcccagggacttaagtgtttgtgaatttgtaggaactgccagattacccacacttagcagtttacaccccttccctccagcactggctgcagagagccctgtcctccagggccctaatgctaattctttcatgattgcactaattatatgcacaaaaggaatgcaacagaacaaaacaaaccacctggttttgtaggtgtggaagtgcacattgcagtaaggagtcaatgaaatcggttactgtgggacaggaccctcccctccccttggttattttactaacttggaataacgccacttccttgtaggaaacaggcagtgactgtcagtgagtgtgcctaggagaggggtgggtccttttagagaccaacctcgcagttagccagcaacaggctgcagcttagctagatgaaaagttagtttgagaaactgaagtcattgccgctaaggctggcaaggtgtggctggggccaagttgggggaatgtcgtagtagccggccctgtgcgcctgagcccacaattactgcgtcgctgctggggtctggcaaagctcaccttgatgcagttttgttcaaagcagtgcaatttccaagcctcaaaacagatccttttcaatacaatgtgattgtaaaaattctattaataaagagaaaaaaaagacgcaccagcggcttacaagatctttttttgtttttttttttaagagacagagtttcactgtcgccgaggctgaagtgcagtggtatgatctcggctcactgcaacctccgcctcccaggctcacacaattctcctgcctgagcctcctgagtagctgggattacaggcgcgcaccaccatgccgggccaattttgtatttttagtagagatggggtttcgccatgttggccaggctggtctcaaactcctgacctcaggtgatcctcctgcctgggcctcccaaagtgctgggattacaggcatgagccactgcacccagtcacgagatcttaaagtagaagtaactatggtatttttttcgagaattctgttagggcgagaagcccattcgtactgtgctggaaccatcctgaccctgtctgttctttgcaggaactcaaaccaatatgcctaagtagctgaaactgttgcatttcaaagccttttcaagcatatcttgaggacactgttccctgcagctgaactgaagtcttgatctgagcccaggaggagtccctggggttgtcttgttgggggtggggaagtgggaatgcttgcattcagctttgggggaccttaaccctttgccccctcccctgtccccccttcacatagctttaacatgaaagtctttctgtctgtcagatctcccctgtacaaagagtggtctactctaaaaattgctttgaaattggaatggacccctccctctcttctattttagttctagtttctagctctttaaaataatgcaacttttcgctttattgttctaaatcaatgcattctagccgttggctgtcccagttgcttccctgtggctgggagcccctctctgtggttgaggctggtcttaccattgctccagttgtcttcggccttctggggcttacttcccctgccctggaggcctgaggccagccagccagtgtggtgtgacccccctgacagtgggctctcccggctggcccagttgagggtggtcagttccttttgtggccttgccttcttgggagataaaagtggccccctgggtgccgtgcggcccgcccgcagggtccttggtggagctccagcattgattcctgcaggttcagctcctgccccaaggcagcgtccagctggctgagtggggttctcccagggtctctaagcacaggacagcctgcttctgcatgggggcgcacaggggaccgcagagtcacactcagacccttctaccacctcctgacttgtggactttggtggtgggtggcgacaaactggagtccactgggtctgtggcagagaaaggtggctttgctgggggctgggggagaggaggcgtttttggatcgcagcatataccttgtctagaattgtataaaaacctacaggaaaaggctgatttttttttaaaaaggctgtttttttaaaaacaactaaaggcacaaaaactccaagtgtgagaatatccagaatgcgtttatataatgtgcaccgttgaaaggaacattgaaaaaacaaaaaactccgaggaacaggtcattgggtttggagaagtttccttcagaaagttctcttcctgctcgttcactgtggattaaagctcgttggcaatttcggaagttcacgttcttgagactcggtgcctttggaacaatggctcacaatgaggacggtgtgcgttcccggcaagaatgagtgttgggggcttttctccttatcacccgttccccagacccctctcatcggcctcataaagaaacagatggttcatcaggaatagctcagaaatcacgttggctcctggctgtataaagagtgggaactgggatcataaacatttgaaatctcctaggaaaggacaatgattccctcaatgaaatattgatgtaaagggagcattttaaaaggcagaaatgatgaacctgattcaggttgaagctggtagtgtactttaacctttttgagaattgttaatttaaaagcaaatagaatgaaatatagactataaaagcagattaaatcatttttatgcatcctgggttttttggtgtcacgtgacaggaagagttactacaaagaagaccaggttttggaaagacggtggggttcacgtgatgaaacacaggccatgacccctttaggaattggatggaagccagccaggccaggccccccacccccaggtcctgggttggggctctgtgggcccaaggagtcctccagaaccaaattctccactaagagcaatttttaaaagagcagctgctcatcccatgtccaattagagtgagcagatgtgtaagaaacatgtctttgattgattttgggggagccccccgcagtttgatgttttgcttggaggtaggggaaacgggggctgagttacaagtattacctgtaggaataaacaattcttttgaaacatcagtagggaagaaagaaaaaaaaaggcagcttaagatttatctaaaaaggaagtggaaagttaaagttgctggagatctcattactgtctgtctcgctcaccgtaattaaaaaatgcctgaatgatcttaataacacatgattcagctgacaagcactaattgccctgtatcaggccaagagaagatgaatgttgtcaagaaaaccacaagtcagacaagctgattctctgtgagtctgacaccgtgttcccatgtacagaccagtttttactggagttcttccagcatcaaaagcagcttcttaccttcccattaattttcatcgctggcaggcccgagttgtttgcgatacactgactacctcccttgattcctcctcgctggctcaggagcttgggtctgcagacaaaatgtaaatatgtttcttgctcttatctttgtcctttttcagggaagaaatctgttcccgtccaatatgaatgccctggtgggcttgtcagtaaattacatggtatttgggaattgattttctgacgccaccgatttgtcaagaacttatcctgccttttcagcgatttgacagcacctgttaggctgtagggccatgtgattgggcagttctcctgccgagaaaaaggggactgatgactttctgtcacttgggcatccagaaacctccttgaaggtggaggttattgagggaggaggcaggagtggaaaaatgctattggtttattcctgtgcttttatagaacagccgaaccattctatggcaataaaacagaatcacagggcaaggtgcagtggctcacacctgtcatcccagtattttgggaggctgaggcaggaggatcgcttgagcccaggagtttgagaccaaccttggcaacatagtgagaccttgtctctacccaaaaataaaaaaaaaaaatcagctgggcttggtggtgcacgcctgtagtcccatctcctcgggaggctgaggtgggaggatcgcttgaggctgggaggtgggagcttgcagtgagccatgatcacaccactgcactccagcctgggcaacagagtgagatcctatctcaaaaacaaacaaacaaaaaaggaacttgtttcctagcaagaagcagatgaggctggtgaataagcataccacataagtaagtaatccactaacttagggaatttcgtgaccagtcactcagcacgccctgttgcgaaggggacggctgaccaataggatcatctcagagtcaccctcacacaacttggcttagcctagttggcaaaagtgtctcttcagagacctaccctcctggaattgaaataaaatgaaaatttgtgatgacgatcagctactgtcagtgtgacttaggtgtagaaattaaaaaagaaaaaaagaccactctaaaggcatttgtgcatgaagacacctacagaaataaagccggggtgctgttcttggtcttcattcaggctagcacctctcgtcaccttttcactttggagctcagggcctggttcactcagcaagtgagcggctcacacagtagatgctctgcacatagtagtaggtactcagaatatagcagctgttgatgtacatgtttccagaggggccaacacaggaatctgcacgtgggtccttgctttaagcccagcccctctctgtgggcgtgggatggagtcttcctttcttggtgaccggcgccctctggggtcactggaggcctggacttccccactggcccagtgaccttgtttccttgttccctgtctcgcccagccttggctgtcctgggatttgaaaatctgggataaagcctttttcgggcctctaaggccctgctggttctgcgtgttccagagagctgcacctctgggtggtgagctggcctttttggcatttgatttatgtatagccctgagtcactgggagcggatctagagtccaggccagtgactgatttcaaacgctaacactcttggctcgggctcaggtttcaagtcagcctccaaaggggatgtttgctcatttcgtcatcttcctatcacagcaattttcgtcatatggaggggtggcactcatgtaccttgatgattattattcttttaaaaaatgaagttatttatgttatggggtgagttcgtcacacagtccgaatgtggaatgttgccatccttttcatcccaatcctgccagtgatttctgtttacaatagaactattgacattgtatggggatgaaactagcatgagatagtaattgttggcttgcctgagattttcatcatatgtacacatagacaaaacctggctttagttcctaaagctattgctgtttattgtacttttattagccaatgttacagatccccgtagcatgccagaggctattaagaaatacaggggtcgggggcaggaacgaagtccctggccatggatcatgcaattgatctatagttatttttttttctttttctttaatttttttttgaaattttaaattattattattactgttttttgcgatggagtttcactcttgttgcccaggctggagtgcaatggcatgatctccccctcccaggttcaagcgattttcctgcctcagcttccggagtagctgggattataggcgcctgctaccatacctggctaatttttgtatttttagtagagatggggtttcaccatgttggccaggctggtcttgaactcttgacctcaagtgatccaccgacctcgacctcccaaagtgctgggattacaggtgtgagccaccatgcccggcccaaattattattattttttataagataggatcttatcacacaggctggactgcagtggtgcaatcatagctcactacaacttccaacttttgggctcaggtgatcctcccacctcagcctcctgagtagctgggacagcaggtacatgccaccatgccaggctaagttttaaaattttattttgctagggggtctcgctgacttgcccaggctggtcgtgaactcctggccacaagtgatcttcctgccttggcctcccaaagtgctgggattataggtgtgagccatgcttttggccaatttttagttattgtggatacataatagttgtacatattcatggagtacttgtgatgttttggtgtaagcatacaatgtgtaatgatcaagtcaaggtaattgggatatatacttatagttagcctacagtcttattgataatgttctcagaaatttctgattccagagctccttgctcctctcccataattagataacgtgtttttctgtccggtaattgctgtagtactcatttttagatggggtagggaaggccatgtgccatgttggggcctcatcccaaagaccttgtgctgtttgggacaggtaattatttaaagccccgtgtgaggtgggtgggtgttaaactcatgctctccacaccttcccagagtgcctgggaaagcaggcttctctaagaaagtggaatagcgaataggcagtgatccctgagagagatacataatgattgtcagtttcatggattacagataattccgtttaatgtcctctgtttttcctttttgcaaatttctatgcattatatagaacattgactttagcatagaaagtgctaattcttgatttggcactttaatggatatttacacagtgacaccataaacattggataaacagaggatttgttttaatgagatcttcagtgatttgaagccgtttcccccttgccttctggaatccccggctccagttctgcctggttttggtgatgctgtcacagtggagggctgactgcaggcctcgactgtgagccctcactcggccaccttttcatttcctcgctgggttccaggctctttgaagcactcgcctcctcccctccctgcatgtcctctgtagtgcctatttctgtgatttgcatatagcggaaatatttgttgaactgaattatttttacacacaagcctttcatgtggccaacattttgaggtctgtctcctttggcgggagtctgggaggaatcttccagttcactaagaagtgtttgatagcttcagggcaggcgtgccctgattggggctggatgccctgcctccatccagaggctctctggccaggaggggaatgaaccaagtgcccagattcccccctacaatgtttatgcagaggtgactgtcacctgccaatggtgacagtccaccagggaagtccagaaggcctttggattaaagctacaggagaggcaggtccccttgcagggtcagaaggggaagagagaagagagagagaaccaaaggtgggaggttcagctactcgggaggctgaggtgggaggatccctcaagcccaggaggtcaagtctgcagtgagctatgattgcaccactgctctccagcctgggcgacagagcgagaccctgtcccaaaaaataaaaaataaagatggaaagatgggaggattctccccaggaaggcccaggccgcagggtccccttgtccttaaaggccagctcagtgaggctacaggtccccttgccccagttccccgagcacagagcaggcatggcctcggacgacttcctctttgtgtctcgtggactactcaataaatattaatgttttccaaagatatcttgcccagctctccctgacgaggctgttggcttgaaggaataacaacactcgttgcactcacggaatattaagtctgtgccagggcctgttctgagctcatgacttgtgctactcggtctctccccacaagctcacagggcggatgctattttcaccgccgtttataggagaggaaactgaggcacagggtccttcagtgactggcccccatgagcaggcagcacatctggaattccagcctgtgcagcctggccccaggatccccatgcctctgtgggggacactctggaagtgacaggtgaggcacttctctggcctctctggatctcctgctggccctgaatgtgggtggttacccttttggggtgctgtcggtgcctcttagatgtctcagtgaccctacagggtctgccttccataggactgcctttttctttttttttgagacaggttctcactctcctgccaaggctggagtgcagtggcacaatctcacctcattgcaacctctgtctcctgggctcaagtgatcttcctaccccagcctcctgaatagctgggactataggtgtgcgccgccatgcccaactaatttttttttgtagtttttttggtagagatggggcttcactgtgttgcccaggctggtctcaatcttctgggttcaagtgatctgtccaccatggcttcccaaagtattgggattacaggtgtgagccactatgctcggccggcacccacctttttgtggacttttctttgttgacttggcattcggcaaggtgtaggcttttgccaccaacacgatacccgtggggagaagccccctggcccccgtgcctgccagaagaaaggcttagggtcccctgcgaggacccacacgtgcactgcatgcctggatagcccatgccagcctcactgaggctggatttagttcctgagtatgttatggagaagtgcccagagcagggaccgcaggcacaaggtgggcctggcctttggaggaggctgggcacggccacctgctcctcctctctcccatgggcaggttggccttgttgccattggaaactcttgagagcccacgggtgttttctggccatgtgacctaaatgggaggcttgctgaagggtagatgctgcttcaccagcaacaagaggagcccccagacctcagccacaggatggcccccaccctgctgagcccccactcttcgctccctgctcagcagagcaacacataccattgcccaaaggatggaccaggcacagcgtggggcccaatagcaaatgttctgacgaaggaggtcagtgccggacactgctgggcgttgttgagtcctgggctggcagggacagttttgcagggacggtttggaaggggctttgctggggagggggtctctaggaggggcagcccctgaatagggcagccgagttgctgtgactgcatcttcctttctttccgatgggggcaaaactcactcttctttttaaccattctctgttatctgtttttcttttcttttgaaactttttttttctttctttttttttagaaagaggatcttgctctgttgccaggctacagtgcagtggtgtgattatagttcactgaagtcttgatctcctgggctcaagcagtcctcctacctcagcctcctgagtagctgggactacaagtgtgagccaccatgcctggataatttttattttatttttttagagatagggtcttgctatgttgcccaggctggtcttgaactcctggcctcaggtgatcctcctgcctcggcctcccaaagtgctgggattacagacatgagccactgcacccggccatgtcctctttttctgattcgggaggataagggctccccatgacactggcatcagcattgggagcatttccgtgaccccagggctgctgatacaccctgtggacagggcaggacccacagctaagtcagtaaagcaccatcctctgggagtggctgtcatacgacatttcttgcttttaggaccattggactgaaaaaccaaatcctgccactggatctggtgatgacggtgacatttttttttttttttttttttgtttagaagcttatgattcatcggatctcttttggtttacggaaagcccagatgtcgtggtccctctgcgtgcccactccaggagaacgcattcaatgtcaaggaaccctgtagtgtgcaaagttggatttagggatttcccgaataaagctcactgagggtcaatgagttccataaacattattgaggccgggtgtggtggctcacgcctgtaatctcagcactttgtgaggctgaggtggggggatcacctgaggtcagaagttccagaccagccctgccaacatggcgaaaccccgtctctactaaaaatacaaaaatctgggtgtggtggcacattcctgtaattccagctactcgggaggctgaggcaggagaatctcttgaacccaggagacggaggttgtagtgagccgagatcgtgccactgcactccagcctgggtgacagagtgaggctccgtctccaaaaaaaaagaaaaaaaaattattgaatgtcttccttgtacctgacactgtgctttatcccatttaattccactggataatatgttaaattcagacttgttcgtagatttatatacatgtacatatccctcttaatacattggtttattctgtttctccatgttcataccgccagcctgatgcctcatttgcacaaatgaatggatgagtgaatccagcttattcttttatttctccctgggatctggtatacaagagatggttattttttaatttgagacagagtctcactctgtcacctaggctggagtgcggtggtgcaatctcagctcactgcagcccctgcctcctgggttcatgtgattctcatgccttagcctcctgagtagctgagattacaggtgcacaccactatacccagctaatttttgtatttttggtagagtcagcatttcaccatgatggccaggctggtcttgaactcttgacctcaagtgatccacctgcctcggcctcccaaagtgccggaattataggggtgagccaccacaccttgccaagagatggtcattaaagttgaattttggcactccttgcagaaaccctacaaagttggtatcacctctattttgcatatcagaaaactgatgctggccaggtgcagtgactcatgcctgtaatcttagcactttgggaagctgaggcaggaggattgcttgaggtcaagggttcaagaccagcctgggcaacataaccagaccccgtctctacaagaaaattaaaaaatgagttggatgtgtacctgtgatcccagatacttaggaggctgaggtgggaggattggttgagtcctggagtttaaggctgcagtgagctatgattgcaccactaaattccaacctgggcaatggagcaagaccctgtctcaaaaaaaaaaaaaaaaaaagtgctgagagagatcgtttcccgagggtctttggatagtttgtagaaaaacagtactgttccttctaaagccctgtggctttttccctattccaggtgcacattggcctttgaggctggaaaacacttttacttacttccagctttatgggattcataaaatggccttgagaaaagtaaaccgatttttctccttctaaaaacatccagtgggccgggtgcagtggttcacacctgtcatcccaacactttgggaggccgaggccggcggatcacttgaggtcaggggtttgagaccagcctggccagcatggtggaaccccatttctactaaaaatacaaaaaattagctgggcctggtggtgagcacctgtaatcccagctactcaggaggctgaggcaggagaattgcttgaacctgggaggtggaggttgcagtcaggcgagatcacaccgctgcactccagcctgggcgacagagcaagactatatctcaaaaaataaataaacaaataaatacatctggtgcaggtaaagtgttcaggaagtaatttcctggaagagggaactctgcagttgcaaatgcggccttcttacaagtcgcttgtagggtgttgaaactctctcgcgatcccagtgacttgagatgctctgttttctggataactaagcttttccaccttcactacggggtaccagggtctttgtagcagagaggcagctgtcttgatggtggaaccactcccgccagtgtgtggtggggtgcccccggggatttagggagagagaaggccagtggcagggactggctggaggaagagggtgcgaggaaaaacactggctgacatttgaaggaacgtgcttcagtatcagggaaggccagcgtgggataatcggtgtcttggcagatggggttgacggggagccctgaagccggcagtgtttagagattcaaagaataggggggctgtggggagtcttttggttcacagcagtgtcccccaaaccggcacagtgggatgagagtgggctggccagggaaggggacagggtgttaggtccagaggtgctaaaatccccaaccatggtcaaaatggggacatgagagactcggggttcagagctcacatgaaggacagctgtccccccctccacccccgccttgggtcagagctggctaggagagcccaccctgcagcctgtccttcgtgggaatcagcatgaggggtgcaaagtgctcagcaaggcccggcaccaggtttgttcttgggatcagagtgatacacgcgccttacattttttttaagctgctggttttgcgggtcagtacggggaaaaacggtgagtcccttttataaaatatatagagaggttggtgcgaaaatagcagcttgtttctgcttgcgtatttctactcactgctgggacacaaatctacccttccattttctgaattgtattcattcaaactctgatttaacctctatttagttaatgaattgggcaagttaacctcgaactcttccaggctgtggctgttaccgtcaccatctcctgcttctcactttacacactcatatgagaccttttttatttctgaagtgtggcctgacattgtttaggctgttgtttggtgcttatttttaactcttcttttgtcacttaagtaggatgtcttaattcttgtttagtgttagatcacttagcaggattttttttttgagcgggggcggggggaatatgattttgtgtcacattttgaatacttctctatggcagtatcttttagagttattatggaccctgtaattctgttctcaaagacgtttaaccactagaggtagacaccaaaaatgttttatttgtctcatttgggactctaattcagtgaagttggctgtttggagtctgagactggatctgtttttttattttgttttgttgttgttttgtttgttttcagacagggtcttgctcttctgcccaggctggagtgcagtggtttgatcacaagtcactgtggcctctaacttacatgcttaagcaatcctcacgcctcagactcccgagtagctgggaccacaggtgctcaccaccaggcccagctgacttttgtattttttctagagacaaggcctcataagtagttgtttcccaggctggtctcaaactcctgggctcaagtgatcctcctgcctcagcctccccaaagtgctaggattataggcataagccctcacacccagccaggactggatcccttgactcacttaatgatcggggtttacttctgacctgcatggggtgctgtggggaacccagagatcaataagacagcccgtaccttcttggagctgtatttagcagggtcatagaagacgcactcataatcagaaaccatccagaatgtgacttctggccagggagaatagggaagggttcatggagatggtggcatttgattgaattctgaatttggggttgtaggtttcaaatattagtttggggacagtcatccttttattttcttctctaaatttaaagaaattgttatttttaaaaaccaattggaatgggtattgaatttctgtgtggagaatgtctaccagtttttcatcattttctccactgtatagtgtcaataagtgttaaatgcaatggtctgtaagactttgttgataattttcttttctttgacatagacttgtaaactggaaaccctgtgtgggtaatgggcagtgcctatttcagcatcttgtccccagaaatccactccctaaaaggcttgttgaatgaatcagatctaggagcatctcttttgtgttggagcggagagtcagtccggactttgagcctctccttgcactgaccagcggcaggctgaagacagttggacttaagaaaacttaatctagaagcaatatgctggtcagattctttcaatgctaggtttagtatcgttcctttttctcccatttggtgaagtggtgtaatgctttagcacattttaaataagattacacaagcggctgttagttggcatcaagaatcttttaatctggaaagaaaatgttacctccttcatttgcaaaacagagtgtttctggcaccgtatcccaaagtgtcttctggttgttccgtttttcagaagttactgtgggcttctaattaccctcatttagacatccaggacagaaattgccacttcaacaagaaaattttgtaatgagccggaggaaatggtctcatcattactacgttatacgcagtctgagagtctgcgtggatttttatttcacaagaatgtgactgtttaattgaaaaatgttgttaaaatgtgctttctgttcctatcagtatgttgttagtgcttatatagccatgctcgagtcagtgaaaattggtgccctttgccaaaatactttttttcatttttgtgtataattttgtgagctaggtctatttttgtttaattaggccctgcaagagaatgagggagagctgtatttaaatttttagaccattaaagggcctaaaactatcctagatgaaaggcccccaaaattagctttaatatttattatatgaataaaaccaatagggaaaacgtttccagaaaccctttctctttttccttcttcagacagctggctaagattaattgcaggcctgaacgtgggcatgtttgctagtttctcttgttctattactagaaaataactcttaagagaggagagaaataccgtcttcttgtatttggggggcaggctgtacattttataactcactaatataatgaaatgtttgttgataacatcatattttgctttctgatagaaaagtcctaatttctattttctttttactttttatttttattactttttttttttttttttttttttttttaaaatagagatgagggcttgctgtgttgcccaggctggtctcgaactcctgggcttaagcaaccctcctacctcagcctcccaaagtgctgggattacaggcatgagcaactgcgcctggcaagtttgttttactttttatttttattactttttgtttctaatttctactttcgacaggattccttttaaaattttaatctaggaaacaaaactgcacgtgaaagatttgccttgtagacggaaagttctggaaacatcagctccaggctgtggtgtgaagctgtcgggctgatttgcctggtaagaagcgcgtttggggcacggagggtcaccttgccccctgcgagcgttctttcatcatttgagcagccaagcatcccttttgggccaagtttgccaaagactctaacgtagagaagtggacagacccagttgcatgctgatgttaggggcagagagaaagaaggaaagatccttgcctagcttaagcccttgtgcttcttccccacatttatttgacttcccaaattggattggctgttgtgattgaaaagattgtcagcactatgtaaatgagaatgagaagtaaaagtgcatctcatgcagataatttctatgtagataatttgccataaaaatttatattgcagtccttaaaaccttcggagatttagtctgtctagggaaaggtgatttatacggcattaaaacactttttatgtcccagtcctttagatttaatgtttattgcctataaaaatgaaatcttcttgtggatatttaaaagttttggtactgtgtgaaatatatattcaagttagaaatgctttggagatgttgtaaataagtggcaaatctcttgctccaaagtccactgtgttgtctgggcccgcatcttggctttgcacgcctgaaaagctgcctcgggtaccggtgtctgatcatcaccatagtgggtcgccaagtaggagaatgtcttatgtagggatttggtggtttttcaaaaaacttaaattagctaacaaggatgggactattataattcctcagaaagttatgcaaggtctgaccagaatttcattccaatctgcagaaagactgaattatggtgcagtttttttggttttttgtttgtttgttttttgagacggagtctcgctctgtcgcccaggctggagtgcagcggcacgatctcggctcactgcaagctccgcctcctgggttcacgctattctgcctcagcctcccaagacgctgggattacaggcgcccaccaccacacttggataattttttgtatttttagtagagatgggatttcgccgtgttggccaggctggtctcaaactcctgacctcaggtgatccacccgcctcggcctcccaaagtgctgggattacaggcgtgagcccctgcgcccggcctatggcgcaggttttaaagagtggaagtgctttgacaatggaatgcccagtacaaagcagtttttaggcttttgcagccactcagattcataacagcacgcttcaattctggtcttaaataaaactctcatggagtaaataaatcatatggtggggacagcactgctgtggaggagggtactgtttaagcattttgggggttcctgaaagatgtttctcaaagtgagcgctggagaggagtacctggtttgattgttgaactaaagtgtggtttctgtaaccctagggagttcttccctaggtatgattgagctccctgagtgctgggatggtgacctccccagcctgtctccaagtctgagtactggtcggcttcctagactccttaaaacgctgggtattttatttaattaatttatttatttttgagatggagtcttgctgtgtcgcccaggctggagtgcagtggtgcgatcttggctcactgcaacctctgcctcctgggttcaagcagttctcccgtctcagcctcctgagtagctgggattacaggcatgcaccaccacgcctggctaatttttgtatttttagtagagacggggtttcgccattttggccaggctggtcttgaactcctgacctcaaacactgggtattttggaaatcatgtgggaagtgcttttcctagagttttgtagctcctcaaaaaggcagaactaatcaaccaggcttccccattgtagccacagttggatcccaatggtaagggccattgggaaaccaatggtctgggtgagtctggcctgggaccctggcatggggaagagactggacttgaaggctttggatgggcagcttggtctggacagtattggaaataaaggaacttgagactttgaaattgctgtgatgggggtgttctcacctgtccataggggtgggatgtcagtaagctttgccggtgtctgtcccatagatagactcagctctgcattgcagccccaaaaggagcctgcattcttaaaagaattttaggggaagaaagatttaagagagcacctgaagtcctgaatcccttcagaaggaattcatggctgcctgtagtcagctgccagtccaaccttgccctccaaaagaagtcacagagattgagttttcagcgaggcagggagaagttgtcacatttgcctaattcttgtagaggtgagagtgggagtaaactggaagggggcggattattggtgatttgggggccacgtttccttgtatcacctgtaaagttttttttttgtttttgttttttttttttttttttggagacagggtcttactctgtcatgcaggctggagtgcagcggcacaatcacggctaattgcggcctcaacctccccagactcccaagtagctgggactataggcatgcaccactgcacttggcgtatttatttatttatttattattttttcgaagagacagggtctccttatgttgcccaggctgttctcaaactcctgaagcaatccgcccacctcagcctcccaaagtgctgggattacaggtgtgagccaccatgcctggctcacccataaaattaaaatgaaaagagcagaccacagccagcagtcttccgacctccagctcttgcaggtcgtgggcagccttgccccaggtgcagcaggtaggccaggaagcaggtgtgggaacagagcaacagcaggcaccgtggggacatgcacagtaagcgtcgaatcggtgtgcgtttgcagaaacgtgaatgggtgaatgaaggggtgtatgaaggtatacacaggaacgccacagtcagctttgtgtaaagtagaccagtgaacagattgctggtattgcttctgacagctctgctcctcaggggaaaatggtgaactcactttagaactcgcctttgtcagctccaactagactctggaaggaacacaaatgctcagactttcccatgacagactgtgaagcaaagccagttacacagctaccgtcactaatatttttggtataaagcagttgctaaaattaattccagtctgaaacttgatgaattctcagtcatggaattaacaggtcttaaatgggaaaaataaaaaattagcttgattaaaaataaatgtttgtgctgaaatgtggagcctgtctgtccctaacaaactaaatatgaagtttttcatcttagaggatttgtttgcctttgagtattcatagggaaagtgcacgtttgtaccagaaatttagagacgcactcccagtaagttcttacgagcagtcagtattatcctttttgtataaggcaagcagtcagtccctatgaagagtaagatacaagcctggctcagcagtggcccccctgagcctatctgatgtgcagaaaagtcacgcacacacaactgtcttgaagggcagcctcctttcagccagcacccatttactccctcttattaggccttcctctgaatttatatcaagcaaactatttaggacgcatctgcgaagcaggaagtgtgtttcattttgtttttaatgaggtttcaaactctctcttcccatctctgtccctggatgacagcgcagagttttacgtcatttgctattagacatcttgtggcttgacatcctcgaaggctcagccacccctgggtgtgtttggttaatacagcaagtgaagcctgggcaacatatcgaggcctcatttctacagaaatttttaaaaagtagctgggcatggtggcatgcacctgtcgtgtcagctacttgaaaggctgaggtggaaggattgcttgagcccaggagttcaagcccgcagtgagctatgatcgtgccactgtactccagcctgagtgaagggcgagatgttgtctcttaaaaaaaaaaaataataataataaaataaagaaaagaaaaaagtagaggttctgtgcttagttagaagatatctaacaacacaattggttagactttcataattatttctgctgatgtaagtatcacagcgcaggtcatgggcaacagtttactgttttcacacccagcttcaatgttaaatgaaccccagactatagcgtgaccagtctgatattatcatccccaaatctttatagtttcagctcttgggatggatgactgaataaccattttttttccagtgtggtagtcttagggttttgcttattggtgtgtgtgtttcaagaggaacctctgttccttggacttgatgtgagtggcaagtcatgtaaaaagctggattttatcaatagtttttgtctaaaaaccaaaaccaaaaaattcttcccctgcagtaccagtgcttgaaataaaccaccctcctacccccacccagcttgcctgcgtggatccagtagcacccccggtaccccggtgggcctttttggcagccccgaggggtcagggatctagggggaagagtcaccgcagggagcgcagatgtacttggagtggggaatggttgggggggacccattcccctgctttaaaccgcaaatgtcttttgatatctagtaaaattggcaagcagaatgattgaaaacatgtgagaggtaactggatctaagtctcaagtagtacatatttgagaagttttccccaatgtaaaagtcactctttaagagccttaaactaataaaaacaaggaaattccatgttacggctgccactcggccttttcatttttattccagaagtcagatctgacaggtcagcagctcactggctctgggctccccgtgtttaaagcagtggggacgaggagaagaactggcagccgccgggacggggaagtctccaatgccattcagtgccaggctcgtaattccctcttagtttatcctattttctcttcttggggcggcttcctgtatgtactttattcactgaagctgcttcaggattccttcagagactattcttgtttctttccatttctgtgtctttttttttttttttttttttttgagacagagtcttgccctgtggcctgggctggagtgcagcggcgcgaccttggctcactgcaacctccgcctcccgggttcaagtgattctcctgcgtcagcctcctgagtagctgggattacaggcacgcaccaccacacctggctaatatttatatttttagtagagacagggttttgccatgttggccaggccagtctcgaactcctgaccacaggtgatctgcctgcttcggccccccacagtgctgggattacaaagcataagccaccgcacccggctaatttcctttatagttacactagcttggaagaataacatactgagtggcgtggaaggcgttggtgcacataggtgcagcatcccagagccccgtccactggcggctatttgtgcatggctgcctgtggcttcttatctgtgatggaacctcgtgggcagagaagtggctggagagcatcaccaaggctgcctggtccaagttgcttcctgttgctgcatgggcagtgttctggggtccagaccctgggtggtagtgataagatggtgatggggtggagtgggtccttatagatcccacattactgagcggccttttgcccttcaaaccagatcacaatcccctccctgccagttggtcctcaagaaatcacaggaggctgggcgcagtggctcacgcctgtaatcccagcactttgggaggccaaagcaggtggatcacttgaggtcaggagttcgagaccagcctggtcaacatggcaaaacccggtctctactaaaaatacaaaaaaaattagccaggtgtggtggtgcactcttgtgatcccagctactcgggaggctgagacaggagaatctcttgaacccaggaggcagaggttgcagtgagtcaagattggattgtgccactgcactccagtctgagtgattctgtctcaaaaaaataaaaaaataaagaagtcacaggaggcccagcatacagagaacatcaggtatagagagatgtccttcctgggccaaaacaggtggtgtcattttgctgagtttgatagagaaaaagtcctgatgtctgtgtacataagaactcacgtctagagttcgagaaaaaccggtgatgagaacttgaacttggaggagtcacagggggatcaggaaagcttggtaattggcatgaatttcctacctccaggggcctggcacagagacctaggatgaagagggggccatcgagcatggtgtgaacttggagagtgtggggagctgccccagccgagggcactggatgggaattcatgccagaaccccatcacatagcggcaggagctgtaattgtgcttcttaattgtgtatcttcatttagtgcgagtttaggtggttagcaatagctctttagctagctttacagagtctaagttaaagagcccctcagctatcttgtagaaagcgccctggacaggatggggtgatgctgacagctggagtcactgttccagcgcccagaatggggagactagcagcacttctgggcagcccatgaagcagcctcttccctctgccggtgtccctcatgtccagcagagctagaagtgaaactcactgaggattgacgcggcccctttaaaatcgcatctccgctcttggcaccaggagctgtcatgtagtgtaacctgttggtgcccagaacccaggtttcctggtggcagccagcggtaccggtgccaggaggcagcgaaggaatcacttgcgacgcccgctctctctgccatacgagtgtcgttctgcggggccatctggctggcagcagctctcagccaatggcaggatgttgtaaacctcactcgctgaatgcggcaccgaaaatcttgaaaattaactgcaaaaataaaatcaaagctggctccgagatggtatttcttggcctggcataagctctccggatgaacttgctctgccttgttgatagatgcctcttactagtttggttttttcccaggagccagttggcatcttttaacttttccttgtaaaatccaggcagaaacattttgagagctttctggagtttttatttgctaattaaaatgtgagaagggaacacagccacaggtagaggtctagtgcaagccacagctgtgattcagaagaagaaaaaaaaaagccaaacctgacagtttcaaaatgaagttattagcacttcacctataactgtgatagcttttaacttgcaggatccttctcttaggcaccacctcccatccgaaccccagagcatatgggaaaaggagctaatgtgtgtaagttgcaggatacttaatcactgaagaatctaacaatgataactactatctctctggaacttttttttaacttagaagagtatgtcttgttctgtttatatatcacatagttttccaacgaccctgggaggtgaggtaggtggtatattttaccaatgggaaaatcgatgctcaggaagtcttggtgacttgctcaagttcccataacaagaagctgctgaatccaggatggaacctggtctaccccaaatgcccctactgcttcctagggcccagtaatgcccctgggtagggcgggcccagctctggaagaaacagggctatacaaaaaatcacccaatattgggtcaccagccttcttctacttgcaaaataattaagcaaaatctgtttttatttgtttttgagacggagtcttgctttgtcgcccaggttagagtgcagtggtgtgaacttggttcactgcaacctccgcccctagggttctagcgattctcctgcctcagcctcccgagtaactgggattacagacttgcaccaccacgcccggctatttttttgtatttttaatagagacagggttttgccatgttggccaggctggtctcgaactcctgacctcaggtgatccacctgcctcggcctcccaaagtgcgggggttacaggtgtgagccactgtgcctggccacaaaatctattttaattctgcaagttataagcagccagtggcccaccaggcccagctgtacgttcccagggaccccccaaagcgtatatgtcccgggcacacacacactaggtggtttgttttgttccccagcagcccgtgtctgcccgggcagatgttagtggctgagaaaccccaacagggagtgagccacaggcccgcgggtggcttccctgccagtgttctcctcgcgaaggggaagggagcccttgccagaatggctggtgccctaacaaattgattcctgccaaacaatagaaataaatattttcagcagacagaaatgttggctctgaaagcattcaaattaaaggcttatttctgaaacaaatactttaggaggaaaacatttttaccagcgcagatgagatcagagctattccttttggcagtggcaggactattttgagactcagccacaacggtttccctgccccgtctcgtttttcactgatgacctcgccccctgtttcatggagacagggaattgcattcagctagaggcatggggaagagatggtggcatggtgttctgcagagagcctcagttggacagtcggccgaatctggattcaaatccaggccctacctctcctgctatgatttcgacaaagccggtcagtcatctgatcatcagcttcctcagtctgtgaaatggggcggtacctcccttgcaatggttaatagcgttatcctcaggacctgggggtcattggaggccagcactgtccctagaactctctgtgttgattaaatggtctctacccgccccagcaaatataattgccactagctacatgtaactgttgggcccttgaagtatggcagctggaatggagggaacaaattttaaatttaacttagatgaaatgtaatccacatgtggccactggctaccattttggatagtgcagttcccattcatccctctcatttcattagttggtccctggagccaattaattggttggagggtcaacccactacaaatctcccaagtctttctctgtgccggatgcagctgtgcggagttgggacctgtctgttgtctttgacatccgtcttctgtcctgcagacggagcagtggggcagtgccatcgagctgggcagaggaattaatatcttagccatcaactgcccaaatcaaccttcatgggcatcttttaattttctaagagatggggtcttgctgtgttgtccaggcaggactcgtgggctctttccgcctcagcctcccgagtagctgggactacagttgtgcaccaccacacccctctgatatttcttaattttaatggctgatgtttcttaattttaacaagttcccatatgtctcatgatgtatgctaagtataaaaagaataatagaaggcatgaagtcaaggggcctgtttcccgggcatttgtttcagtggtgagtcacattcatgcgaagcctcggtttccttatctgtaagaccagatcagcaaaccacctgtggctgcctctctccctggttgaccccgaggccaagaggaggggcagggtcagcagccggccagacctcagtagcccctccccatcctggtatgggggaacacaggaggtagaaaacaagtgacctacacaaggcgggtggtggcgggggaggtcccactttaacaggaggcaagatggccgggagaaagctatggggaacccaggcaaatggagatgagcagaccccaagaaccgtaccctagggggctggctgggtcgggggaattagggtcctttgggctccttgcagagccgaagattgtagtggggagcactgcgtgtgcctacaaggctgagcctggcaggcagaattatgtgttgttttgagataacagccacaacagagcagtaaagaatactgcttataaaacggacatttttttgtagctcaaaaatggtcaaatatcagtaatgtcatgtggtttgagtaatccataaagcagagcccttctcgttagggctgagaattatcctcccctctccctgccacagagccggccacgtggcctgccccggcacctgctccgccttacatgtcattatgcgtctccgagacagcgtctctcacatctcaccgtttaaatgagcgtctagcaagtattctatggagtgcaatgcttgttggatacatctggcattttcatcttcgcagagtgggtttgtgacggggtgaaaaacaaaaaaacaaattcttgattcttgatggaaatctctcagtcctgagagatttataaaaaaggcttgtaggaaaactttgtacgcgtagcttttatactcatagaccaaattataattttttattcaatcttattttctgaataggtaacgtgttcacttggtctaaaatcaaaattttagccaggtccggtcactcgcacctgtaatggcagtactttgggaggctgaggtggggggcggtcacttgagctcaggagtaacatggcaaaaccgtgtctttacaaaacacacacacacacacacacacacacacacacattagctggacatggtggcacgcgcccgtaatcccagctactcagatggctgaggcgggaggattgcttgagcccaggagttcgaggctgcagtaaactgtgattgcatcactgcactccagcctgggtaacacagtgagaccctgtctccaaaaaaataaaatttgtatgtttatatactgagaaattttgtctccgcctctgtccctttttacccctactgtctaccctaagtcagtactgtacttctgttcattttctgggggtgtgctgaacagattcaagagaatagcatttccatggaaaggccgcagcttgtaagtttcacttgaatttccgtgattgggagttaatatcaaatgatctctcagaatcaagaaatactgatacatatcaaatgtataataacattttgagaattttttttttttttttttcagacagagtctcactctgttgcccaggctggagtgtagtggtgtgatcttggctcactgcaacctctgcctcccgggttcaagcgattctcctgcctcagcctcccaagtagctgagattgcaggcgcccaccaccacacccagctaatttttgtatttttagtagagatggggtttcaccatgttggccaggctggtctcaaagtcctgacctcaggtgatccccctgccttgccctcccaaagtgctgggattacaggcgtgagccactgcgcctggccccattttgagaattaaaggaacatgggcacgtaatctttatacgaggtggagtcagattgaatagcaagaggaagagaaactgacatccacgctcattgcactgggcgttttatgtgacttaatcctcatagcagctctatgaagtatgtatcagagggtgtccccattttacattaaatcacttgcctggatcactcagctggggagggtgagagccaggtgacctacccaaggctgtgtctctgggtggggggctcagaacctctctccctcgttttgtagtagccagacattgtctcgtataaactatggcaactggaagtgaaccaggtcttttcctgccctctgattttggtggaaaatgtgacctacccaggaaaagcactatgattttaggagtttaggtgcacaaagctgttttccaagcatgctcattcttctcccaatttgggactcattgctgcctctctgccctcatctgtggggccaagggagctggagcgacagccacagcagaccgctctgcatccctgtatgcgttgtgggaaacagcagaggaggtggcgttgcgcccatcttacagactccagattctgttcacccgacaggcagtgggaatccgtgttcacgctggtcccttggatcagaaattcagtacccttccctccacaccatgctgtagacacctctttcctctcctagacccggaacatcctctcttcttcagggtactggggaccaagatccaccctcgtggtgagaaaaccacaccataaataaacacagccaccatacgccgtgagatctggccaagaggtttccttctgttcattcggccctaatctccaagatgggaaggcattgccagctgccctgtgtagagattcctgaacacgcagtgtttcttattaacccgccagataaccagaaaatcagtctttgggcaagcgcttgcttctccacgtgcccagtattttctttctttctttttatttttttaatgagacagggtcttgctctgtcgcccaggctgggctcgaacttctggcctgaagtgatcctcccacctcagcctcccaaatagctgggactacaggtgtgcgccaccatgcccagctaacttttttttttttttctggagagacagggtgttactatgtggcccaagctggtctcaaagtactgggctcaagtgatccccccacctcggccttccaaagtgttgggattacaggtgtgagccactgtggccagctattctttaatttactagcgctgactacatgcctgtgatgtccccaggaccctgcaaagttctgggaaattcatagtgagcaaaacacagtccttgctggagttcacagcccatggggagacggcaccaaccctgtgcccagactaggggagctgccacgcagccactcactgagctgggcacacaggttcccatctcttatgaggtgaggcaggaggagcagggagggagctggggaagtggcatcagaacattttttggaagagagaaaggaaaggtttccaagcagaaggaacagcctgtggcgaggtccgaggggaaaggaggggaccctgttctctggggacactaggggaacgtcagcatgccaggtcagggttctggggagccctgggtggtcttatcgatggcccccaggaagccacagaaggcatttgagcagggaacgccaagctcacggcgggctttggcagggcgcgccccgtgtcctggaggactgtgtcctggtcatctttctaggcccccactgcatgcccttgaggactaggaagggtgcctccttctctgcatcaggctgactcctagcagctgccgtatctccagctttcctgctttcaactatgctttttgtctccttttcctcattgcgagcctaggcctgtatggggtggtggagtgggtgggagctcactgcttaggtgggtgggcagtgtgggtggtggtggttccatgggtctctccctcccactgtcccatctttgccactcatctgctgccccccactcccggaccccttttggaggtcagtctcactctgtggaaaccctggcttcctggttcgagatgccccctctggcccacgtgtctgacatcacgtaccagaacactgtggccatcattcaggattttttatgacacagtagtgaatcaaagcctgtcagtgggaaagtgatggggaaggattaagtgtctgagaacatttgggaaatatgaggttagacctggttctcaaacttatgaaataagtgaaaacatgaacgttcactttgggaattctgcaagattctcctttaaatggagtccatgaagagaacaaaatgaattttctgcagcgttacgcaggagcacttttctggaaatgaggtttcctaggactttgtcagcccttcaaagcctaggtctccttactagaggggaagaaatgagattttatttatttttatttttattttttattttttgagaccagagtctcactctgtttcccaggctggagtgcaatggcacaatctcggctcattgcaacctccgcccccagggttcaagcgattctcatgtctcagcctcccgaatagctgggattacaggtgtacgtcaccacacccggctaatttttgtatttttagtagagacagggtttcaccatgttggcctggctggtttcgaacttctgacctcaggtgatccacctgctccagcctcccaaagttctgggattacaggtgtgagtcacccactggccacaaacttatgaaataagcaaaaacatgaactttaactttaggaatctacaaggttctcctttaaatggagcccacgaagagaacaaatgaactttctgcaaatgagatgtcctaagaccttgtcagcccttcaaagcctaggtctcattactggaggggaaaaaataagattttaaaatatcaatgtttagccagactcagtggcttacccctgtaaccccagcactttgaggaggctgaggtgggaggatcgcctgagcccaggaattcgagaccagccaggacaacatagcaagacttccatctattaaagaaaaaaaaaaccatcgtttacttttaggagtaggcattacatttacgtgcttaaaataccaaaggtacccaagtgtagatatgaaagactttcccacccccaagtgagtgcccagccccttaatttccctccctggtatggatactaccagtatcttatgtttgtagaaccttctacagaaccttgtgtaggtagaagcagattctatgcatctatgtgtatctgtgtatttgcagtgactagattgattgctgttgatggacatattctggggaggtgtttttacacttccattactgagcacaggctcacaggatggcactttcccgcatgcaccaccatgcctggctgatttttgtatttttagtagagacagggtttcgccatattggccaggctggtctggaactcctgacctcaggtgatttgctcgcctcggcctcccaaagtgctgggattacgggcgtgaaccactgcgcccagcctgttttttgtttgtttgtttgtttgtttgtttgtttgtttttgaatagagacagagtttcactgtgttggccaggctggttttgaactcctgacctcaggtgatccacccacctcagccttccaaagtgctgggattacaggtgtgagccaccatgcctggcctcaatttctcccttttctaagccccccacctctgtttttgtcccatggtctggtcctgtcggccttgttgcacctggcagtcagggttgacttatgatttacttgaaccatccctggagcccctggcctggtgggggatgctggtggcagaatgaattcgggtctgaggtcaagcatgtgtctgtgagagtacacaaaatgaactgtgatgtagcgtttactgtgccacaaacttgaaatgcatcatcttgattatgtccagagaaaggaagtcatttgaccacagccacacaggttacaatggggatgcggcctggagtccaggtgtgagctaccacacccagcccacatacactttaaagatgagcaaatccaggctgtaatcccagcacttagggaggctgaggtgggaggatcacttgaggccaggagtccagtcaggtttgggaggccgagacaagaggatcgcttgagcccaggagtccagtttaggtttggtaggctgaggcgggaggatcgcttgaggccaggagtccagttcaggtttgggaggccgaggcgggaggatctcttgaggccaggagtccagttcaggtttgggaggccgaggcgggaggatctcttgaggccaggagtccagttcaggtttgggaggccgaggcgggaggatctcttgaggccaggagtccagttcaggtttgggaggccgaggtgggaaaattgcttgaggccaggactccagtttagacaccactgtttgaagcgtcttgggatgttttcagtaggggacttggagaagtgatggaaagaggctggtgggtggggcttaggcccaccacccctttctagccagagaaccctccattcatcgaaatgattctgttgttggaaatgaaacaaaaaataaaatggtcttaggaccttcctgtgcaggaaccatggccgacctttccctttttgtacaagtgatctatttttttcactagcaaaaccatttaagatttctatataggatgtgctgtttgattagtttgacagataatcccccaagaaacatcagatgaactcactctttggattaaagtttgagataataaaacaagaatacttgtgttgctgatgtggccagcccaagtatgtttttcccaccagcccagaggttctgggggcaggaggcatcctttgcaggcctagaaggacccaccctgtgggagcctggccctgtgcatctgcagagagcacttgctggaaatctcagtgggaaatggtggggatgcctcccatacccccactttaaaacaaacaactgacaattacacttttttttttgagacagagtctcgctctgctgcccaggctgaagtgcggtggcaccatctcagctcactgcaacctccgcctcccgagttcaagcgattctcctgcctcagcctctcaagtagctgggattacagatgcacaccaccatgcccagctaattttttgtatttttagtagagatggggtttcaccatgatggccaagctggtttcgaactcctgacaattatactttttgagacagggtctccctctgtcacccaggctggagcacagtggcttgattatgactcactgcagccttgacctcctgggctcaaacgatcctcccgccttagccccccaagtagctggaaccacaggcacccaccaccgtgtccagctaatttttgtattttttgtagagatggggttttgccatgttggcaggctggtctcaaactcctgggctcaagcgatctgcctgcctagacctcccaaagtgctagaattacaggcatcatccactgttcccggcccacatacactttaaaggtgaacaaatccaagccaggcatggtggcttatgcctgtaattccgcactttggcaggccaaggcgggcagatcgcttgaggccaggagttcaagactagtctggccaacaaggcgaaaccccctctctactaaaaacataaaaattagctgggcatagtggctcatgcctgtaatcccagcttctcaggaggctgggtcttgaaccctggaggtgaaggttaaccagtgagccgagatcacaccagcgcaccccagcctgggcgaccgagcaagactgtctcaaaaaaaaaaaaaaaagatgggcaaatccaaatggatctctggtgttatttaaatacttatttgggaaaaaaattttcccactatttctgttaagcagacagctggttacatggtagttttttaattttgtttttaataacatctgaaatgcctggcagaaagtctggagttgggggcagagagaaacttaaaatgttaggagctttgccctttgaggagctgtcagaattggagaaaaaacatcccagaaattgtaatcagtgaggaaaacaggattccagctatccacagcaccccagctgtacaccagcgtcacgggatgagggatgcctgtgtgcacgtaggccttggtttctgagctgagacagcagcagccaggccgacttggtgataggcttggcctgcccctgcagtggactgcctgggcctgggcctgggccttggccttggtctcagccctgtggtggatgatctgagccttggctttggccctccagtggatggcctgagccttggccttggccttggtcctgccgtggatgacctgagccttggtcttggccttggtcctgcggtggacgacctgagccctggccttggccttggccctccagtggatgacctgaaccttggccttggccttggccttggccctgccgtggatgacctgagccttggtcttggccttggtcctgcagtagacaacctgagccttggcaattggccttggccctccagtggatgacctgagccgtggccttggccttggttctgctgtggacgacctgagccttggccttgaccttggccctccagtggatgacctgagccttggcgttgaccttggcccgccagtggatgacctgagccttggcgttgaccttggcccgccagtggatgacctgagccttggccttgacctctgaagctcttctgtgcaagggtggggctcctgttggtgacacccacttgctgagtctacacctgggaagctcttggtcagctcggcccattgacttgagagaggaatagttgccgtccagcgagtgctgggggtgtaaggtggaccgggccacacggctgccaaggggccggctgggtgggactgaaacctgacccatgtgggtcctcattgcctcctgacatcagtcatcctgtgatctcttagaaagataaaaacacattttctgcgttctggtgcctctccttgccagacattttctcagtaaagtttctgtctcagcctcgttggaagtgccaggttctgagcccatcagtttgctgctagcctgccagcttcccatgacctgggacctgggaccaggggcccgcaggtgtttctagctggagaggagttctagatagttctgagcggataccctcctctgtcttcctcgggagagttctggcttggtttggtggtgttttctgtgaccagcagtggccaccgccaccaccaacccctcttccccctcccctcttcctccccctcccccctccctcctcctcctctatctccatacgccctgagactggccagtgggcagcatattgtgcaagaaacagctgttgttttgacaaaggacataactcgcctcacttcttgcatcaccagacccacgaggctctggattccaggcctctgcccctgcaggtggacacacagaccgtaacgcagaggctcacgtgtcccacactatgcattaccatttgtgtacgcactcgttcacatttagcaggattgtaaaaattaatagttagtgcagttcttccagctagataatgcatccaaatggcaagacagtccaaagatacacactatggagtaagtccctctccccaccggcccctctggagagagccaggcacggtcacaagtttcttctgtatccctctggagataatcacagcctatgcgagcatatggatggatattcttttaaacattgtgttgcggtttgctttttggcttggatgtatctgatgattatcatatcccttacaatacaccgtgtttttttacattacaggaaaatctgtgaggggctaaaccgacagggtattgctgggcatggaggaggttgggtccaggttttttgctctttgtgactttttaatgcctttcagatgtgacgactctccatacgccttctcacacgtgacccgtgactcatgggccgaggcctctgcatttgggacccccacctccacctccccaagatgcatttcattcccttgttaatgtgtcattgtagttgacgctttgaggataggcaggcttggtagataataaaacagtatttggcttatgtttaatcgctgtctcctcccacagcccgagaacgccttagcgtccttcagaaaggatttggtggtactggtttttatgtgtgtgtgtgttgttttttaaaaaaattttctccaagggacctggtcaaagatttcaagccttaaatctgatcaacccaatctggggcggcggcagctcagtctctcctcctcgctgtgccaatctgtttctgtggtggcgggtggcggctcggtgttaaatttggagacccccgtgggtttcccatgccgacctgcatatgtctgcgggcacggggaagggagggccgcagacccccgttgagtccccgactgccagcagcaagttgccgcaggcgcactggctctgcagccccgggatcaaggtgggttcaccttgcaccgggccacctgtttcagtttcctcctccaccaggcaggctctctgacagatcagcccagggaggggcaggtggggaccgagggggacggagggggcccacagacccccggctcatctggcatcttccccagcgtttcccacacttgacccactagatgagaagttgggggtcggggctgggaccccaccttcatacctccagcgcctgccaactcaaagacatcggtagatgcccaccgattgggtaaccgcccccagcacccccaccctgctaggcttccatgcagtgggggaagtagggacccccggccaaaagcagtcatgttctttttgtttttctcctaagttttctgcgtctgtgtgcgattggaacgaaacatcaactctttttttttcttttttgtcatatttcaatattggctttcttccccgccttctttcgaaggctccttttataacttcggctgctgctgcttaaatatagatgtcaaagccctcctccctccagattgtttatatttttgaagagccttctgcttcgctgtgactgctcctctcttatctgtatcccccgttccaccacattggtttcggttgctcttttttttttttccctgccttcccttaactgggatgtgtttcaaatgtggtctatcaaaatgttcagtgtttcccttttttctgcaatagctttgacatctgttcttgaattctagcccacgttattccttaggacttgtttgcccaagatgtgcctgaatgccagaaatactaaggggagaagagtgtggtgtggtggtatcttcccctcattgcctggtttgttgttttattgtcgttgttgtttttttttctttcctcccctgctttttaaagtgtctacgattccttccttcttccttccttccttccttccctccctccctccctccctccctctttccctccctccctccctctttccctccctccctccgtccttccctccctccgtccttccctccttccttccttccttcccttcttccttccttccttcctttcttctttctttcttttttcccttgggacacctcactcatgcccaggctggagtgcagtggcgtgatctcggctcactgcaacctctgcctccccggttcaagcgattctcttgcctcagcctcctgagtagctgggattacaggagcccaccaccatgcctggctaatttttgtatttttagtacagacagggtttctccatgttggccaggctggtctcaaactcctgacctcgggtgatccacccacctcggcctcccaaagtgctgggattacaggcgtgagccacctcgcccggcctgtccatgatttgtaagttgacagcatgatttcatcccatccggcatggcccaccccgtagtagtaccaaggaagcatttcccagcaagaacttgtaacgtgtaggtttgctggttaacttccgccaaggaggaaagcctgtgggacttggtgagctgggtggtggggggtggagaaggagaggctctagtgtgcttcttggaggcgtggggataaatcttcagctttgatttttctcgccgttcagctctgcttggactcagggtgatggtcccaaccgtgagaagccagctagagcagccaccttggatcccagcagaacgggccgctgtgtgtctttagttgccaaagcgactcggcaggaaaacaggccttttggtggcgacagcagtgtgtccttgggcgcctgctgtcagcctggaacaccattctggggccatctgctgcaggcttgttggaaacagatcctcttggcagctcttcccagaatttctgaggccagggcacaggttctctggcgcgttgattatcggtttgttgcggggagcagagcccagagtcctcagccccctagcgggtccctcatggggaacccactcctggtggtcctcagcgttcccgcgcaagtaatgtgatttgagaataactgccaatggtgcctcatttctgaaaagtggttggaaataattattcttggaatttaccttttaaaggtccctcttgaaaactaatcataggttaatggtctcgaacatgatgcttggcctagagtgagctcaccataaacatttgttgaatgaatacaaaccaagtattactctcagagatcccaggcccacagcattgaaggacggccacacggaatgccccgaggaggggatagatcagcagaaggactagagctcaggagagtggctggctggaaggaacccttgggaagaagaggcgtggagcaacttggggaggcgggtgctttgggcattagcctgatagttgtggctggagcaagaaagatgtttctgtgtattctgttatgggaacagagtcatttatggcgtgcacattgaggcacgacccatgatgttgaacgagcttggttttctcaaccacttcacatgggacggacgtgggatggggggataatgttcatttctctgccttcccgccaccctccagcccctcctctgccaatgagttgatgttccttagagccactggggtctctcccccagtgttctggtcaaatgcaaataggaccctcctctagtacacagtgcaattacaatctcacttttcctttcctgtttccccaacagagagaactcgatgccaccgcaacggtattggcgaaccggcaggatgaaagtgagcagtccagaaagcggcttatcgaacagagccgggagttcaagaagaacactccagaggtgaggcgcgtgaccatcgtgttcgctttgaagggatcttagaatgctggtgcatgttcaggcgacgctccgtgagcgtttcattttcatcagatgaacgcacggccggcaaacaacccgtttctttccccagatgtcttcagccccatttccagcagaacgcatgccatcctgcaggctgtggggatgtggaaattgataggttgtctggaaatatgaaagtcagagccaattccaggtgcagatactggacaagcttggtctgtaagaacacgtgggcaggtgtgtgggtgtctcagaccctcgagctcatcccagaccctgtcccatgtcagttagcaagccaccaaagtccataagggatcctgtggggtggaaggtccgcggggcctgcttccctgttgctggtgcaggcggagtgtctgaaggctgcacgcatctgggcatagcagtgcgcctaacgcttcttgtaaaacagacatttcgcctgctaggccttttaaatgcctctctgtttcttgaaatatgccgtaaagggcaatggaaatgtgctttttatatactcctgttttttctctcgtgagtgtgcaatcgggggacagtgttgagttgctggggtggcgtttttctgctcgtttcctggccccttcttccttcccttcaaccctatcaggggcttactaagaaaaaaaaaaaaacatccaagcgtgttgcaggcagatgagcagtcgcgggaatggctttccgggtgacatctgccagtttggtccccatggcgctcatcccgcgggctcggaccccagcctctcttacatcttccccttgtatgggaaggggtcgcagcagcccacagcttcggcccggcttccgggcttggggaatcttctccgtatcgtagctcttggctcctccatataagacataggaacatgcctggaggcaaagctcctttctaggagagatgcccctctcttacttacataatattgctgggaaattatatgtgaattgcatttttaaaagcggactcatttaaaatgtttcaaaagaggcttgctagtcaagggactgctggcatgaatcattatggaaaacaaattaataaccttctgtcttcagaataaatattttaggagaaagcttggtagcagagtagaaagaaggcagcctttggccacagagccagctaagggttcaaatctcacacccgctgcttgcctcggctgcccctaaatgtgggtactccatgtttcacgagaccaaaaatgcaggtgggagtcactggtgcttgggggtttctgccttctctgccagtgttggggagtggggggccctattctccatgtcagccttgccatgagtaaaaacaggaggaaaaaaagagctggggacagaacgtccttcttctgttgcctccagcggcttcagagcagactttcctggaactccggtttcctgagcgcttgtccttgactcagtttccccagcccaagccccgccacatccatcgtgctagctcctcttagtgccgttcctgtagctagtggtcacccaccgttctgtattgtcactgccctttcctcggtgaccatatgtctgagggtttccatagaaaatcttagaggtttggctgggcgcagtggctcacgcctataatttcaacactttggaaggctgaggcaagcaatcacttgaggtcaggagttcaagaccagcctgggcaacataacaagactcatctctgttataaaaggtaaaaagaaaaaagaaaacgttttgtggttaaaaacaaacaaagaaacaaaaaaacccagaaaatcttagaggggcaaggccatccttcagaggccacggacaataaatacacgagtgtattcagccagagaatgaggttcctaagaggcctggcttcctgggtgttcctcagaagtccccaactcctagtgacagtggaggaggagcgtgtcccccttcggtcaccctgtccgttccttatgctctgctgataaatgccgcttgtactgcactgagccctatccctccatcgtgccttgtgtcgaattccacattagttactcaaagacacctggccttaaacttggcgtttttatctccttctgatcccaataaatggaagaggcttggggaggcggcagcctggtaggtacctgccacttggggcatttcttctcaggacacatttttagactctgtcttcatggagaaaggggctagaacccaccaggaaggggaggcagatgatggaaggtcaccacctgcttggccctgaccccgccactgccagtgggtggagggtggtgcccacttcctcatctttggctgtagtaacgagggtctcactgcagcatgcggtcctggggaggtggggagaggggagctggctgcaggctcctgccccgccagccctatgcactttctcatccaaggaccaacctggaaatctgtggggcgcccacgcggaaagtccaagacgagacccacttcacttgtgccagcagccagagcttcctgctggtaactttttttttattttttgagacagagtcttgccctcaggttggaggaccacccaatcgctcaggttggagtgcagtgtcacaatctcggctcactgcaacctccgcctcctgggttcaagtgattctcctgcttcagcctcccaagtagctgggattacaggcacatgccaccaccacacccagctaatttttgtatttttagtagatttcactatgttggccaggctggtctcgaactcctgacctcaggtgatccgcccacctcggcctcccaaagtgctgggattacaggcatgagccaccgcgcccagccctcctgctggaaatgttgaaaccacataagaccagaacagtggtgggagtcgggggctgtggccggagtgtgctgggtgtgcaggaggcggagttccctgctgttccctgtgacagcaggtgtgtgtgtgtggggggggagctgtgacagtacgtgtgtgtgtagatagcacatgtgtggagcctcagctcagtgcctggcctgtgtcccaaggggacactgggtcaccgtttgtttggggtctcagtcttgaggagccaccactgccctgacactggttgctcctctggccacaccgcaggattgattactaaccgtggaggtgacgtcgggttgttgcatgtgtagaaacgaggcttgcttagagctttcgcccgttgggtaggacagcctggcttaccgggaggagggtatcctcttccctatggatgcagcccacgatccccatggcaacataccttccagggcacagcgtggcagagccagggctggtggtgttcctgctggtgtgacaccaagggtgttgatcttgatggaaacgcccacgtctctctttgttctgggaaagaaggaaaggtttcctggtgtctgatgaatgtctaatgtgttccacagggaggattaggcacccgcgagggttcagtggggagtaaagtttgtctgccatcggagatttcaccttctagactggcccttcccagatgtcactgggaaaagctctagtccaggagggaaaaggtgggctgtgacggggaggtggccagggaggggtgctgtgtggtggctgggactctgacaggcgggagaagccacaggaacatcaggaggtgagcgccaggatggctggagccttgaagggtttttctggggacaggatcctgctctgtcacccaggctggagcgcagcggcacgatcacagctcactacagcctccaactcctgggctcaagtgatccctccgtctcagtgtcccgagtagctgggattacaggaacgtggcaccacagtgcctggctagtatattttattttattttatttttatgtgtttttttttttttcttcaagtgtcttgctctgttgcccaggctggagtgcagtagcacgatcttggctcactgcaacttccaccttctgtgttcaagcagttcttctgcctcagcctcccgagtagctgggattacaggcatgcgccaccacacccagctaatttttttgtatttttagtagaggtgaggtttcaccatgttgcccaggctggtcttgaactcctgaccttgtgatccacccgcctcagcctcccaaaatgctgggattacaggtgtaagccaccgcgcctggccgtagtttttaaattttctgtagaaacagagccttttgctgttgcccaggctagtctcaaactcctgcgctcaagcagggtcctcccactttggcctcccaaagtgctaggattacaggcacgagccactgcgcccagttgaaggttttctgtttagaattagttttttaaagtttcagttttatatcattagattaatatatttgccatcatatgatattgtgtctttttaatccagaaattgtagttaatttgcagaagattgcagttactctgcagataaaattgtatacgttttctttgaatctacaaaaagagtccctttgaaagaaaaacatttttaaatgttctaactgaacatccattccctattgaattaagaatcaatcgtggaacataataggcggtggagtgtttctagggtatattgctttctatatttttgttttttttggaatatagtggcacaatcatagcttactgtggcctcgatgtcctgagctcaggcgatcctctccttatagcctccagagtagctgggactataggtgcgtgccaccacaccctgctaattttatgttttgaagagaccgggtctcactttgttgcccaggctggtgtcagactcctgggctcaagctaaatcacccaccttggcttcccaaagtgtcgggattacaggtgtgagccactgcgcccagctctgatttttgtatttcttacttaaggcgacatacttagtagctgtgcgtcttggggcagatacctcccaaagccccagttctgtcatctataaataatgtaacaacagggccccgctcgcagggttgctgtgtgcacatatgtgtgtgtacgtacccatgtgcctgtacgagaagggctgcgcacaggcctgtccctagagtttagcttatgttcgttattagcattaacctgggaatactcaccgtgtaactcatgagatacagtggatttctgttcctcagagctagcttggggaatttctatgttttattttattttatttatttatttatttatttatttacttatttatgaggcggagtttcactcttgatacccaggctggactgcagtggcgccatctctgctcactgcaacctccacctcccaggttcaagtgattgtcttgccttagccttctgagtagctggaattacacgtacccgtcaccatgcccggctaattttttgtatttttagtagagacggagttccaccatgttggccaggctggtcttgaactcctgacttcaggtgatccacccgcctcggcctcccgaagtgccaagtggcatgagtcaccacacccggccttagctcgggcaactttaaaaaaaaaataacaacaaatataggtagtttcagcttaaagtgtttcaaaagttggtttgtggccagacacagtggcttacgcctgtaatcccagtgctttgggaggctgaggtgggaggatcgcttcagaccaggagtttgagaccatcctgggcaacatagtgagattccatctctacaaaaaaatcaaaagattagccaggatggtggtgtacacttgtagtcccagctacttgggaggccgaggtgggaggatggcttgagcccaggaggttgaggctgcagtgagccatgatcataccactgcactccagcctgggcaacaaagtgagatcctgtctcaaaaaaaaaaaattggtttgtaataacaattaatcatcttacaaatatttattgaacaccttccatgtgccagacagtttggccctgggaataaaaccctatctccattctttaaaaagtttcttatctttcttagtaagcaaatagaacccaatggcagagcgtgttaagtgctaggatagaatgactggaatcttctgactgtagactttccccacagaaacactcttatgtcagtggtgataaagttctctggataagccacatatggctcagtaaccctttttatagataaacagttctgctttttgagccttggttcttaacctttaaaatatccatgaaagttgaggacctacgcacctgggaaatgcacgtttgcagtttctggggggctcccagacactcatccatgcagccttagtttagaacaccagttctctgggcccatagtcccagtttcagctcaccattccaggagaaccagtgggtcacctctactctccttctcctccttgtgtcctggggtggaaggggatgaaggagggaggaggggggattctagagctttggggtgggtgacagatgagtaccaaggcctgaccgctgggcagggacagggtgtgcctggccttgggctgggtgctggggagtgggagatgggtgaaggagcaaggccacctgatgtgacaaggggctccacgggctggcagcaggggcagcacctctgcactgggctggccacagcatgtcaggagggagcagcagcagctatctggaagcctggtggtgttagaatcatgtatgtgagcagtggaggctgaaagcctagctctcgcaaaccccagaaagtgtctcttagcttttccgtttgccgtttgcttttccatggctttgatcgcggtcaaactccgatttcccgcgtgtgtgattccagagttcttctggaggcgaggttacgggaggtctgcagcatgtctgacctgcagccccggctcactggcctggctgtagggagttagtggatggagagtggctggacagtttggagaccaggtaacccagcgtggggtcctccctggagaaacccccagtgctcctgcgacatcggcctggcttcagggctctgctatttgaatgtgatgctcaactctccaataaatggtcgtctgtgttaggcttgcttccagaaagagctcagggatggttttgggttttgttctgcttcttttcaatatgggaggaaccttctctgatgggagaaaagagaggaggagaaccacattcctgagatgctgtgattttatcatgaaaccatccccagccctcatcctggtgacgtcagtcggcccagtcctactccagaacgcttcttgggtgtctgtctgcaggactttgctcagttaatttttgtctcctctaaaacagaccccgttgctctgggaggagagccgagctgcggctcaggggccgtcactggtcatttttgccctgatgtatttttgcctctacatttcttgatctctggaacgttaatcccaacgatgcctggtctgcggtgctcacagtctgtgtctgtgctttctacacctgtcctgctcagatgcacatgatgtcacacccaggtctccatcctggctcttgttggctgcggcggcagccctgactgtcggagacgcctggctcagcatgcccaccttgcaacagggagcaccctgtgctgctcacagaactgcccatccactttcttttcctttcctgggtgccaacatcttcctctgccccttctacgccggcctggcgcatttctctgatttctgtgttcccgggtagcagttgtaaaaattcaggcttgggagttgtcttgagataggacttggaaaggaatcttttaccatcgttgaaattggctagatttgtggattccttcccgaccctggcaggcacggtgaggggaggaggtccctcctttttattgatcaggatgcactgtgtgcggggtaagccaggaagccacgcacctgatgctatctctgccatggggaggaggacagaggatgggaagatgctgtgaacttttatgattcgtttttcactctcggtgagaaaaggagctagcaggatgggtgagggagtggagggtagtaatatatagttgtggcctgggcccaaacgcatttagtcactgcctcgacagcctttatatagacaccaccagagtgactcagcctggaaaaagagagtcacttaaaaataaagttgcgactccagtggacacgtggtgcacaggctgccctgagatagtcaccagggctccatggccctgcacaccccccaggaccctgggcgagtcaggtggtgaagtgagggtgatcgttgtaaccccatcttggcattgacgtgaggatttagcaaagtcacatatcatcccaattacttttttccttttttttttttttctttttggagacagggtcttgctctgtggcccaggctggagagcagtggcatgatctcagctcactgcagcctcaacctcccagcctcaaatgatcctcccacctcagcctcccgagtagctgggactacaggcgtgcaccaccacacctggttatttttttttattttttattttttgtagagatgggggtctcactttgttgcccgggctgatctcgaactcctgggctcaagcgatcctcccacctcagcctcccaaaatgttgggattaccggcgtgagccaccacacctggcctttgatgctttctaaacatgaaacagcatccaggcatcatcggctactccttgatatgtcagtgttacccactggactctcaactcttctctgttatcaacaaatcttgttttactcctcattagaccctaaaaccactgcacacagaaaagtgaaaagcccagcctcattttcctttcatcacgttgagcccattgagttggcttcattgaaggcccacagccctgatgtgacacaatggggcctttttttgagctagaattccactccgtcacccgggttggagtacagtggctcgatctcggctcactgaaacctctgcctcccaggctccagcaattctcctgcctcagcctcccaaatagctgggactacaggcatgtgccactgtgcccagataatttttttgtatttttcatagagatggggtttcaccatgttggccaggttggtctcaaactcctggcctcaaatgatccacctgcctcggcctcctaaagtgttgggattacaggcatgaggcacagtgcctggccaaaagtagatttctatagagatagaaacccccaggggtgaggggatagaggaatgaggaatgactgatagttggtatgaggtttctttttggaatataaaaatgtcctagaataagacagtggtgatacttgcacaactttgaatatgccaaatgccactgaactgtgtactttaaatgggtgagttgtatggtatataaattatacatcaataaagctgttatttaaaaaaaaaattcagccaggtgcagtagctcacgcttataatcccagcactttgggaggctgaggcagatggattgcttttgctcaggagttggagaccagcctgggcaatatagtgagacctcacccctacagaaaaatagaaatattagctgggagtggtggtgcgtacctatggtcccagctactcagaaggctgaggtaggagggtcgcttgagtctagcaggagattgaggcttcagtgagccatgattgcaccactgcactccaatgtgggtgacagagttataacccccgtctcaaaacaaacaaacaaacaaacaaacaaaaaacctaaactaaattaaaaaagaattcctctcttcatgggggtgtcagaaacccccgaagagatttcttattcagttgttctctcatcctctaaagaaactccccacagaaaagtatcttgtgaattttcatttttgcagggggcagtttggttttaaaaagtctactccaggatttggcaaaatgagaaaaccccagtaatcaacttgtgtgtttaatcattctagaatcacctactgttaagttataataagcctttaactagaaaaagtttaaaaattaaaagtgaacttttaactgttaccaattaaaccctttaagccagtttatcaacccaagacattattttctttcttttgggtctctaggggagaagaggtgccttgagtgggaccagtaatgaaggcaatttgaacctaattcgggccccagtcagggaaggtggctgcattatccccctacatcccagcaagactttgccgcatggtctggagggcaccagcaggggcctgtagggaagaggaggttgcctgggcccagggacattgaatgctagtcaagccctggtttcatttgctccaacagcattaatagtattgtgacctccatggcactgtgacagaaacttaaccccagtttcttcgtctgcaaaaaacataccctgcctacttcaaggggtcctggaggctgaatgtccagtctcaggccaggagtagaacgcataactagtaagtggtgacgtgcagtgaccttgagcaaggtcaaaaactgttctaagacttggtccccttatgtataagcaggaagaattggtgctatcccatttcacccaggaggtgaaatgaattcagatgcacagagcatatagtaggtgctcaacaaacaccctcctctcttctttccttccttgctttcttttacaagtagtcctgagcccttttctagggccaggggcagtcagatacagcagggatggagggagaagattccagatctcacagagatctggcagtggccaagtaaacaaatgatgcacaagataatttcaggtggcggtaagagctcagacagaacaagatggcagtgagtgatcaaggatgggcgaaggtactttggggagtcagagaacgtgttttgatcttaagaatgcaaaatgactttttgtatcacctgtcaacacaacacacacacacacacacacacacacacacggaggctttagtgcaaattttgaaataaccattgattaattttggcaagctgttagcagtggagtcccccacatttcttccatgtaaagccctgatcatcttggctgtaaccactcacttactttgaagcgtcagattcagtctctctgctttctaagaccagggatgctatttaatctgggcattagaaaattcagttggccaagtgcggtagctcatttctgtaatcccagcactttggaggctgaggtgggaggactgcttgagaccaggagtttgagaccagctggggcaacatagcgagaccccatctctacaaaaaaatgaagaaattagccgggcgtggtggtgcatacctgtaattcaggaggctgaggtaggaggatcccttgagcccaggagttcaagactgcagtgagctatgattgcgtcactgcaccccagcctgggcggcagagcaagaccctatcttcaaaaaaaacaaaaacacacacacaaaattagtcaatgaattgtggagtttcaaagagaccttattttgtttgtttgttttctgggccaaaggcccagaaattcttaggtaattcttcggtaattaattcttaggcaattcttaggtaattaacgaggagctaatctcccagttgctctgttccttgtcactggaagtggtcagagctgttgcggggcttggcccaggggcggcgggtggcatctgaagaccccgcaggccctgctttccttccgggagcatctcaggacggccgctttgtctgtctgcccccgccccttgctgaaacgtcaacaaggccggcatcccctttccttcctgagagccatgtgtcgcttccttcatgtgtccagccgtttttacagggctattttaagtataaaagacgcattatctgagagtttaataactgtcaaaagggaagcactgtcattagattcatgtgccctggaattttagtcaaaaacatgctgcgttctatcacgtctaagcctctattttcttatctcaaaaaataggaatgataacgacctcggagtcattatgggctggatgaactcttatagggattcagaacaacccaggcaccaagtagaaggtcaataaatggcttattgtgttcatgttaccaaaatctactcttttgagaaattgtgttcacaaatggccttttttttttcttttttctttttttttttttgagatggagtctccctctgtcacccaggctggagtgcagtggcgcgatcttggctcactgcaacctctgcctcccaggttcaagtgattctcctgcctcaacctcccaagtagctgggactacaggcacctgccaccacgcctggctaatttttgtatttttagatggggtttcactatgttggccaggttggtctcaaattcctgaccttgtgatctgcccgcctcggcctcccaaagtgctgggattctaggtgtgagccaccacacccggcctcacaaatggactttttttttttttgagacggagtctcgctctgtcacccaggctggagtgcaggggcgcgatctcggctcactgcaagctccgcctcccgggttcatgccattctcctgcctcagcctcccaagtagctgggactacaggcgcccgccactacgcccggctaattttttgtatttttagtagagacggggtttcaccgttttagccgggatggtctcgatctcctgacctcgtgatccacccgcctcggcctcccaaagtgctgagattacaggcgtgagccactgcacccggccacaaatggactttaaagttataaatgtgacggagggcagtggctcacacctagaatcccagcactttgggaggctgaggctggcggatcacttgagctcaggagtttgaggcaggagaatcgcttgaacccaggagatgggggttgcagtaagccaagatcgtgccactgcactccagcctaggctacagagtgagactccgtctcaaaataaataaaaataaaataaagctataaacgaacacttaaaaaaattattaaagcctagggtagaccctagtttctactgcggacttgaacagatacagtaaaattaaaacttgccttcttccatatgtgtctagagagtaattttctctccttttgcattagtttcactgttcatagagtggaaatgtttgctgctggactttcttttttgaagctattctttgagagtagcccataacttgtctttctggtcaataacctcaactgaaatgcattctgaatggagaacgtcattctgtgtaggatttaataataacttcagcacagaaaagcactctctgcctcttctcagcaaacaactttgttgagcatgattttaaaggtgtaacggctaaatgtgaaagccatatgatttggttgaaatcgtggtgagctgttattaatatttattgagtacttgctaggagtcaggcattatgctaagtgcatgaccatcatttctctgcccctggaagtcaccctgggagctaagtatcatcggtgccacttaatgaagcgtaagccacccacccacctaccaggattttcccgggcagacagactcctgggaatgaggccatataatcccctgaacaccctgcctccttagggttccagaagccaattttttttctttttttgagacagatttttgttcttgtcacccaggctggagtacagtggcctgatctcggctcactgcaacttctacctcccgggttcaagcgattctcctacctcagcctcccaagtagctgggattacaggcaccaaccaccatgcccggctaatttttgtgtttttagtacagatggggtttcaccatgttggctaggctggtcttgatctcttcacctcaggtgactcacctgccttggcctcccaaagtgctgggattacaggcatgcgtcaccacgcctggcccagaagccaaatttttagtcacttaaccattagcaattcctcttctattagattttttttaaaattgcttttgagtatttctttgaagtggcatactcatttaaaggattctatatgtcagggggaatgttttctaggagggtacttaggaaggaacatatcgttatagcctaaaatttgccattggcctgtgaaagccttcttaacttacggaattgattataagccaaagcgtgggaaaatctccccttccactttgagattatgtcagtcaagaaaatgacaattggataccaagccatgctaactctgatacttgctgtcttcgttttcttctttctttggctagggggatggagcgcgtgtggtgtgggtgggactagtcactgagcatgttattgactaacattggcttttcattttaacttgcaaatgtgagtggcataaaagtgagtttacgaggagcatgactggcctgttatgcagagtcttgtaattttgtttgtggccctttattttaagaagatgttgtgttatatagttggtgtccttaaaggagtatataattggatctggaagcttagattgtgattctgacttggccacttaatgaatgcaagatctgagcaagccatgacctctctgttgttcagtctaagaaaggaggtgttggtgctgagcatggtggctcatgcctgtaatcccagcactttgggaggctgaggcggacgggtcacttgaggctgggagttcgagaccagcctggccaacatggcgaaaccccgtctctactaaaaatacaaaaattagccgggtgtggtggagtgcacctgtaatctcagctattcaggaggctgagacggagaatcacttgaacctgggaggcggagattgcagtgagccgagatcacgccactgcactccagcctggatttcagagcgagactccgaggttctgtgtggctgagagccacacattttgcaacaagagactcgtcccttttccataggtgtccttattcctattgatcttacctgtgggcccaagacttaggcacatccctttcttcttaaaaggcatcacctcctctgcctcttggagttttcctacccagaattcattcatgtgtgcagcaaatattcctggcagtcccattgtgtgtggaatggggtaaaccaggaagactgttgtgagggctcagtaacttcagggacacagccgtcgtagcttataatggcagctgatatttagtgagcacttactgcatatccagtactattctaaacactggaaaggcatttaactaacttaacactcacaggatccctacgaaacaggtacagtgtttatttctgtttcaaagagagggaaactgaggcccagagaggaggagtaacttgcctaggcccacaggtggcaaagctgcctgaaggttttttttgagacagagtctcactctgtcgcccaggctggagtgcaatggcacaatctcagctcactgcaacctctgccttccgggctcaagcgatcctcacttcagcctcccaagtagctggggctacaggcatgcaccatggtgtctgactgatttttgtatttgttgtagggaggggttctcactatgttacgcacgctggtctcaaactcctgggctcagtccctcccaaagtgctgggattataggtgtgagctaccgtacccctcaggaattcttattttttagatggaaattttaaattggcttttattggaatctcattaaatttgtagatttggagaggctttagaaggcattttcaagttttgattgattgttttagatttcattcataggtgaatttcattctctatattttacttgagggatccacggaaactacctacatggacttcacttactctggttcattgtgtgggatacaaaatcgtcaaaattgaaggattgatcattgtgtctggagccaggcataaaaataaacctcactctgttatcataggtggctgtgattaagatcgagggaaatgtcggccctgggcctcctaacattgacagtttccttcagaagattaagtgcggcttcatttttggcccgggccatcagtagcttaaagccattactgtctattggctgtttggtttgtctgaaatatggggccggcgtcagcctatttccctggggtcaggtgtgttcacataatcaaagtgccaggaacccatatcgcatgcaagcgtgtgtgttcaaattagccttctccagggaggaattcacagcaccaggaatacgcgcagagatgttcttttgcacttttgcattttaaaacgtgcatcgcttacgagcgcagcattttcaagccttttcttgagatcagctcgttcagttacatgtgcttttgaagatgaccatttgtgaaaccatcagccactggcaaagtgaagaaaaatgaagatttcggcctggttgatgtgtgctcggggaaaggtgatagcttctgtttccttgaattaaaagctgcagacaagtatattttcatttattttgtttataaatcaacaacccacgaaaggtatttcatacgtatttaaatgattgctttgccgccatcaagaaaaaatactgtttcacttaacagtgaattgagacaaggaaaagtgatgtgtgaatagaaataaagaaattaaagtaaaaaacaggatcagggtaggttctagggctaataatttaagaacagaacatgtggtttaactctttttgccactctaaggagaggtgatatttgtatttttctttttactgaaaccagatcgtgagacacgcttttcattcatacttgaaacttgataaaatgtttggctttatattaattttctcaattataagtgtgggaaatgaattcgttgataacccttttcaagtaaatgaactgattagaaccagaagagccgagagtcatttttattttaaaattctttttgcatgaacacatgtagtgttgaggaatatgtggaaaattgaaatattgcttctctcctaccgtgtctccagtgcctcgataaatcaccttttttttttccttttaaaatgtctggccttataatttatgtttgcataacccattactaaattcatagtaggtgttttagttggcaggcattattccagggatttggaggagtttaaaaaaaatacagagcctttgttagtatttatactaagtggacattttccttttttaacaacaacaacaaaaaagaattagatttttaaaaaagaattcagagctagctatttacctttttcctagacaaacactattaagtccatattctcacattattcattgtcttaatggagattaagatttcttaatggactttattatagcttttctttctttttttcaaaattagaactggccgaagaaaatgcttctactattaagatcagatgaatttctacagaattttcagtaggtgtcatgttgtataggaaataaacatttctgttttagtaggttttcgatttcttacctcccgttgaccgttttgatcataaagtgaagatgaatacattcattcatttactgcagtctttggtacttgaacagaaatagcagtgttcttggtttgttcgcatacttgtggcttacctttgagactttctaatttttaaccagacatttaaaaatagccattctgtcttttagccctaatttagaaaaacttgtagcgctttcctttgaaatgatgaaaaaaaaagttctttctgttttctatcatcaaagtttaaaaagcgatgtttggatattttaaaagccggaaagaccatgtatggcgtgctgaggaagtttgctttgtttgatcattttctcttcccctcacccccatcagctggctaataatgttttccatgttaaatgtgtatcacagcctgttgaaatccctgtggttaatcagaagagaagttgtttctatcctatggaaccttaatacagttgtcaggaggtttgtgaacagaaattcagaattcatcacactgtaacgatgatctaaaggtcaagttgtacagtataaatttgaaaatctctctctgacttcctttctacctaaattagagcctaaaagtcatgagaattttgtcttctttttgtttattttagagatagcatagtcgatgttttaaaaagttgccaccttttcactataatgcgctcccattatcagagatgtttattctggttgtatctctctgacaaccttcaatacttaacagaataatttagtttggattcaaagaagtgcctcttctatttctgtgtttgtttctagaaactttgaggtggaggaattattgttccttcttcttggcaatgttcagggtttcacgaatctgacttttaaaagcccagctctcagccccgagcctctcatgagttaaagaaagggttttgcagcttttggtagacgagaaacacattttatggctcttcatgaagttgcccgctccgtccacgtcctgtcctcttcctccttcccagtttctgggctccctggctcttgtcatgaggctttcagttttgtgtcccagaaagcgcttcccccggggacagtgccatgccaaggctgggagaagggaaaaaggaggtgtttatcgccttgaagatgccttccagcctttattattaactcccttccaaagtaaactttcgggtttttttcaagtctgttctggccaaagtacagttgggtttgccgtgttctctaggagtagaggtgaaaacagcattgcccggggtgaggagcaggaggaggaagggtccacgtataggagtggatggaggggatctgtgagacagctgctgggacagatccgacttggagactgtcaggcctctgagcccaagctaagccatcatatcccctgtgacctgcacgtacacatccagatggccggttcctgcctttactgatgacattccaccacaaaagaagtgaaaatggcctgttcctgccttaactgatgacattatcttgtgaaattccttctcctggctcatcctggctcaaaagctcccctactgagcaccttgtgacccccactctgcccgccagagaacaaaccccttttgactgtaattttcctttacctacccaaatcctataaaacggccccacccctttctcccttcgctgactctcttttcagactcagcccacctgcacccaggtgaaataaacagctttattgctcacacaaagcctgtttggtggtcttttcacacggacgtgagtgaaagagactgccattcatgaatggacaaggcctggctccgtccacgctttcccagctctgtgtcctgccatcggacatgctggcacatctgctgtgggtgccctgcacttctccgggcactcctggcccagctggggaggttggcatggtatccaccattttgttctaaagtagtaaatgaaactcttgggagggcagcacccagcagatgtttggagctagagacagggctctggggatgtgtaggaacccggacctggtgtggcaatggtgtggggctgtcacgaggcgtgaggaggctggggtggtgttggggacagcacacgatgctggggctcaggccaagtgaagcttggacttcactctgtctgaggctttgccaagtgtcagagggtgcacacttgggagtcacatggccaggctcacatttccagccgaagttacactctacagcctggcagcagatggacgtttggggacagaggtggagccggaacagctgagacactgttttagaggactctgcgagaaacacgctcttaaaacaaggaagcggtggttatgtcttattcaacaacgatctgttgtggaccagctgtgtgccaggcagttgcaggccctgaggctgcagcagtgagcagaaggccaaggtccctgccctcgcggtgcttacattctagtggagacagatgttaaactacagggcaggaaaacactgtcaaggagatgcaggtggaggattctgactgtggaactggggcatagagacagtgggttttgaaagcacttggctgagaaggatgggaggagggaggagggaggagggcgggtacatctgtagatggaccaggttaaggtatggacttccccatcctgacaagggggagccccaagcttgttttcaggtgtgacgggggtggggagaaagagagcattccaagagaggcacgaacgtcatttccagagcgagatgaaggtcacagagtttgggaggagatgggatccggcactcgggctggcgagcagacaggagggaactcagggagatgggaaccccggggaggaagttagggcaggatcccctgggagttttcccggatacataggagaaaaggttatccttcaagggtgagcgggggctaagtgcaggggacagaagagaggaaagcccggcgaccatcatgcccggctgccgtgggtggtctggattggaggcggcagccgggctgtgtttgtgcggagggtggcagggggccagcggaggaaactgcccaggcgccagccctgccatccccaccggcctcctcgctttggggttttgctttctgccctggccacgtgggaccggctaggtggagatcatgcaatcagggttcccagctctcagaaccataatggttaagcaagcagcttcgtttccaggcacgcaggagctcccccgtgtcagcgttttcctaacatggctaatcataaaaacctcctgggtgtgtgtgtatgcttgttaaaaatactgtccctgggccccaccctagacttagtgagacacagtcaccggggaagggcctggggacttgcatttagaaccagctcctggaatgcttactctgaggccagtttgggccccctcccatggcctccctctgtgtcccttcctccagatgctgattgaggatgtgtcccctgccgggactgtgtttgcatgtctctgtctctgtcacaaagtagatgcctggggagtgtgtgctgcgtggccccctgaagaccctgtaccgggatgtcagcaccccagcccccagctcctccccctgtgaaagacattagctcctggaggggctcaggtggtggaaatgaatcttagcatcaatgtttagacctaaaagccatctccaggtcatcatagcacatgacagagatagaggcagaacctggtggccataggattatttctgagcaaagatcgcccaagctttggcataggccagggttattcacatgtccgagtccctggaagtggggtgtgaggaggttgtggggggccttcagaatgagggaaaagggataaatcaaaatcaagtctttttttttttttttaattgagacagagtctcgctctgtctcccaggctgcagtgcagtagcacgatcttggcccattgcaacccctgcctcccaggttcaagcaattctcctgccttagcctcccgagtagctgggactacaggtacgtgccaccatgcccagctaatttttttgtatttttagtagagacggggtttcatcatgttggccagggtggtctcgaactcctgagctcaagtgatccacccgccttggcctcccaaagtgctgggattacaggcgagagccaccgcgcccagcctaatgatataaatattagtagatttctgcttactcacttcaccaccagcattttctagcaaatgtgagttcagcagacaccaaagatttttataaatcaaagtagacagtctttaacgttgagaagattctgttaactcatctgttctacccacactcttgcccttccctcctcacagaaaagccaggagaagggtgaataattgaattacagatgacagtaaatatttggatctagctgcttatgaggccttaatgatatcagtcagtacaaaaggttgatatccatgttttttggtgtgtgtatttttttttttttttgagacagtctcactctgtcactcaggctggaatgcagtgacgtgatcacagctcactgcagcctcaacctcccaggttcaagcgatccttccatctcagtctgctgggtagctgggaccacaggcgtgtgccaccacacccagctaattttttgcagagacagggtctcgctatgttgcccaggttggtctctcaaactctggggctcaaatgatcttcctgtgtcagcctcccaaagtgctgtagttacaggcatgagccactgtgcctggccgatatccaccatgtttggagcctgtttttggttacatttcatcctcatctactggcctggagatattggtgtcaatcagttcttcactgggggaagagatttttttaaaaagtcagatttacactcagtaagattcacccttttcaggtgtccactttgatgaattttgacaaccacatatagtcatgtgccaccaccactattaagatagaggacaggctgggtgcagtggctcacacctgtaatcccagcactttgggaggccgaggttggcagatcacccgaggtcaggaattcgagaccagcctggccaacatggcaaaaccctgtctctactcaaaacacaaaaattagccgagcgtgatggctcatgccggtaatcccagcactttgggaggctgaggcgggcagatcacttgaggtcaggagtttgagaccaacctggccaacatggtgatacttcgcctctactaaaaacacaaaaattagctgggcatggtggtgtatgtctgtaatcccagctacttgggaggctgaggcaggagaatcgcttgaacctgggagatggaggttgcagtgagccaagatcgtgccactgcagtccagcctgggcaacaagaccaaaactctgtctcaaaaaaaaaaaaaatacatatatatatatatatatatatatatatatatatatatatatatatatatatatatgatggttccactgtcccccctattctcccaggcctctatgtagtcagtcccttcccccaccctcagcccatggtaaccacttatctgttttttgctggcatcattttgtattttctggagtgttacatagagggatcataccatatgcagtcttcgagtctggcttctttcacttagcgcagtggatttgcagttcaacagtgtggccgctgtcagtgccaagtagtattccattgtatggatgtaccacagcatggagggatttttaaggctggtcaggcagtgcttatgtcacaggtccaacatccagtcccctgggccatttaaagccaagcacagccccacacctaaccctcgtctgaacgatcttgtacagccactctgcagtttcacatcctgaatgtgagcagtctttttttaaagaaggaggttttgggccaggtgcagtggttcatgcctgtaatcccagtactttgggaggctgaggcgggtggatcgcttgagcccaggagtttgagactggcctgggcaacatagtgaaaccccacctctataaaaaaaatacgaaaattattggtggtggttgcctgtggtcccagctgcttgggaggctgaggcaggaggatcacttgagcctgggagtttgagaccagctggggcaacatagtgagacccctgtctataaaaaatacaaaaattggggctgagcgcggtagctcacactttgggaggccaaggtgggtggatcaggaggtcaggagttcaagaccagcctgaccgacatggtgaaaccccatctctactaaaaagacaaaaattagccaggcatggtagcgggaacctgtaatcccagctacttgagagcctgaggcagagaattgcttgaacccgggaggtggaggttgcagtgagccgagattgcaccgctgcactccagcctgggcaatagagcgagactccatctaaaaaaaaaaaaaaagccgggcatggtggtgtaagcctgtggtcccagctacttaggaggctgaggcaggaggattgcttgagcccgggaggttgagaatgaagtgagctctgattgcaccactgcactccagcctgggtgacggagggagaccctgtctcaggaaaaaaaaaaaaaagaggaggttttaatgttcgcaaagctggtcagtttccaatctggtgtcaccagtggaaaaaagatgtaagtgttgttggcaagagaagctcacccagagacacgctccatgaagtccctgacccccgctgggggtgcctgtgatggagggtaggctgtggtgcctgcgggcgcgcacaggtgagatggaaggaataaggggttattccttctgggtgcagctctgcctggaggccagagctgtcctcctcccttcgatctctgaattaaagacgctcttctagtattttcttatgttgatatatatgtgtatatatatatatgtgtgtgtgtgttttcttattgttctagttcttatattgtcatttaattcctttgtcctttagcttgcaagggaatgtgttttcttattagattgtaagctctggggaggtaagaccagcacttccaccctcccagatccttggttgggcacgttattgatcagtccacatctgttgcttggctgattgattaaatgctgtggtgcccgtgttcactgagggattccagacccctgtctagcccaaggatgcctcacagtgggaatgctggcacagctgtcttggcaatcagtagaccatcctgtcagttcttcaagcccagagagggtccgtgacttgctcagagtcacacagcaatccattagcgaggccagccccttccctgggctctgcatttctcttgtagtgaagagctcctcacagtttatttgcatactgtaaatttgcaaagtcagaaggaaaagggcagggagccgggcttccttgaggcaggtggctcttttaaagctggggcatgttgtcgccaatctgagcttgtttccatggacgcagccagccgggcagcctgttcccgtcaacctgagccctgatggagcctcggacctgacaggctgcctggggaactcactgggaggagggcgggttgggggagacccagaagccatgctggagtctctctctggcctactttttgccatagtttgaagggaaagttagtgaattgccaggatcaacctgcagtttccccaaaacttgcacaggagtggctttcatcgctgcatggggagacctcctttgcgggtctgcttagcggtagctggattgtctctgagggatacctggctttcctaactgttcctggagaatcttaaagacgaaaatggaagaaagggctcacatctttgttttgtgctgcaagcaaagtcttggaaaaatgaatgatgccaatggaatctatttcttgtaattaatttcctcaagctactggatctccttttcttgctgagattgtggtttggcagctgcagtttgatagccccattctgagactggatccctctcttccctcatctggtagttttcacgtcggggcattcctgaactccgtctgcctcgtttcaggctgggatcacagatcaggagcgaaggctttatgatattaactagtcaacagatacattctttgaagaatttctgtgtttttaattaccccacgaaagcctttggacgcacgggttatgaggggcattttgcattgctaaattccagccttgattgcaaacctgaaaagagcagaaactgctcagaacaagttgttaaaaccacagacacaagggaaaggtttctctctctccctccccctctctctgtccctgtttttaagtcctttcagctggaggtgaaactgcaacgttatcaaacatgccagtacacactgtttcccaggcctgtttttgcatgagttggggtagaaatgtacccagcttctgttccagtaggtggagaaagatgcttaaatcctagaagcactgttcacctacctttttagggtactgcaggtttagctcgagggttggagggcatccagaaaagcatgactaagagagaaaaagactactcccaaagctaacagggtggagtatcatagccaggacaggaaaattcccagcagggaaacggcctgtctgtaatgcagacacattgggtcataggtttgctttcacagaataagtgaaatggaacaaaagtcttttttgaattctcattccaagaggcccagtttctgcaggtgtgtcttttcgatcttaccttgtattcagtattatttcaagcaatctccattttaggcagtgtctactccagaccaaaaaacctggctaagaaagaaattttgttgattttgagacagggtctttctctgtcgcccaggctggagtgcagtggtgtggtctcagctcactgcagcttcaacctcctgggcttcagcgatcctcccacctcagcctccctagcagctgagaccacagatgcctgccaccacacccggtgaatctttaaattatttgtagagacagggtttccctgtgttgccccaggctggtctcaaaccactcctgggctcaagtgatccccctgcgtcgacctcccaaagtactgggatcacaggcgtgagccaccgcaggcctcccagactctgggtcagagggcagcttgagctcctccaccgactgctccaagcctttgccccagctcttggtgcctggggtggtgggagcagcatgggcttcgctgcacacggacctgggcccagatcttggttccatcggctgctgggagatcagttcccttctctgcacctccattcagcttggacgggaatctgtccttcctagaacagctgtgattaataactgagaccacacccatgttcgttgtggcttagcgccatgcacacaggtacctagtggatgttaactttcctctccatcctggtcagtgctttttttttttttttttttttttttactttttctttttctgtttttgagatggagtctcgctctgtcacccaggctggagtgctgtggtgcaatcttggctcactgcaacctccacctccctggtgcaagagattctcctgcttcagcctcctgagtagctgggattacaggtgcccgccaccatgcctggctaatttttgtatttttagtagagacgggttttcaccatgttggccaggttggtcttgaactcctgagctcaagtgatccacccgccgtggcctcccaaagttctgggattacaggtgtgagccactgcacccggcctctggtcagtgcttctgttgagttcaagaaaaatgaccaattcatctaaaaccccgagctggcagatgctctcccgcgcggcggcggctgacgtcagtgctactttcagcgtctttggtgcagtcttggtgttcgctctcaaatgggctcttttcagtatcacatatcatatgcaggatgcagaggggcccggcttacataccgagagtcagaggactcatgcggccacaagtaggttgggaacagtgtcccctaataggatgagttttgggctttaaaatttaaaaaaaaaaaaatgggggcattgatgagtctcgttggcaccttttggcttgtggaggctcgtgatctaatattggtctctgctgtatacccagcacactacctgccacttagccattccataaatatcgttaaataagtgaattaggccgagtgccatggctgacacttgtaatcccagcacttacagaggccgaggtgggaggatcgccttgagcccaggagtttgagaccagcctgggcaacatagcgagaccgcgtctctatttaaaaattaaaaaaaaaaaaaaaaaaagacaacttgagccgcacacaggttcttgccaaagcctctattagtgctgtgactcgggaaagaaaacttgtttttttcttcagttgactgggctcagccatcccaggtgtgagtgactcaggccttgagagcaggtaatggatccatagggagccctgtccccacccagggagactgtcccagcccctcccgatggctccttccagaaaggggcgcagtgggctgggttgcagggggtagttgtgtccaagagtcctgcaggatggagtgggaaggggcaggaggggtgtcctgcactgccagctgttcatctaccccagtgccatggaaacagagctcctgcttttccccaggaaggcgttgatacatttataggctagcattcaacatcagcgttgtgctctggcagtctcagcagtaagacataaacctaccaaggtctgggggaagcactgggtgttaccatcctggctcacgcgggagacgcatgctcctccgtgactgtttgtggccagtgagccaccagttgacaccagcaatccagccttctgcccctctcacttcacagatgagggaagtggggatctgcctaaggtcacactttggtgcatttctcaaatcaaacccaggagccggaatttttctactgagctcctgctaagacaccctgggtcgtttcctccgggcagtccatgtcatctgctgtggcgtgtatgttcatgggtgattctgtttctgtttttaaaccctgtgcctcttggttggtgcttttcctcctggaggatgctgcagacctgcagcggtcacctcgggccacccagggagcaggtgggcacacccaggttgcatctgtcgccacactggtgcaggccgtgttgcacatcactgctgccgggttgaccccacttggtatgaaatgagagggcctcttttctgaagcaaggtgttgcaatttagcctggggatgaagctgcttcttccaatacccagagttaacaccaaatgccacgagagtgagaaaataagacagcattgcactttcccagaaattgtcaccccagggtgccaccccacctcccaagcccactctgggactccttccacacacagtcacccactggttaccaagcctgcggggcaggtgctaggtgcgtgctgggagtcaggggtggatgaggtcttttgcagacagggcagagcgacctcagggcagagccatgagggcctgtgtgcagcggcttccacccaggcaggctccggctctgcaccttcagctacaggatacacttgctttcgacacctccactgtcatttagacacaaagcacaccaccaccgaaaccactccacagaatgtagagtttcttgccaggaaaataaaataaattaaaagtcactaatacttttatttaaattgcgagtacatttcctcgctgttgcattttgtaatttatacctgggagttaatttattgttatttacagttgcacaaggactcatggaaatgccttgtgtatcgagtgttctcattatgctgggcacggtcccaggtgccggggaggcaggtcatagtcctggcctcgtggagctgatgttctgaacgagagttgagtacccagtgggacatcctgagagcccaatgcaggtcctggtcagggctgtggggactgtggggaagacctggatggcaagaggagtagggacaagatctacaggattctgcatgcagggctgcaggccaagagggaggagttgggggttctagtccgctaggttcagggagccagacgtgtctgctgtcccaaacctcctgtgctcaggaacgtggttctgatgagcctgtatcaccttcccttccctccacctatgggtctgagtggcaggaagagttctagctgtgtcagccaaggccggggacaccagaggcacagggcttggtttaggagtcaagacaaggcatttgcttatttaaagaatgagttctatgcacttccaatgagtggttctgtggtcaggagggcggcacctggagagaggtcaaggtagaattgtggatttggaagggtggaggatggaaggccccagaggaaaccagcagtcagggactgaggaggtgatggcattctctagtgtgatgtgtggacagacagagtagaagaaccaaaaccagtcttggagcgacaggtgggtcagacggcagctttctctggacccgggtcaggaagagaagggtttccagcaggagggaagattgcgcttaggaagagaagggtttgctgggctcgatggctcacgcctgtaatcccagcactttggcaggccaaggcatgtggatcacctgaggtcaggagttcattttgagaccaacctggccaacgtggtgaaaccctgtctctactaaaaatacaaaaattagcccagcgtggtggtgtgcgtctgtaattccagctacttgggaggctgaggcaggagaatcacttgaacctgggaggtggaggttgcagtgagccaggatcgtgccactgcactcaagtctgtgtgacaagagcgagactccgtctcaaaaaaaaaaaaaaaaaaaaagagagaagggtttccagcaggagggtcagtggcggtgaagcttgcagctggcaaatgttgggttggatttggggtggggagtgaggccaggagctggtggaggggggcagaggaaggaaagatcactcactgctaagcctttcagatgagttccccgtggtcatcagaggtaggccttgctgtcttaattttacaaaagatgaaagccacaggaggcatagacttgctcagagaattcatactcagttcagcagactccagtattgatgctcaacccatgctgctgctggggagggctcaggggacaatgttaagtgagaccaaggaggtggcacccctgaaccagtctctccgtgagctcggcggtgagaaaacagtgcacagggagaggagccacagaaggcccgggatgtgtcacccagggtttcagctgggaggggacaaagccgatttgggtgggagagtggaagtaggtcccaagaacttttattttaaatgttttgatgacagatttaaaacttgagtaacttcattgtaaaatggccaggcgtggtggctcacacttgcaatcccagcactttaggaggctgaggcgggaggatcccttgagcccaggagttgggagaccggccttggcaacatagtgagtgagaccctgtcttgacaaaaaattaaagaattagccaagtgtggtgacatgtgcctgtagtctcagccacttgggaggctgaggcaggaggattgcttgcacccaggagctcgaggctgcagtgagccgtgatcatgccactgcactccagcctgagcaagagcgagactccgtctcaaaaaaacaaaaaccgaaaaaaccacctcactattctaggcccgagcccgagcttaaatatttaccccatatccaaccataagttaatcccgcacacaccttcatcagtttcttaaagaaactggtgccccagcacggggcatgccaacgtattagacaggcaacaacttagacatggggatgaaatgaattccatcttaaatctcaaagtgcacaatacagtctctaaaattaaagaaaagaaagatttatttccaaaaaagcccacagtgaaataattgtctcagtctgtggagagagctaatttggacagaatcacatattttgattcctgggatttttttaaaaggaatcttttaaagcagtaaatgaaatatttttggatgtagacaaaaatgacttacttagccattccactggcaatgtggaaaggatgaagaccaattttgagttagcaaggacaccttcagaaagttcagctcccaggaattgttgaccctagccatccatgtctgtatttcctgaggactattgcttacggaattaattgggactaatttctgttgcacctgatctccagccaaaacactcacattttgcctcatctgcagagacctgggctgagttttatctctgcgtcactgccgagttccctgcccccgctctgttaacagagctataattaactcacaggacgccaggcagccagattcggccaggcgccaagaaatcagccccaattactatattcacattgtcagtaatgcccacttcacagcttctgctaatttgaaatggcaagttccaactttccatagtaaaattaccatttttgtcctattctattacgtggtgatatttgtccattatttgggctccgtaaacttggcattatcacgacaattagttgttgagggttttctaaaatgatttgcaattacatctcttaagcggaaaactgtctgctctgatggagtgagaatccattccctctgtgccctagatccactttaggaattggcttttcataggggaacgtggtgcctcgggattttataataaagtcgagcctttaaaataagggctagccttggaacgttgcctgctttgtagatttccagtgttcaagttgtctgatttctttataaagatggagaagtgtctctgtccctctgggtctccgagttcccttgagtctgggcctctgtatctggatcccctcaagccctactttgttgtaagagccaaattagccaggggctactggttggtggctctgctgggggggcatcacagagtctctcttctctgacatttgctgaccttcaacccgccctggtacaggagcaccccattgaggtcctccgttttccagagtcctgtccctgaggaatcacctgcctgagtccctgagcttgggactggctggcctgattgggttgtacattttgttctcttttcagcagagaaatctcaggaggcaccatgccaggccactgtgcccctgcaagtgtgtctgagtatggcccaggaccctgcccatcactggtctgcaacaagataagcacagaagttcagagtaggtgtctagaaatgttcatagcaatttaacgtgacggtgacatccaagtggcattttaattttattttataaagatctgagtccacaatgggctggaaatgtaaaaatctgttgtgtgttcttctcccacagattgtttgacaaacattggtcattattattattattattattttgagacagagtctcactctgtcgcccaggctggagtgcagtagtgcgatctcagctcactgcaagctccacctcctgggttcacgccattctcctgcctcagcctcccgagtagctgggactacaggcgcccgccaccacgcctggctaattttttgtattttcagtagagacgggtttcaccgtgttagccaggatagtctcgatctcctgacctcgtgatccgcccgcctaggcctcccaaaatgccgggattacaggtataagccaccgcacccagccaaacattggtcattatttaatctcctcatctctgattggatttcactgtgatcatttactgtggctaaggcagagtgcttgctttttttttttttctttttcttcctttttttttctttgagacagagtctcactctgtcgcccaggctggaatgtagtggcacgatattggctcactgcaacctccacctcccgggttcaagtgattctcgtgcctcagcctctcaagtagctgggattataggtacacatcaccatgcccagctaatttttgtatttttagtagagatggagttttgccatgttgcccaggccagtctttgaactcctgacctcaggtaatccacccacctcagcctcccaaagtgctgggattacaggcatgagccaccacgcctagcgagtgcttgctttttctgctagacagtggtcctcaggcccaatccctgagagaggggcttctgagaggtgaaggaggcaggagttcttgcccctgactctcaggagctggtgtctcctgggcatcactcacggatgggctgattattgctcattaccccacaggatccgacagttccagtacaagctgcttctttgagacagagtctcaccctgtcgatcaggctggagtgcaatgctggcgcgatctcagctcactgtaacctccgcctcctgggtttaagcgttctcgtgcctcagcctcccgagtagctgggattacaggcacccgccaccacacccggctaatttttgtatttttagtagagacgaggtttcaccttgttggtcaggctggtcctgaactcctgatctcaggtgatccgcctgcctcagcctcccaaagtgttgggattacaggcgtgagccactgcgctcggcccagaagacttatattttatgatataagaaaattatatgaaattcccaaaaaaacccagaaaattatatgaaattcaaatttcattgcccatagtttgttgtttttttaaaaaaaaaattgtagtaaaatacacataacataaaatttaccattttagttattttgaaatctacagtttagtggaattaggtacattcagtgttgtgcaagccatcactgccatccatctccagaactttttcatcattccataactcacctccataaataaagttttattggcactcagccatactcatttgtttatctattgtctgtggctgcttttctgggctacagcagcagagttgagtagttgcaacagagaccatatggcctgcaaaacttaaaatatatttttttcttctttcttttctttttttatagagatgaggtctcactacgttggccaggctggtctcaaaaatcccagacctaagcagtcttcctgccttgcctcccaaagtgctgggattacaggcgtgagccatgtagaatatttactatctgaccctttccagtaaaacttggccaacccctgtcctggtgcacactctccttacttcttagttaccatagcaactgcctaactggtctcacttcctttggtttcattccctttctgtatatctgccccctggaggagtttttccaagatacaattctgattgattaacttcgctggttaaaatcttttagcaggctggtgcggtggctcaacttgtgatctcagaactttgggaggccaatgtgggcagatcacttgaggcctgaagttctagaccagcctgggcaacatagcaaaacaccatctctactaaaaatacaaaaaataagccgggtgtggtggcgcacgcctgtggtcccaaccacttgggaggctgaggtgggaggatttcttgagcctgggtggcagaggttgcagtgagccaagatcatgccaccgcactccagcctgggtgatagggtgagacactgtctcaaaaaaaaaaaaaattcctttagcagcatcctgtagactaatgccatgtctgggaacaccagtcccaggataactgcactagttattaaaggctctataaactcttgcagaaaagaaacctgctgaacatcgatcaacccagtacccttcaaaactcattgactgggcaagtctttttccttttttttttttctggagacagtctcgctctgttgcccaggctggagcgcagtggcatgatctcggctcactgcaagctccgcctccagggttcatgccattctcctgcctcagcctcctgagtagctgggactacaggcgtccgccaccacaccctggctaatttttttttatttttagtagagacagggtttcaccgtgttagccaggatggtctcaatctcctgaccttgtgatccgcccgcatcggcctcccgaagtgctgggattacaggtatgggccactgcatttttcttatcacccattctcattagcctacagcagggattggcaaactgtttactgtaaagaaccagatggtaaaatactgtaggtttcggcagggccatatggtctgttacaaagactcaactctgctgtaaagtagccatagataatacaaaaatggtgggcgtggctgtatgccgataaaactttatctaaaaagacaatcaggcccatttgaactcctgtcctgtagagcagtggctgtcaaggtgtggcccaggccagcagcatcacaggacctggggacttgttagaattgcagattctgaccaggcgtagtggctcacacctataatcccaatactttgagaggccaaggtggaaggattgtttgaggagttcaagaccagcctgggcaacatagcgagaccccgtctctacaaaaaaaaatacaaaaattagctaggcgtggtagcatatgcctgtattcccagctactcagtagacttgaggattgcttgagacctggaaggttggagctgcagtgagccgtgattgcgccactgcactccagcctgggtgacagagcgagaccctgtttcagtaataaataaattaaaagtacagattctcgggtctactccagacctgctgaatcagaaaatacgcgggcaggcccagccgcctgtgccttcaccagctctcctggttaaggcctgagaaccctgctacggaaccccgagtacctttcagaacatgttgacctcattcgcagggatcagtggccctttgtcatctggtctctggccagtgtccctccctcatctggtggacttggtactgatgccgaaccacctgtgggttccaaacgtgccattgtttctcccacccacgcatttgcacaaatgtggtcctgtgtggctcactcccttttctgccgccaccttctcccccactgcgccatgctggtctcagctcggggcttacctggtcccagaggtgtgttgggaggtccccaccccttgcctctgcccgttgccttttccacccctgcactgggtgtgcataggtgcgcagggcacgtgtgtgtcctctgcggtcactgacttgattgtctgcctttcccaggaggacatgggctctgtcgggacattttatccgtctgtttacaacatgaaatagacacctccgaaatgtgtgtgtgttccgtaaatgaaggagcagagggaccccttcggagcatctcagaggccaggaagcctggcttctggccgccctgcccgctcctcacgtgtgaggggaactggggaagtcgagtcagcccgctggggttcctgattctctgcggttctgggaagagcttgcagtggaaggcctcccagccatttcctcttctcccccaactgtgactcactgattgattaatgtttggaaattgtgactcatcttgttagagaaggaaaaggaaattttattctcttcattctccctccctttcaaataagtaataaataaaaagtggctgatcttccacttggtgcggtaagaagcatttaaatacattcccggccctcataattggtggcttcttggagaaaggtacttattagaagaaaaacacttccctatgtgttgttgttcggccttctcgttgatgaaattacacggtgagttggtgagcgaatttaccttgcccctttttaaaggtatttgtggcagctcttgttgtaggaatcaggggagaggagccacttctcttttagtaagaaatgcgaagagtggcctctccatcttcagagtttcaaaatgagttcactctggtggtgagtaatgatgtcttaagctggcttattaaaggcggaggaataagatgttcttgctttacctcacgtaccaaatatagataaggcgctggatcagcagagcctcaggcccgtgccaggacacagtcgggcctggcgatgtctgttttgtctcacgactggagggttgaaggggaagcacagcctttgcttttaagggttttcttctgggaaatccacaaaaaaaaaaaaagcatttgttcacttctcacgttgtgatgttgaaattatggcttggagttttacatttgccttttaattctctttatgggcagcatgtctgtatgtcttaggctcttggttctggaagaccaagtaaattcagtatcttttcaaattgtaaccctctggtctgggtaacacagcaagacccccatctctacaaaaaaaatttttttaagtcagccaggcatggtggtgcacacctgtagtcccagctactcaggaggctgagacgggaggatcacctgagacacgagtttatgtgtctgagacgcctgagacaggagtttatgaccatcctgggcaacataacaagagcccatctctatgacaaaatgtgaaaattagccaggtacagtggtgcacacgtgtagccccagctacttgggaggctgaggttgggggatagcccaggagttcaaggctgcagtgagctatgatggtgccactgcactccagcctgggtgacagagtgagaccctgtctcaacaaaataaaattgtaacccaaagtaagggctcaataaatgttagccactgtgattattctattattcccgtcctcgttgtaaatatttgtgtggcttggtgcctagcgtcttttgtagctgtatgtattgccaaggagaatcccaaggaaaaaaagtagaaatatggttaaagctggctgggcacagtggctcatgcctataatcccagcactttgggaggccgaggcaggcagatcacttgagtgcaggagtttgagaccagccagagcaacatagcaagaccccttctctacagtgtgctggcatttgcagtgcagccaccattgcccatggtagcgatgaggaagctgtggcttagaccaacttccagaatcactgctctggtcacacagctgctcgcaggtggcatcatgaacacacctagtctgactgttgcttaaccacgacaaactccatctccttccactttgcctggctgaggatcggatgcattacatagaaatatttgaatttggaagctgttgaaatacaggttcaggccaggcatggtggctcatgtgtgtaatcccagcactttgggaagccgaggcaggcgatcacctgaggccaggagttcgagaccagcctggccaacatggtgagaccctgtctctactaaaaatgcaaaaatcaactgggcctggtggtgcacacctgtaatcccagctactcgagaggcaggagaattgcttgaaccctggtggcggaggttgcagtgagctgagatcatgccactgcactccagcgtgggtgacagagacagattcagtctcaaaaaaaaaaaaaatgcaggttcaaggaagggagaggatgatttgtgttccgctctgcgcctcctccctggtccattcccttctccctgttggaccattgctgtgacacaggtgatctgagcatcaagaaaaaggcatttcttgcttctcagtgatattagcaagcacctgctgcttgtattcactgtgctgagttctacccatttattctctcattcagtctttacatctccctgatgaggaggcataataatatcatgcccattttatagacttgagggaactgagcccaagccattcagccagagagtaaccgagctggagttccaccaggtctgtctgctctgatagcaggcatgcctgacctccgcacctacccacttccccacttctgcagtctcatgtgtcccagggaacgcacagctggggcccctctcctaatttgcacccttcctgagccagttcagaagtcccagactgtgtctttctggctggctgtgtcactgggcccaaggatggtgctacggggctaaagatcttctacactgaccctctccactaacgggaaatcagaaaagggaacttgaagagaacattggcaccaatggttggacctagggatttgtagccacctttctaagggagatagaggacagggctaagagtcacaacttttgttctctacccttgagcaatcgaatacttgcaaagccctgtttctaaggttaaaaaaaaaaggctgggccctgtggctcacgcctgtaatcctagcactttgggaggccaaggtgggcggatcacgaggtcaggggatgagaccatcctggctaacacggtgaaaccccgtctctactaaaaatacaaaaaattagccgggtgaggtggcacatgcctgtagtcccagctactcgggaggctgaggcaggagaatggcgtgaacccgggaggtggagcttgcagtgagcccacgtctcaaaaaaaaaaaaaaaaaaaaaaaaaggaggcagctttgggggacaaaacattcagcgtggccggctctccgcatcttacagtggtagggatgaaatgcacgcgccctcatttgaaatgagaatcgcagtgcctcagttaaacagcggcctctccggatgccaagctgagatcatttccatttctgtgccgagatcggccttttgcagagatagatgggttatatttatcaccagctaacttattagcatgtgacaccagatacaccaaattgtaatctgactcataaaaggatatgtagttcatgacttgatggtgaagcaggtcagtttaaaaaaaaaaatcagatggattatggagtcaacgtttccttcagaaaacttcttcaggggtaaactggtataataggaatgtctgttcagactgttttgaaaacagttaccttgagaattttgtattcctttgacccagcaatcccacttttgaaaatctatcccaaggaaaaaaattagaaatacagttaaagccgcctgggcacagtggctcacgcctataatcccagcactttgggaggccgaagcgggcagtgcgggttgagtgcgggagtttgagaccagccagagcaacatagcgagaccctgtctctacacaaaatacaaattgtttgctgggcatggtggtgtgcaccagtagtcccagctatctgggaggccaaggcgggaggatcgcttgagccagggaggtcgaggttgtggtgggctgtgatcacaccactgcattccagcctaggtgacacagtgagaccctgtctcaaacagaaaaaaagaaatgtggccaaagctttatgaacaataatgttaattatagtgttattgatatactaaaaacaggtgggagggaacaaggctagtgtccaatatagaggaacggctaaatgatgctaaaaatcattcattcaaattattatgtaactgatattgtttcccaagaatatttactaacacagaaaagatcatgatatcacctaaagtaagaattaaagatgctgtatcaccctagtttaatgaaagaaaaatgttcaaaaatataaagacaagatgaatatatagacatacagcacaatagatgcaaatacctgcacatcacacaagggctggtgaacatgaggacactggattcttccaggcctttttctaagtcttagcagggattatttttggttggtgtgagattggcttttttctttgttatgcttttctgtgttttgcagattttctccatagagaatgttacttttttttaggcagggaacggtggctcacgcctgtaatcccagcactttgggaggctgaggcaggcagatcacctgaggtcaggagttcgagaccagcctggccaacttggtgaaacaccgtctctactaaaaatacaataaaaattatagccaggtgtggtggcaggcgcctgtagtcctagctagtagggaggctgaggcaggagaatcatttgaacctgggaggtggaggttgcagtgagctgagatcacgccactgcactccagcctgggcaacagagtgagattccatctcttaaaaaataaaataatttaaaaaaaacaagagaatgttactttttaatttgaaaacaataagaaaatgtccaagtctgcaaaatagagtctttttgaaagactcttcgtacttattaatttattcaccagacatctttaaacggaaacagtggttaagtgtgagagtttggaagtcccacagatcagaaccccagctgccgtttactcactgcagtccctgggcaagtaattcagtcatctgagtttccttgtccctacccgtgtaatgggggatctctggtacccatctcatggagctgctaaagtgattaaatgagacaaaagtatgcgagccctttgctggaacatgtttctggaatacttgctgttattagtggaaatattgccaccgtgccatgtgccagactccgtgtgaagtgtgcagagtgctaggtgggtaaaaatagcccccctccttctagaacctccaacccaaaggtgggaaggggcacacaggtaacagaaatgacagcgttgacatctggtgtgtgctgtgtaagtcatgtcatctgtgctgaaccctggggctcaggagagacgtagtggggctgtcgtgggaactgggccctacttgggagccaggatgtgggcccggcctgaagctgcagcagcagcagcagcagcaagatgtgagaatatttaggagatggaacttggttcagtgggaggagtaacccaaaaggactctagggtggtcctgagattttcttttctttttttttttttttttttgaggcggagtctcactctgttgctcagacttgagtgcagtgacacagtctcagctcactgcaccctccacctcccaggttcaagtgattcttcttcctcggcccctcaagtagctgagattacaggtgcgcaccaccatgcctggctaattttgtattttcagtagagacggggtttcaccatgttggccaggctggtctcaaactcctgggcttaagcagtctgcccacttcagcctcccaaagtgctgggattacaggcatgagccactggccagtcctgaagttttcacagaagcatgaaaacacagagagaattccttttctgtcataaggagatgatgcccttttttttttttttttttttttttttttaagagacagtattgccctgtcgcccaagctggactccagtggtacagtcgtggctcactgcagcctcgacctccctggcttaagcaatcctcccacctcagccctcctaagtagctaggactacaggctcatgccagccaccatgtctggctaatttttaaattttttatagagacacggtctggcagtgttgcctaagctggtctcaaattcctgggcttaagtgatccgcccacttcggcctcccaaaggattacaggtgtgagcaaccacgcccagcctggatgattggatggtgcctatagattcaggaaaaacagacttttcccccagaatgttttccttacctagctctatgtgtgtgcagtgtgtgtgtgtgtgtgtgtgtgtgtgtgtgtgtgtgcaagagagcgtggctaagacaagggtattcacctggcatcctcattcccaagttgccaatactcctctccccttttttcttaactcaccacctgggaagttttcctatttctctccctcctatcccagataagaagaattgccttctttcctcccagctgatttgcttttctcgtcattatatggcaaaccaggctgcactcccctcctaaggcaggcggtggttctctttgggctctgagtcctcagtgttctgcctcttcgggtgccaaccaggaaagccgccttccgcttttagagcaacgtgaagaaatcatggcagcccacgtaagatctctcattatttctgttgaaactgattctatcgagggtggagtgcattgcctttaatttctttgtttgcgtgtattttttttcccctctctctcacaagaagtatattcttttctttcctgtttgttcctgctcgatttggggaggctgctgtttccactgcctaattaatgggaaggtgttctgcggaggatttcaccgcgtacatattctctgtttggacatggtacaacctgtggacccttttaaacatagttacatgtttgactctttatagggtaataactcgattaattttgcaaggctttttagaataccattgttctcttgaaaagaacaggtttgctgttttaacaagactttaatgccatcgagatgcctcacattggcacggttgcgtaagaatcgcacggtcccatgaaatgaaattgagagagctttttccggcgcctggttggttggggcggcctccgttcggtgcttttttcatcctcgacccagtgaccaactgtgtttgccctgatgtttctttcaattccaccattccgaaatgtctccggaatctgtcgttttagcttttgcagcaaggttcgttgtgtttgtcttgcccgcttcaggtttctctaatgagattcacgtgtaaaggaggattggcaattaatcggatgactgattaattgtgagattcttattcttaccaaggaatgctatggaagtcctggcttcagataaaattctcaatgagggccagttgcagtggctcacgcctgtaagcccagcacttgaggaggccgaggtgggaggatcacttgagctcaggagtctgagaccagcctgggcaatatgacaagaccccatctctgcccaaaaagaaaaaattagctgggcatggtggcacacacttgtgatcccagatacagctacttcggaggctgaggtgggagaatctattgagcctgggaggttgaggctgcagtgagcagagatggcaccactgcactccagcctggacaacagagcaagaccccgtctcaaaaaagcaaattctcaaagaggccttaatataccttttttaatcataagctttaagagcctggtcatgcaaagataattcagtgagatgaaagattgtttatttcctactgtgcattggtcacaactttgattccacagaagggcagtgtgctgtcctaacagagctgagtgtgtggagtcttaagagcttcctccctctcagcaaatgtgtattaaatgtttctgctttgccagttccagtgccagtgccctgtgattagaaggtgagcttcaccgaggcctcctggtgttgtggagagggagccccgggaatggctggatgcagaaggtgaaggttgagatgcaggagagggagcagttagccttctggcttgggctgtggtgggtggtgccctccatgagattccaaaaaggactagtttggggaggaatgaaattggcatttggagagtgtaagatactagtggagtctccaagcagagctgcccaggagacaggctggccatgaggagagtagcattcacctggatatagatttgggagccactcaccgggagagagattccatctgtgtgtccctgggcagcgtgatcatgggaatactgcttaacctcaaatccttggctttctctgtaaagtaaatgtaataagatctccacagggtttgctgtgagggttgaacgagctcagtgcacatgaaaatgccctatacactcgaaaccagctataaatattggttattattgttaggatgctgacgttcaaatataaattgccaaaatcatttgggaagcattgcatactccattcccacatggagagttgcagggcatgtgattatctgtttgttcatttagtcacaatattgatcaatatagaacaaagcagtatattttaaaaatcaaccaggagcagccattctttgaagtgttatgcaaccattaaaaattaggtttggccaggcgcggtggctcaagcctgtaatcccagcactttgggaggccgagcaggcagatcacctgaggtcaggagttcgggactagcctggccaacatagtgaagccttgtctttactaaaaatataaaaatcaggcgtggtggcaggtgcctgtagtcccagctattccagaggctgaggcaggaagatggcttgaacccaggaggcggaggttgcatcgagccaagattgtgccactgcactccagtctgggcaacagagagagactccatctcaaaaaaaaaaaaaaaaaaattgcagagagtttgtagtacatgggtcaggcttaagcaaaaagaaagcaacttaggaagtatatatacagtattattacaactacaaaaggaacaggcagaaaaaaccctggaaggaaccatgccaaaatattaagtctcctttagggagcaggacttggagtcgtatttctttatgtttttctgtgctttaaacatactctgccatgacatattccttctgtgatcagaaaaatataaactaacagtaacagcagaacatcccttccccccaaatacaggtgggaattagatgtctgaagagctgaaaacacaaatgtatcgatttcatctttttaatatttccctgcaattcatcttgccttaatcaccgttttctctctgtccgtggaatcacagagctaactgcacagaaacggtgtgaatgaaaccaagttggccctacgtggaatctcaaatcgctctaccctttcgggatcttccgtttaagtttttggataatgaaaatttgatcttgatttcaactaaagctgttgtgtataaatctaacctttctatttagcgaaggtttttagcggtccatagaggccggagataacgaactgttacttgtcttctgtctttcccgtgtctgccatgggttctggtttgtaggcagatataaatgcagatacgtgtgcccctgtcgtgtctgaaaggatgatagaagcgagctgaagactccttcctgggagaaatggatttctcccttgcttttagaatcctcaactcctcccattcattctgagcaatagccatcataccatatttcatcaatctcagatttcttttttcttcctttttttgaaacagggtcttgctctgtcacccaggctggagttcagtggtgcaatcatagctcactgcagcctcaaactcctgggctcaagcaatcctcccacctcagcctcctgagtagctgggactgcaggtgtgcaccactgcaccaggccaatttttgtattttttgtagagacagggtcttgccatgttgcccaggctggactcaaactcctggcctcaagtgatcctcctcccaaagtgctgggattccaggcatgagccactgtgcccagcccaatctcagctttctggtttggccaagggatttactttcaagttgtaaagtaaacaacttgtgcttttctgcttttgccatctcctggttccccctgctgatgccacctctgatgccacttgtcacctttctctaaaccacccccttctctcacctggcaggaaaattccctgcctatccttcagtgaccccagcaccggtttcagtgccagaaaatgtgctgtcctccctgtatttggctcgcctgtcctccccctcactgatgttttctgctcattgggtgggggaggaatcacatgggttaggtgcccatccgtccactcctgtattccatgcgcgaccacggtggcccaaagttggattccagcatgtgatgttgaatgaggcaggcgtggctcccgtccccgggctgcacccagcagttcatcccggatccaggcctctgccttcctctactctcacctcttctcctctgcagagaagtgactgctgctggttagtagggtgggaagtggaggctggagggcatttgagagggcagagctgagttctggcctgatccagtcactcaacagcccatttcctcatctaaaaatagaataataatcaattacttagtacctgtcaacacaagcctatgtatatatatatatattttaagagaccaggtcttgctctgttgtccaggttggagtgcagtggcgtaatcatggctcactgcagcctcagctcttgggctcaagtgatcctcccacctcagcctcccgattatctgggactacaggtgtgtaccacgacatctggctaactttttaattttttatagagatgggatctcactatgttgcccaggctggttgcgaactccttacctcaagtgatcctcccacctcaccttcccaaagtgttgggattacaggcatgagccactgtgcctgggcaagccaatattttaacaggccctttacctatgtaatttcacttcaacttctcggcaaccctgtgaggtcgggagatcgggtgttcttgtcaaaggcacatcaagaaatgacaaggcggtaccgggcacagtggcttatgcctgtaatcccagtgctttgggaggccgaggcaggtggatcacctgaggttaggagttcgagaccagccttgccaacatggtgaaaccacgtctctactaaaaaatacaaaaattagcctggcgcagtggtgagcacctgtagtcccagcttctcaggaggctgaggcaggagaattgcttgaacctggggggcggaggttgcagtgagctgagatcatgacagtgcactccagcctgggcaacagagcgagactccatctcaaaaaaaaggtgaaagaaatgactgagcaggaatttgggcccaggtttcgtcaccaaattttgtatgttttagctatcattattgctgtccttgttattgatgttatcggccctgagggtataatgatgagcagaatatatcccgattctaagaagtcaagaggaaaggaagctagctttgctttatttcaagtttctcattcttttttgccgtcattcttttttgatcacaaaatgcccacctgtgctctagaaaccacgcctccattggacaggctttgggagtactggctccagtgatttgggtggttttgcactgatttctcatccagcaagcaaacctcaacaccttcagactgtccccagcaaccagaatattatcgtttcagagtttcgagggaccatagctgtcagcctgtctgtccaccctgcctggcgctggccttaattggaggatggttgcatttggaccagagcagaggcagatatctcattcctccaatgaaatacgagggcttgtgcaacaggcttcttatctcatctccacctgatcccaggagcctgattcctttccagggagcagcagatgagacttttctctttccaacaccagtgtgtgtgagcgagtgaatgagtagggtttaatggtgattaaaggcgtggtcttcattttgacaccttttgttctataacaagcctgacaaccatgaacctacttcttgccagacagaaaagtcattcccgtgccttgcccctgagcctcctcggaaatggcagagctgcacatgaggaattatgcttcctcgaacagcaacatatgagtcgtgcctcttccctaacaccgctttgcagtttgtgactataatctaatgaatccagctgacgttgatcaggtccttggtgtgggcgaggcactgtgcggcggggagggggcttccttcctttgttcctccctagtgcaaagcagtgggtatcacagacgaaactcacaagccacaaagaggttcccaggtcgagctggcctttgtgcccatgacgtctccctcccagacctgttctccttccaccatccttggttcccagtcagggcatggtggtgggggaagggcagggtcagcagggcatatggcctggccctgtcctgcagtggggttgactgcggtactgctccagaaaaatggactttgttgccagcgttaaaaaatgatgacttggccaggcgcggtggctcacgcctgtaatcccagcactttgggaggccgaggtgggcggatcacgaggtcaggagatcgagaccatcctggctaacacagtgaaaccctgtctctactaaaaatacaaaaaaaattagcggggcgtggtggcaggcgcctgtagtcccagctactcgggaggctgaggcaggagaatggcgtgaacccgggaggcagagcttgcagtgagccgagatcgcaccactgcagtccagcctgggcaacagtgtgtgactccatctcaaaaaaaaaaaaaaaaaaaaaaaaaagatgacttggagattgaaagaggttgaagagatagctaaaggcaatgtgtggacctcatttagattacagttggaaacaagccagcagaaaacgtgtttctgaaacaactggagaaattagaacagtgggtttctggatattttatgatattgaggcgttattgctattatttgtgaagtgataatagtgtttgttttgttttgttttgggacagggtctcactctgttgcccaggctggagtgcagtggcaccatcagggctcactgcagcctcaacctccccgggctcagctgatcctcttgccccaacctcccaagtagctgggactacaggtgcgcgtcaccatgcctggctaatttttgtattttttgtagaggtggtgtttcagcatgtcacccaggccccggattatagtgttttgactgtcttttttttttttttttaaaggatccttatcttttagagaattcacactgagatatttctggatcaaatgacttgatatctgagatttgcaacaattaatacagtaaatgaaacaagcctggccgagagttgatactcattgaaagcgcatgatgggcacatggggactggtgttactgtttgcttgatgtgggcttgtctttgagattttcgtagtaaggtggtattttgcacaaaaccccagctctgatttttctgggaaagtgggaaggcctggtgattgcaggctgctggagctttagatgggtgggaatgtcctaggtggcggatgtcccatggtcatgtggagggaaggatagaaagagcatggcagggggccaggtgccccgacaggtgagggccacctgcagggaacatcagaggtgtgtgcttcttgagggtcgttacccacggtctgtatctccctatattcaccaaaatacacgtgggacttcccttctgatcaggtgcacagcctaggggatcctctgggccgagcggacctgccagggaagctctcaagtggtctggatagaacaagcagggggcttctgcaacaagccggcctagctccaggacacccccatccaagagggatttgacagatccatcccagccccataacttggttcctttgcagagggatcatttggaatttttttattttattttattttattttattttggtgagatggagtctcactctgttgcccaggctggagtttagtggcgcaatctcggcttactgcaacctccacctcccgggtttgaatgattctcttgcctcagcctcctgagtagctgggattacaggtgccctccacttatgcccaggtaatttttgtatttttagtagagatggggtttcaccatgttggccaggctggtcttgaactcctgacctcaggctatccacccgcctcagcctcccaaagtgctgggattacaggcgtgagccaccgcgcccggccagaaatctttttccatttgccacacttgtgacttagccaagtgtctttttcaaagactaataaagccttcacagcttccgaaacaccgcgctagatctggtagccgcggacaatttggattccttctccagtgggaaagattcaaaactgcaggtttcagaagcctttaaaagcttcttgtctgtgtgatgttcattgaatgcaaattctttcgcaaataatggcctgcaactgctttaaagaaataaactcatcttgctgagcccgggcatgtatgcgtcaatggtgaaaaactgcaaacacacattctgttagcagaatcgtttaattaaaccacattcttgaaatggtctgcactataggaagggatgttgtgtgcaccacactttctaaaaagatatgtaaaaggtccccagaaacatataatcagaatttatcctagacaagtaatttcctctccccatgtctgtgtcctcatctgtaaaatgaggtagtggggccaggacgtctgtaaggtccttgtagtgatgctgttcacaggtgctgttacttgggggaatcataatgctctagggtttttggtttggggatttttctttgtttttttgagacagggtctccctgtgttgcccgggctggaatgcagtagtgtgatcgtagctgcctgcagcctcaacctcctgggttcaagcagctccccctgcctcagcctcccaagtagctgggactataggtacacaccaccacaactggatatttgttaaaatttttgtacagaggaggtctccctgcattgcccaggctggtctccaattccgaggctcaagtgatattcccaccttggcctcccaaaatgccaggattacaggcatgaaccactgcacctggtactagggttgtatcgtttgtcttttaaaaaatcttcacataaaagttaattgtggggtgggagggagttcctatatcaaaagtatgttgaaatacaagagtcaagaggttgagtctggggtccaggtgggtcccctggacaaccctctgcagacttgctgctgcttttgttaaagtgtctgggagtcccaagccacatggggtaggggcatcagaagagtctagaattattatttttgagacgtggtctcgccctgttgcccaggctggagtgcagtggcgcgatcttggctcaccgcagcctccgtctcccaggttcaagtgattctcctgccttagcctcctgagtagctggggttacaggcgcgtaccaccgtgcctggctaatttttgtatttttagtagagacagaattttcccacgttggccaggctggtctcaaactcctggcctcaagtgatccacctattttggcctcccaaagtgctgggattataggcatgagccaccatgcccggcctgaagagcctagaattcttcagccttctccaggatatccctgctgcctgggtgggagacaggggagagttggtagggagaggactgtgctgtggaggtatgactctgcaaggtgaccccggctcagcagctgatcagctctgtggccttgggcaggacacggggctccctgaactcctctctccacattggtaaagggtctggtcaggccagctgtgggctagtggtgagagtaacagagatactgatctgttactggaaacgccatgagctgattgctgtcattaacctccctgtactgagagttaaacaaacaggcacctaggatgggtgcagtggctcacacttgtaaccccagcactttgggaggccaaagcaggaggatcacttgaggccaggagtttgagaccagcctgggcaacatggtgaaacctcatctctacaaaaaaaaaaaatgcaaaaaattagctgagcgtggtggcgcacacctgtactttcagctacccaggaggctgaggtgggaggattgcttgagcctgggagttccaggatgcattgagccaagatcgtgccactgcactccatcctgggtgacagagcaagaccctgtctcaaaaaacaaacaaacaaaaaacagcaaaaaaaaaaaaaaaaaaaaaaaagcaggcacccagattttcctgtactgtaaagagaaaaaccttgaatttggattaggaaggtctgaccctgtcacaaacaaaagtgaccaaatcatacattttgaaattcacctcctttgacaaagccaggatcctcatgaaagagaagattctgatgtgaagtcagccctgcactttcagcctttccagcgtgcaggttgatagaatcccacactttttagcggtcgaagggaacttaagatgtagcagttatttcagagttgtgaagcagagaccaaaatagtttgaagctgaattttaagcctcttttggccagatcaaagaaacccaaactcctaaaaataccaaattagctttttaagcatagtttctatctttagttgaaaatgtgtgcagtgtatacttctggaacctgcttaaatgtatccattgaaatgaagatgtaccttgaaaaaagaggcgcctgatctgcagtaataattaagtaactttctctgcccttgactcttgccccaacgcgtatcaggattccacggtcccctttctccttcctttttcaattctgaaaccatccttgtcttcttgccggagttagcaccaaaaaaaaaaaaaaaaaaaaaaaaaagttactcttgtagtttacatgtcataaatgaaaatggatattccctcccagggcataatctgaaatatttgtatttgggtttcaaatgtgtgataagatgctctctgtggcagatcggcctttctaattgctgtgcttgttaaaattcaaattaggctttattctcttagcaaacgttgactgacagttgcagagagtggcccagaatggcactgagtgatgggtggccaggaagcctgcggtaggaaattcacaacagacctttcatagagaaacggctggccttgactttgagtccttccatcccaggtgctttagagacagagccgcctgacccttccttagcttggcccgggggtgcgttggagggggctgttcccacctgcagttcctaaaggacaaactgtctgatacaggcttcatgtggggctggccaaaccccaccgaggtttgcacacaccccaggattgcagaacctgagctcgaggagtgggacatgacctccccacgcctctgctgagtatcccagaccttcccatgtctttcttttctttctttcttttttgaaaaggagtcccattcagtcgcccaggctggagtgcagtggtacgatcttggctcactgcaaccttggcctcccaggttcaggcattgctcctgcctcagcccctcgagtagctgggattacaggcgcgtacgaccatacccggctgatttttgtctttttagtagagacagggttttaccatttggggcaggctggccttgaactcctgacctcagctgacccacctgcctcagcctcccaaagtgctaggattacaggcgtgagcccctgcacccggctgaaccttcccatttctaatcagaactgaccctgggatcaactgacctccttggagtgtagaggcatcctggttgtctggggactttgggtgggatctctgccagttttgcctgcagcagaaggaaagggaagtgacttatcttaggcacctgctttgaacaaggcactgagctgagcacgttcacatgtatctactaatttaatcctgacaacagtcctgaaaaagatactttccccattttccatctggggagactgaggctcagagaggtcactggcctgcccagtatggcgctgccagcaagggttgagctcatattgagtctgggtcggtgtgaccctacagccatgcccttgacactatgccattcctgccctcctggctggttgtgttctgctcacttccaagaatgatttccaatggcttgcaaagttacagttagcacagtatgacaagcaaggcatgagactgggagtgagtgggaacgaagaggaaagaaagtgagaggaggctgggcatggtggctcacacctgtaatcccagcactttgggagaccaaggcaggaggatcactggagcccaggagttcaaggtcagcctgggcaacatagggagacccaatctctattgtaaaaataaattgtaaataaagtgagaggaaaaggcagttagaaccagaattagacaactatccaaagttccccaggccctgtgtactttgtaaagatgagatacagacttgattgtgagcttcccagcaaccaatgcaaaaagggcaaccagataagtcatgtgacttacgctgtccacaagctcaaaacaaagcatgtgttgagggaaagcacagctcctctggtgttggcaaaaaaaattctccctaaagatcctcgtaaaaagaagtcacttggtttcattgccggttacaagttgctggcaaccaagtgccactggcaggtatcttacagcttaatagaagcagcattacattggtctaaaagaagacaagagaattacaggcccatttttaggagtggatacacctctttctataggtagaggaacttctgtctggatttgtgagttgggtgatttcagatactgatttatttttatttatttatttattttgagacagagtctcgctctttcgcccaggtgggactgcagtggcgctatcttggctcactgcaagctccgcctcccgggttcacgccattctcctgcctcagcctcccaagacgctgggactacaggcgcctgccaccacgcccagctaattttttgtatttttagtagagacggggtttcaccgtgttagccaggatggtctcgatctcctgacatcgtgatccgcctgcctccgcctcccaaagtgctgggattacaggcgtgagccaccgtgcccgggccagatcaactgatgttttgagttcagatacagagtaaatgtagcttgtaaagtactggtcattagaaccagagaatgaactctgtccctcttttaaatctggttggtttagtctttttagacacataccgttcggggacaaagagatcgatcagaattttcttgcctcctcggacggcatctgacctggctaggttgcggggatctgttggagagagaagcgtgtcatggatcccgcatcgaaaacagccttgaagagggccaggagcacggaggacctggggagggccctgaccactggacacatctgccctttgctcctcctttttgtctctgctggtggccctttctgctgtattcacgcgccctcaccacctcctgtgtattcgtgtgctggagttcagccgccaaggtggagagagactccctgtcggggaaggactccggccccaatgcctcctcctccaggccaggccgccatggtgggtgggaagagaggccactcctagagaaagagacactgtcagtaggtgtcaggaggtgtcccgggagctcgccgcgtggtaaccaacagacacagcccttcttggcattcaaagttgcaccctgatgcctgtgagggagtcgtgactttctgttaccactgacccagggcagagttttaaacagtgaccttaaggcgaaaagctccagatctcgttactgaccagtgcagccagccactgccttccttcctttttgattctaaaaatgacactcgggttttagagggttgcttttcaggcagccgaaatccccgcatgcaccttctcgtacatttcaggagagaagaatcaagtccatccacggtatccttgcccaggtaccggtatccatcagagcgtgattggggtttcagcagagccaggcctgcttttcctggcagaggctgggcccctttagatttttcttgtagattttgcttgagcctcccagcccttccttgctcagcacctgtgacccactgggtcacagtgacccacatcccatggctctgaccgcagctggactcatctcacactcacgttcatcacggctcccagaaggcacgtgtttttaatgagaggctcatttccaccactgccccccagccctccgcagcaagccagtgcaacgccaggacagtctgctgacaggggaattggagactggagggagcaagttttacctttttggtttgaccatttaaattgaagtcatgcatacagggaaagttatgcatatagaaaaatgtacacttcatactgcgtgcattcaattaatttgcgccaaatgaatgcacccgtgtcccctgcacccagatggaaaatgccaccagcacccttaatagcccccacctggacccctgaattggagtgaattttgaaagaagagggaaagaaagtgacatgtcccaattagaacatatgggacaggcactttctatactgtccaccttgccccagattctttttctttttctttttcttttttttttttttttgagacggagtctcacactgtcgcctgggctggagtgcagtgtcatgatctcagctcacggcaacctccacctcccaggttcaagagattctcctacctcagcctcccgagtagctgggattacaggtgtccgccaccatgcctggctaattttttgtatttttagtagagacggggtttcactatgttggccaggctggtctggaactcctgacctcgtgatccactcgcctcagcctcccaaagtgttaggattacaggcgtgaaccactgcgcccggcccagattcttttttttttttttgagatagaatctggctctgtcacccaggctggagtgcggtggcacaatctcactgcaacgtccacctccctgggctcaagtaatgctctcacctcagcctcccaagtatcaaattctcattttaaaaattaagaatcagacccaaaaagaacaaatgacttgaccatgactgaggccacagagccgaaaatgtccccatcctggagtcttactgtggcacactctcatcttaaccacacactctagttttatcctctctgtgtctttcatagattatcaggaagcgaaataacctgttaatattttcaaaagttcttatgaaatgtgaagtgctgtataatgattaagatagaaaggagaaactaggaaacgagagcttttaatcctagcttacaggaaattctaactagtaggaaatctaattcaggcagcgctgggaaacatcacaggctatgagatgaaagtcagctaaattgggatctaattctataatctaaatatagatgtagatatattacaggttggccttttcagctggagagagtatcattcactccaaaagtgccttttgtatcacagagaagagcgcagccaggggtgatatcagctgaggaagggggcgggcagcttggcgtgaggggctttcattcattccttagtcatctctattttcttaaattttatagtaggaattatttgtgcgttgtatgtataataaacacatggaaaagacaagagcgaggaaggcatctcaggagtgtttttgggaaggaggctgtcatggcatgtgggcagagggaggtctgggaatgggatttgctgggtcagaaagatgtccatgttctttgccaatttggcatcagaaatggcccacaccagccaggtgtggtggctcatacctctaatcccagcactttgggaggccgaggtgggtggatcaactgaggtcaggggttcgagaccagcctggccaacatggcaaaacctcatcgtccccactaaaaatacaaaacttagccgggcgtgatgggaggtgcctgtaatctcagctgctcaggaggctgaggcaggagaatcccttgaacccgagagatggaggttgcagtgagtcgcgattgtgccactgtactccagcctgggcaacagagcaagactctgtctcaaaaggaaaaaaaaagagagagagagagagaaaagaaaaggctcacgcctgtaatctcagcactttgggaggctaaggcaggaggagcttgagaccagcctgggcaacatagtgagacctccttatctctacaaaaaatgaatttttttttttttaatcagctaggcatggtggcatgtgcttgtagtcccagctactcaggaagctgaggtgggaggatcacttgagcccaggagttcgaggctgcagtgagctatgattgtgtcatgtactccaacctgggtgacagaacgagaccccgtctctaaaagaaaaaagaaaatgcctgtttcagttgtcactcctcaccagtgaggcatgggagtgttctcttcctccaaacctcactaaccctggataatggcattgtgataaattttccactggtcaaaaaatatatattgccttaaactcaaaactcgtccatcaacagtgaggttggctgtctttccgtgtgtttgttagccagtggtatctcctgtgtaaattaccttttgacatcctttgtttattttggttggtcttttacctcgtcgtcatcttactcacttttaaagagcatgaattaaggccgggcacagctgctcacgcctgtaaccccagcactttgggaggccaaggtgggtggatcacctgaggtcaggagttccagaccagcctggccaacatggtgaaaccccgtctctactaaaattagccaggcgttgtgatggatgcctgtaatcccagctacttgggaggctgaggcagggagaatcacttgaacctgggaggtgaagattgcagtgagccgagatcacaccactgcactccaacctgggcacagagagagaccccatctctaaaacaaacaaaaaaccacagtatgaattaattatttctctcttacatgttgtagaaatttttcccaaatctaccattcattttgtaaacataaactatatttctgtactctcttatagtaattgtagatttctagtgtttcacttggtttttgaatcgacaacagttttgtgtgtagggtattgtagtgtaagggatctgttttttcccccaggcagatagctcattttcccaatgcaatattcctttaaatattctgaataaaagaaaattttaaaaatcatttttgagcgatgggaaatgtgaaccaaaaatatgcataaggaatttttgattgaaaaacccagacgggggcaggagtttgaaatgaacttcccctaaaagccaaaacttgtagaggtggcagcctgagggctttccagagagctgtaattgactgtttctcccatcagccactctcctctttctcataacttttttgggcagccattaaagatctgatgacgagtgtgaatgtggcagcattttggcattttggatggtggcataattgcacatattgaaaaactctaaatttacatcggtggatccagtgcgtctcattatactggaggtgtgaaaactccatgtgcctctttgaacaattgtcctgctctgtcacagttcaggggaaacaaaagtagctccaacttcccgagatttaaatttgactttattccatttagttgatattgtaactagaatttgaatagtcttttccctttctgattttttttttttttttttttttttttttggagatgtagtttcgttcttgttacccaggctggagtgtcgtggcatgatttcagcttgctgcaatctccacctcccaggttcaagcagttctcctgcctcagcctcccaagtagctgggattacaggtgtgtaccaccacacccggctaatttttgtatatttagtagagatggggcttcaccatgttggccaggctggtcttgaactcctgacctcaggtgatcctcccgcctcggcctcccaaagtgctaggattacaggcgtgagccactgcacccagcacccttcctgatttccatttccgcttttatctctccactcccgaagatgtatcaacccacaaggaacttccttccagcccttacttaaaacattgctctttttccagctccagatattccctacattggctgccactcctccttgtctctgttcagtcttggaaaattggtttggtccaagctgaagctattctttgaagaaataccattatttttaaataaaaggattccccagcctggacagtgtagcaagaccccatctctaccaaaaaatcaaaactttagccaggcatgatggtgcacacctgtagtcccagctatttgggagggtgatgcaagagaatggtttgagcccaagagatcgaggctgcaggttagctatgatcgtgccactgtactccagcctgggcaacagagtgaaaccgtggctcaaaataaataaataacataaaaagattctcctttgagagaatcgcttgaacccaggaggcagaggctgcagtgagtcgagattgcaccactgcactctagcctgggtgacagagtgagactctgctcaaaaaataataataataaataaataaaaaagattcctccttccaggagccaagaactaggaatttcaagctgcaatcttgctttttaagcatggttatatatggggggtcagcagaatgtgtgaaaattattgaaaagtaaagcatgagatgtgactgagctcttgagagcagaccactttccccttcttaaaacgttttttttttccctgacccctgtctgagatacaggctctcctggttcggcccaccttgcccatcactctgctgggtccccactcgcgccctgcacctgaggttagagggcacataagtctcggggacctgccctttgatatctacaagaccctgtcctcaggggatcccatcgactctcgtggcttaaaataccatccacagaaggatggcgtctatatttatattaacccaaatattcaactgaatattcaacatctctacttggaaagacatctccggcttcacatggcttcaaaagagaactgttgacccctcccacacacaccgcctgcaccaccaatcccagtccccctgtcacctcgggaaatggcgtcaccacccaggggctgctcaggctaaaacctaggtgtgccctggggctccccctcctctcccccgacatgcctggtccaccagcaagcccgtccttcctcctggatacacctgggctcccagctacacgctgtcaccttggcccaagccactgtcatggccaccccaccaccacttccgttcttggctgccttctgtccattctctttccccagcggcctcagttttatttctaacgaatgcagttcagatctttccgtctccctgctagaccctctgatgtctttccatccaaccttccacattctgtgaccccacgtcgccctcactggctgggccacggcccctctagccccggtcttcacccttgaacctgcctagcctctgtcctcctcctctgcgccccgtggcttcttccactttcttccacctggctcacccggaattccagctacttgtgctcttcctgtcacacattgcctggtgtgtcatttccatctctgtctacctttccctcctagaatgccattcccatgagagcactttcaggccacttcacggcgtacgtccagccccaggcacagagcccggggtatcataggtgcacagtaaacatctgttgatgggctggctggattctatgtgggaagcataatgaccagtggtcacaaattactggggccagaggggcgctgcctggtgttaaccgcctggtgcctgccctacctttaaagccaagagtgtccatttaatgagcaagaagcagaaatcctgggcaagcagtgcagatgtaggctctcgggaacatgttgaccactcagaaaaccttccaggaggtgagtaccaggagatggaggtgctctagactgtgatgctgggaaaggattgtgggctagaaaaagggctccctagggccggcatatgggccactgggtggaagaggggctctgagaccctcaccctggagcaggtcatcacccacaccgaaggaatgaagcgtgaattcggtcacgcttaaaatgttgaattgttggcaaaagcccaagttaatgaaatagcatggaaaatggatgtgatgagatttttgaattgtaattagattaacattgtcactagttatcagtctgatatatcttataaatcaaacgttgggttgatttatcttttatcacttctagggacttactcctaacagtaactcacaaaccagccccaaatcagagctggtaggatgggctcccagctatctttaggaggtttgttggtttggggaagacagctcccccttggcagggctcaggtgttttctttcttttttcttttttttttgagacggagtcttgctctgtcatccaggctggagtgtagtagcacaatgtcggttcactgcaacctccacctcctgagttcaagcaattctcatgcctcagcctcccgagtagctggcactacaggtgcccaccaccatgcccagctaatttttgtatttttaatagagatagggttttaccatgttaacaggccaggctggtcacgaactcctgaccttaggtgatccacccgccttggcctcccaaagtgctgggattacaggcgtgagccaccgtgtccggctgggtgttttatttcttcgtctgttattcaggaactttgtttccagcgctgtgagtatgagtacaggcccagggctgggtgacagagtgcggagagcggggccctacccttgagctgtttctggaagggctcccagccagcaccgggcttagggagcagtgccctgcagtgtcattctgggccagggaggttgtgatgaatattattctcaacagagggtccccagggcagtgatgccactactcaggatcttacagaagaagaaccttcaggctgggtgtgggggctcacacctggaatcccagcactttgggaggccaaagtgggaggattgcttgagcccaggagttcgagaccagcctgggcaacatagcaagaccctgtttctccaaaaaaaatgtttaaaaagtagctgagcatggtggcatgcacctgtggtcccagctactggggaagctgaggtgggaggattgctccacccgagaggtcgaggctgcagtcagctgtgattgtgtcactgcagtccagcctgggcgacagagggagaccctgtttccaattaaaacaataaaaatcttcattttgaagaatctgaccagttctctacctggcacttgagtgaaaaatgacacaatccaaagtaggtggcagattggttctcactcaggcagaccctggagacacctctcccgcttctgactcaggggagagtgcggtgacataaaccaccttcttctgctctaggccagcttgtaactgttcagccagccagccgtctcctaactctgtgacccccggcccaagaacagggctcctgaaggccccgagaaccagcccgccgtccgcacggatgtacctggaagccacagtgccccacaccccgtgggactttctcccgaacacagcacctgcgcttcctgactcctctctctgaatctggcctttgagttcaatgtcctgggaacttaactctagggatgctctttccccctttagctaccgagtcacatgctgcgtctttggaaatttcaggcaatatttagtttggtgcaaaagtcattgtggtttttgcaattaattgcaaaaataataaatggaaaaatgaatttgtggacatcaggcttgcctagggagatgacctagggagaggcctcttttggcatagctcctgaacagggagaggtcctgacatgaataccccccgttttgtgaatcctgagccagtactgtgtccccggccccctcctcccccaacctatacacacgcctcactttcccttgcaggacgttttctaccacagttcctctctcctgacatagtatgtgtttgtttcttacttgtcttgccgcatgaggatgtaagttgcctgaattcaaaaacatgtcttcttttttgtgaatgaaagagtggctggcatgtagcaggtactgaaattatttgtagagtgaatgataaatctcagttcagggcactcagtgtggcctgggctacgtggaatagccaattggtggccacagagagtggccagccattcccaggctggcaatgtgagtcttagccactctcttttacagataatgtgcttattaaaatgatatcccaggcattccccagtggtgtttgaatcgtgaatgcaaatgtcagaggctctgaagtttaaagtctttttttttttttgagacggagtctcgctctgtcgcccaggctggagtacagcagtgcgatctcggctctgcaacctccgcctccctggttcaggcgattctcctgcctccgtctcctgagtagctgggattacaggcaagcaccaccacgcccagctaatgtttgtatttttagaagaaacggggtttcaccatgttggccaggctggttttgaactcttgacctcaagtgatctgccgccttggcctcccaaagtgctgggattacaggcgtgagccaccgcacctggccaggtttcaagtcttgactctaataaaaccagggaggtttcgctcagccacataagtgggagggaaaattaactgttgctttctgtattcaccaagatggcctaaaataagcaagcagaaaagggaagaaagaaaaccaaacccatgaggttgtccaagtcgatcttggcaggtattttcttgcctgttgattgctagagtttccctctacctgcattgcaggctgaaatgtatgactcagccctgaccaataacatagcagtaaaaagtagtttcccctgagagctttctcttcctccatagctgtgactgctgacatcttccactgtaagtgagaaaagttgagtgtgccctgctgcctcgtttttctcaccaaggtgttatgagctggtagggaaggccaggagctagggcagcagctttagaattagtgcaagagacaggaggacaagtcactgggtctcctgaatttcctcacctgcaaaacagggacagtttttaaatttcttttttttttctttttttcttttttgtttgagatggagtcttgctctgtcgcccaggctggagtactgtgttgtgatcttggcttactgcaacctctgcctcccaggcttaggtgattctcatgcctcagcctcctgagtagctgggattacagatgcgggccaccatgcccggctaatttttgtatttttagcagagatgaggtttcaccatgttggttaggctggtcttgaactcctggcctgaaacgatctgcctgcctcggcctctcaaagtgctgggattacaggtgtgagccaacagggacttttttttttttattatactttaagttctaggatacatgtgcacaacgtgcaggtttgttacatatgtatatatgtaccatgttggtgtgctgcacccattaactcgtcatttacattaggtatatctcctaatgctatccctcccccctccccccaccccatgacaagccccggtgtgtgatgttctccttccccaacagggacagttttaatcaatcccctttctgggtggtgtcaggacacccacagaggtgtgggtctaagcgctttgtgagtgtccacgtcctgtgcctaaggaaagcactagtcattcattcattcacccaacagttcctgacggcccacctcaacaggaaggaatattatacagccactaaaatgtaaaatcaccagtgctgttcagaaggacggagatgtttatgtcattggctgtgtgaccaaaagaaaaagttctgctggggatgtgggatgggcatatacgtgttttgaatataagatctttctttaatgctgttatatttggtctccataaaataattattctttgggtgacaacctcttagaaaaagaaagacaaaagcagctatttgcataaacctcagcccaggtgtggtctccagccccaggaaacttctctaacacccctcccatcctcccaccagtggttcctccctcggtggcatgaggtggttcagtttttttcctctgtgcccaccctggggtgccctgggcccatggccactgactgcagtgaacaattatgtgtgagtctgttagttcatttgcattgctataaagaaatacccgaggctgagtaatttatgaagaaaagaggtttacttggcccatggttctgcaggttgtacaagaagcatgacgccagcatctgctgctggtgaggcctcaggaagcttccagtcatgatggaaggcaaagaggacttgacatatcacatggggagagagagagtgagaagggggaggtcccagactcttttaaacaaccagatctcacaagaactcagagcaagaattcactcattaccaggaggtgggcaccaagccattcatgagcaatctgccctcatggcccaaacacctcccaccaggccccacctccaacactggggatcacatttcaacatgaaatttggaggggacactagccgggtgtggtggcatgtacctgtaatctcagttactcaggaggctgaggcaggaaaatcgcttgaacccgggaggcagaggttacagtgagctgagattgtgccactgcactacagcctgggtgacagagctgagactgcaccactgcactccagcctgggtgacagagcaagactctgtccccccccaaaaaaaaaaaaatatatatatatatatatatatatatatatatatatatatacacacacacatatatatatgtgtgtgtgtgtgtgtgtgtgtgtgttaggggacagatgtccaaagtgtgtcagtgtccatcatggctattagactgtcaggcattgaatatgggcccatgttttatttctctttatttcctcattgttgaacacatgggtgtgcctcctatggatgggaccagtggctgactcacctttccaaacttgcatcctgatgatctgtaaagtgtacccaccctgtaagattgtcgtgggacaatgtagataaaaacctcgatatacagcctagtacacaaaggacggtgtaaatattctcttccgtgcttcgtagatttcatttttgaacgctcagattgttctccggcaaaaaaaaaaaaaaaaaaaagtgcttgcagtgagaacctgccctgcactctcaggcgagctgttgggtgcaagtcctgcaggactgagctctgaaggccacccacaccctgggttgtgcttggatgatggcatccctcctggcacaagcgcagatgggcagtcgggagggaacatcagcctgggaaaactagatgtcagtgaaaaatgctggaggtggctggcgttcgcaaaactcagtcgtaaaaaacagcacgttctcagtacaaaatgagcactgttaaaaataaaccgcgcaagaagaaatatatgaatacgagggcatggcaaacagttttgcaaggtattaagatcgcattaatcttaattttattatatattaaagtttctaacttttcaaataatgcagttttcgttgttttaaaacgtctgagaattatagagctatttggtgtggctctcaggcaaggactcctgccatttattggggccctggttttatttaatagccagatgaatggaatagttaataaaagaaatattgctttattccctgacatttatgtccttggtttccaataaagaattgaaattatgaatagttgatggtttaaattgatgttttatgttgaacgctagctataatttgccctctgaggattgtaataccgagaaacagatggtttctcacagtaacaaattgctatgtgtatacacgctatagtcttggctttcagatactttcacctttggttctgagctgctctgcagacgggagaggggggtcgtgcggggagatcagcctctggaggaaggggtttcctgccctgtgggggagacacagacaggccctgggggttcagggaaactggggaaatgtagctagcctggcatggtgtcagtacctggggccaagaggagcgttctgtccacgatcatggtggcagctgcaaggtagtgcctgcaggactgctgtgcatgtggctgtttgacaccatgccgtgctgcaaactccacatcttcctagaacaaccaggagaatgccgtggagacttgttgccagatttttgcagttgccctgcagtggagaggttaagagcttggactccggagccaggtggctgggccactttgggggaagtttcccaaattcccacatctcagtttcctcatctgtaaaatgtgcataagagcaaaagccaccaccctgttttgaggattcagtaaaaccatccctctaacacaacactgagcccagtgccgggtatggtgtcagtgtctgccaggtaatggtgtaacgaaaattacaaagcagattgatgtggtgtgattcttgacgttacaaaagcttccttgtttttcagagggagttcccacaggggttctttagacaggcagtgcattaaggttgcagaaatttactttccagaaggttttaaaggaacgcagcttcaatggcagcaaggtacctgaaacaggaacccttccagagtgtctctgttttgttggcctttgagacctgccgcttctgactgcggggacctgggctgccccagatctgtctgtcagaagcctggagttgttaagctggtgaaatttaacaccactgtaaagagcccctcacagacaattcaggaacgcttacagatagaaaccggtcctggttttaaggtgtaattttgcacaagtgttaacaacaagagatggaattggtaacgaggcactggggtcggatcttcatatttttgtcacatttcatcggtgagatcagtaggtctgtctcccctaagaggagtgtggaatttagtgtttttccttttttgggctgtgacccaagagcttgttttcaagatatgtatttatttagaatacaaggctcttttccataaggaaagaaaatgttacagaaatgagctctcagttaattgaataagaaacctgttcgtctcatgactcacttaagagagagctggcagcccttcctgaatgcctattacaggcggcactgtgtccttttacttaatcttcccaaggaggatgagggttgcaggctccccaggcccatcgctgtgttggtgagtgacagagcctctgtaaaggaatggggatgagctctgagcccttttcccgtgggctctgctgcctggaggcatgccctccctcggcttgtcttccagctctcgcacagaaccaagtgttaactggtggtggtttggagacgagaggaaatggaccgtaaggaccattgagttggcataaggagaccagggcccaactccggaccctaccagagcagagtctttctcctctgtaatgtgagactgtagagctctagaatgttccttctccaactcagagctgatgctgtcagggccctgctgcagggtccttcagtggctccctgtggcctgaaggacaagccagctcctgccctggaagccgtggggatgtggtcctagcctgtgctcctgcctcgctcacctccctggaacaccagggccacctctctgggctcctcctgtgccccagtctgctcctgccacccctgtcccaccgtgcttcctccctccctgtgcctcagctcaggccttgccacctggagctctgacctcgtccgtcttggaatgaggcacctgcatgggtagcccatgggtagagttgcagtcatctgtttgctttcgattcactcccgcatcccgacacagtgcccagcacatcatcgatgaatgagtgtggggcaaatgcttgcacagaagtccgtgcgtgagccacgacggtaaacagaggcgctcctcttgtcctaatgtggaactccccaagctacgggaaaggggtgcatatggaccgctgctcactcacggctcagatacttccacggtaatgggttggcgacagtgactcagcttctcataggttcaagcggaagaaatggtgagtcctggagcactgcttgctttgaagtctgtttcagactagggtcatgtttcaaagtttttgaatttcttttttattcaaaagacatttgatgagttgactattgggggaaccttgaccccggtgactccgtgggacaggggatacccccggggtcccttataagcctgctgactcaccgcctgttctccatcttctgtcttccacattagaagcaagggcggggacattgcctttcccggccgctgcggtgtcctggcgcagggcacgtgcctgagggcccttggtcatccgagggaggactgcaccagggacatcagagtgctgatcttacaggaaacggcaaatgaatggaattggtctgactccatattactccttacttagatgtaaaacaaatacacatgatttttcatcctagaagaaagtctaaacgaactcttgacaaaaacagccaagttcagagaaagctgactctgttggtgtaagaagcgttttttcaggctgggctgctggctcatgcctgtaatctcagcactttgggaggccgaggcaggtggatcacttgaggtcaggagttcgagaccagcctggccaacatggggaaacctcgtctctactaaaaatagaaaaattagctgggcgtggtggcgcatgcctgtaatcccagctacttgggagactgaggcaggagaatcacttgaacccgggaggcagaggttgcagtgagctgagatcacgcactgcactccagcctgggcaacagagcgagaatctgtttcaaaaaaaaaaagaagaagaagctgttctccgtgagtcagccccggtgtctgataagtgtctgcagctgacagctcagagctggtgtcaacccactttggaggctggggtgggaggcaagaaacccagacagaacccctcctggctgcaaaacctccaggcttaactgtggcgcccactccatggtgggtcttaactctcctgaaaacacttcatgggctgtgggcctctcgggtgcttctgcgccagctcttcctcttcacctcctgccacagatctgtgtccccaggctctcctgtgtgtctccctgctcctcctttccctccaggtccgattccacagccctgggctgcctttccacctctgccttctctggggtatgtcctcgcctctcctgtcaccattgtcctcagggatcttccagctttccaggcatttggaaagaggcctccataccttgatgtggcctcccaggttccttgcgacagagtcctgcgtcgggataccaggggctgggcgcggtggttcatacctgttatctcagcactttgggaggccaagacaggaggattgcttgaggccaggagtttgagccagcctcggcagcataatgagattccatctctacaaaaaaataaaatttagccaagtgtggtggcatgcacctgtggtcccagctactcggaaggccaaggcaggaggattgcttcagtcctggaggttgaggctgcagtaagctataatcgtgccattccagcctgggaaacagggtgagatcctgtctcaaaaaaaaaataataataataataataatatttgtaggggaaggacactcagatttcctactggaagcaaggcttcctcattccatcagattctgctcctcctccaaggctcggctcaggggcctgcccctccatgaaccttcccagccctcagcccccttccttcctattcccccagcaccgacgtcacctcatcctgcccgactctgtagcatgcaggcctccgtcctccacccagctgcagaaccggagacctcaggtggtatctggttccacgtgtccccaatggcacctcgcctggaacgatgtctgcgccgaccagtgataacaatcgaaatagcaggcgtggctgaccgtgtgccgaggctcggcgtgccgcactggccagccgtgatttcatctcagcctctagcatcctgctggggtaggttaataatccctggatttctcagatgggaaatgttaggaaagtctgtaagcccccatggaaggtcccggagcccaaattcaaacccgagtggagcgttctgttgcttcactgtgctctggtgtgaattttaatgtaaggccctggcatttaagagctcgaagacaccatggaggtggagagctcagccctgtcattggatggaagctgagactggtgagattctcaccggggcttttgcagggagtttgggggaattttgaaggtggtacaggtgttctgaccccaacaccatctcctccagctgggccacacacttatttcctgctcctacccccgtccttcccaccccttggattctgggtgtacagaagagtgggcacatgctaaggtcagccctgggttagcctcatggacaaggtgggcctggagcaggaacccgcctgatagaagacactcaaagtctgtccgtacacgctcggtgtgggcatcgcttgcacgcaggtgcagcttttgctgtgggaaaccactttaaatgaattgatagcctcaccacagtggagccatggcccgactgtggagagactccattgtagagaaatatttgagtgaaaggtttcatgtcagaatagcatctgcatgcaaataagaggcatgggcgggtgcagtggctcacacctgtaattccagctacttgagaggcagaggcaagatgatctcttgaacccgggattttgagaccagcctggacaacatggtaagaccccatctcttaaggaaaaaaaaaaggtttaaattagctgggcgtggtagtccccgtagatgaagttatttgggaagctgaggcaaaaggattgcttgagccctggagttcaaggcagtagtgagctatgattgtgccactgcattccagactgggcaacagagccagaccccatctcttttgtttgtttgtttgtttgtttgtttgttttgtttttttgagatggaatctcacccaggctggagtgcagtggtgagatcttggttcactgcaacctccgcctcctgggttcaagcgattctcctgcctcagcctcccaagtagctgggattacaagtgcccaccaccatgtctggctaatttctgtatttttagtagagatggggtttcaccatgttggccaggctgatcgtgaactcctgacttcaagtgacgctcccacctcggcctcccaaagtgctgggattacaggtgtgagtcaccgcgcctggcccagaccccatctctttaaaacaaaaaagtacatgggataaatggggaaaacactcttgagacaagaccaaaacatacagtggctgctaaatgtcagtgccatgagcccagggttctcctacatccccttccgtggtcagggaggactgctgggctctgtgtcttctgtgattctcccctggctctgagccctttgcacctgcaactcacagcgccgctcaggtccctgggggtaaagtgccataggataaaagccacaggagggttttgaaatgctcttttcctctcagatatgtatttccgcatctttacggagtctcatcaacgctttttaaacctcccctgggatttgaaccagcgcccatagatacaggtggcttgtcaggtcagctaggtgctgctactgaggcagcatctgtccctagccccgcacccacaggttcagaaggggaacgcttcccccgggtggcttatgagatccagtacttctagtttcacttctttaaaaataccgtaaaaaagaaaaaggctgtcaaaacacaagcagtgtttgaaacgaagctttgtaggtccccctacaccaccaccgtcgtgggcagcatagcggatgagttctgggacaccagctaaaatgtgggcaagagaagccagggcgcgtagcagatgtgtgtgtgtatctttatgggattcaagtcatgtctctgttttgttgaccaacttccgctagaattcatagccatctagcctatgtattggatttttatttctgtgatgtctgcttcttttaaaaatatcagttggggccgggtgtggtggctcatgcctgtaatcacagcactttgggtgaccgaggggggtggatcacttgaggtcaggagttccagacccacctggccaatatggccaaaccctgtctctactaaaaataccaaaattagctggacgtggtggtgtgcacctgtaatcccagctactcgggaggctgaggcaggagaatcacttgaacccgggaggcagaggttgcagtgagctgagatcgcgccactgcacttcagcctggggaacagagtgagacttcatctcaaaaaaaaaaaaaaaaaaatcagttagtagccaggcaccatgcacacacctatagtcccagccactcaggaggctggaggatcacttgagttcaggagttcaagaccagtctgggcaacatagcaagacctcatctctacaaaaaataaaaaattagcagggcatggtggcacatgcctggagtcccagctccttgggggaggcaggagcatctcttgagcccaggagtccgagaccaacttgggcaacatagtgagattccgtttcaaaaatatgtatcagtaggttaatctagactttgtttacatgggccaagtggccaaggtcacatcttagagttgtggactgtataatcaggtaagtgtggctacagtcacagaaagtcagggtagaaagaggcttggaggggggtgcacttcttctagccagagctttcctactgagctccttaaagcacaggggaaagtgggacggggttggggggcaacctaaaacccaccccctcccatcttcaaccagtgcgaccctgtttttacctgctcagcagtattgtgcatccctgtaaaattttatttgaaaatggccttctgcagttaaaactacaaaaaaaggttgaaagtggccaacttaaactccactctgtttcttttttgattggggagactggtgtgcatagaagggaggtgtcagctaacgagactgttacctcaccacagatgcccacccgtgggtgatggagctcccaagtcctgggccacaccctacgtgccccatgcccagcaagttgggtgggggaggggtcagtacatgtttgtaagataaagaaaaacatccttcccaatcagccgtattacccagagggtgatactgatttagatcttatttcagtttggttagagaagctcaggtaccagtgagcagaagtctggccattgtggtggcttctggaagatgatgtgccatactgttagcaggggtgcaatttggggtgtgaggccaccagagctttgatttccgcccccgccgcccccctccaacccccgccccgccggattatttggagtttttttattgttgttcatggtaattacctgctattagacaacaatctagttccatttgcaatagggaataatacgtctgtgacacagtctccagacttagggagcctctggccaccccgagggggccctggtcattctgctgctggtcatgcctagctctgggtggccgactaggtggcctgggcgggagggtccactctttgcctttataaaaagaagggcttgggccaggcgttgtggttcatgcctgtaatcccagcactttgagaggccaaagcaggaggatcaccttaggtcaggagttcaagaccagcctgaccaacatggcaaaaccccgtctctactaaaaaatacaaaagttagccgggtgtgtggtgggtaccagtaatcctagttactcgtgaggctgaggcaggagaatcgcttgaacccgggaggtagaggttgcagtgagccgaggttgcaccattgcactccagcctgggtgacagagtgtgactccgtctcaaaaataaataaataaataaataaataagataacaaggcgtgctggagatggccacaggcctccagcagccgcaccatcagagaaatggagtcagagagagctgcagctgctctgatggggggtgggagtatgcaggatcctctgggggtggctcaggcctcccaggggagcacttaccttttcatttcatagtatgtcggagctgctgatgcaggaataaagcaaagtgcctggcactctgcgcgactgctattttttcattcattcatatatttgtccttcctctacacatgtatggcagattaacaaaagcacctccacggcctagctatgtggcccccacgggtttcttagcctctctgagcaagttggacagggctgccttttcctctccctaactctgacttctgtcccagcctcttccatctaatgtcagccctcatccctgcctgcccctcccggtgcagactgggacattctcaggctgtttgagccaccccttcatcctctgtgcttttccctggcatcctggactcccttctccccttcatggtgctcctaggccattcccagcgctcctgttactctctctgtcctcccagccccaaacccgtccagctctgtatccatctgcctggctgccattcatgctgcagacgtagcactcccagagcccatctgtctccacacattgaggcttccagccccctaaccccggtagtggccacagtgcccagtgggccaccccagccaagcccaagagtggccacatgggagcccttcttccatctccctcccctcatccacacattaccaagtcttgccaatttcatctcctgaggacctcagcttctgtcattctctccccattatactgcagttgccaccgttatttctctcctagaccttggctggcattacttggacattcatttctttggaatctcttggccagctttgcacacctttaactagactaagaagatttgaggccaggggcagtagctcatgcctctaatccccagcagtttgggaggccgaggtgggcagatcacctgaggttaggagtttgagacctacctgggcaacatggtaccccgtctctattaaaaatacaaaaattagccaggtgtggtggcacacgcctgtaatcccagctactcgggaggctgaggcaggagaatcgcttaaacccaggaggtggaggccgcagtgagccaagattgtgccattgcactctagcctgggtgacagagcgagactccgtctcaaacaacagcaacaaaaaaggaaatatgagctcccttcccagatccgtgcctctggacctgggctgaaggcttctactccctccattgtcaccttcgggaatctgcttgttaccttcctcccaagaatgttccagaaggtcttggtttaatttctggagggcattcaagaactcagtcatctcacgtgtctagaagagaaacattaaggccaggcacggtggcttatgtcggtaatcccagcactttggaaggctgaagcaggaggaccacttgagcccaggagttcaagaccagcctgggcaacatagcaagatctcatctctacaaaaaaaaaaaaaaaaaaaaattagccgggcatggtggcacatgccattagtgtcagttatttagaaggccgagacggggggatcatttgatcccgggaagtgaaggtgctgtgagctgcgatcctgccattgcatccagcctgggcaacagaacaagaccctgtctcaaaattaaaagagagagagaaacaaacatggcagctcagaaacctggctgggggtgattgtggggaactgctgctgacgggctcttgggcacacccctcactccagccattctgcctggatgccttaggaacactcctcataccctcctaagagtcccatccaggccgccatggctcacttatccctgccacgtggactccagaaaacattctcagtagaaacccacagaaactgttcccagtcacaaagcacgccaggtgcatcctgttctttctgtcatttaaaaaaatgaatgtgtctctatccctccttcttataaaacagtaccctctcaccctgcatggcttaaattctggtctatcttacgcctttggattcaatgaccttcatcaaatgtctgcaaggcaagggccatttacagtaaacatggtgggaacttagcaatgtacttgggaaataaattctggtcaccaaatagagaagcaaatgcaacaaataatcccacagaccattataaaatgtcttttagacgatagttgtcaagaattagagttactcgtccaaaactgttgttggtgtttggaagcatccaaacatcggctggcccatgtcccataggggcgtctgcttagcaccctggtgagtggagagttgtgtgtatggggacttagcagagtgggaagcagcttgcaggaaggttgccaacgcttattaatatttaccaaaaagatgcaggaccggctgcggtggctcacgacagtcctcccagcacttagggaggccgaggtgggtggatcacctgaggtcaggggtccaagaccagcctgggtaaaatgtagaaactccatctctcctaaaaatacaaaaattagccgggcatggtggtgcacacctgtagcccagctactcgggaggctgaggcaggagaatcgcttgaacccaggaggcggagattgcatgagatgagatcgcgccactgcactccagcctgggcaacaaagagcaaaactccatccaaaaaaaaaaaagagagagagatgcaggaccatctgcctatgttccattttggtgatgatatctgaccttctgggagagagaacatcttaccccacagacccaggaaggcatgcacatgaggatggcaggagagtggctgtggacacttcctgtgtcaccatcctctgctctaggtgtgtactggtcacaggcacaggacagaaggctccccagagtccgatcccgtctcttgagctcagctggctatcctggaaccccccaacccgctgacctttggaagtggacagcagcccacgcctgcaggtggtccggccctgctgtgcagccctgttacagcacgttgtgtttttctggcttgtctctgccaagccccatgtgaccatggagggggccccgagcagacctgggggtggcggtactgaggcagaggcaggcgcacagtggtttccaagggagaaaatgaattcatgatctaaaatgcaaaaccttaattatgcctgactcctttcctccctccctccctcatttctctccctccctccctccctccctccatccatccttccctcgtttccttccctccgtctttttccttccctcccttacttccttcctctcttcctcctacccttcattgacctttcattttgtgactttgtcaaatacagccccaggctatcttctctttctcctctgctccaggttgttttctcttgctcctctgccgcatacatacccttccaccctgcgtctgcccatggaaatctcgtgtcccctccagtattcctgcccacagtggcctttgttaggaaattccggcacagtctcctcacagggcagcccttctgggaatcgctcccctgcgctcgtgtgcactcccctgcgctcgtgtgcactccggcccagccttcagagctgcttacctggctcttgtcttgtgtcctctgaccgcccatcagggcctgcccatggggctctgtctgcaggggagcagccccaaacacagtccttgtcagcacgccgatctggacctgaattgggcccttgcacacactagctgtggaccgaagacaaatcaggttctccccgtccccagagtggggaaagcggtagtgtgggcctccctggggtgcccatgatggtgtaatgagtgcgtgcacggagcctgctccacgtctctatggacatttccataacttttcttttggtttgtttttttgtttgtttgtttgtttgttttgttttctctgagacggagcctcactctgtcacccaggttggagcgcagtggtgcaatctgggctcactgcaacctccgcctcttgggttcaagagattctcctgccccagcctcccgaatagctgggattacaggtgcccaccaccacgcctggctactttttgtatttttagtacaaacggggtttcaccaggttggtcaggctggtctcaaacttctgaactcaaatgatcctcccgcctcagcctcccaaagtgctgggattataggcatgagccaccaggcccagctaacttttcaatttataaacactaatacctacttgtgtcccgtggcctcatctcagccatgtgaggccgatgttgtgcccattgtacagatggcagagcgcagctgtgtgtgcagtgcggattgcaggactgtgcctgagtctgggacagggtctttgccacagctcttgggatcctctcttctcatcaatgttatctcagagagctttcactgttggataagaggttgaccctggaccccaccccagtgctgctgggccctgtgggcactcacagagcagtccttgctggcctgactcatattcctgagtctcaggggttcctgtgccaccagagaacgaactccccaactgtcagtcactcagctcagtgcctgtatcttaaattgggcacctttagcaaaagtgcagtgtggaactgtgtatcctgctgccccagcccaggacctagcacagagccgggtactgtgccataataagccttggtaaaggctgctgtaggcttcacagtacagatggcagggctgtgcccgggctgcaggctcccatttaccagatgtgtgcagtgtggattgcagggctgtgcccggctgcaggaacacatttactggatgtgtgcagcacggattgtagggctgtgcgtgggctgcaggcacacatttactgggtgtgcacagtgcggattgcaggactgtgtctgagctgtaggtgcacatttaccgagtgtgcacagtgtggatttcaagacttagagatgagacagccagttcctgtcctgcccaagggtcgggcagggatacgcatcaaagaccctgggcatctttcccagcccgggcggtgcccccagccatcgcttctcagcaggacagccggcagggcatctgtcgtcttcgtccaccagcatcacgacctgtttgggggagaagtagtatttccacaccccactcagggcgatagcgtttgaggaagaagagaaagagagacttttggctttcctgatttcaatctttctgaaggtggacccatcactggtgaaaaaaattggtttttttggaaccaagaaagcagcctcggcctccagtgcctgaccaggctctggccagggtataggatcctggcgaggatgctgtgctgtgttgggcaggaagccacttcctccctctaaacgtcagtgtccagctctctcttcgtcgctttcttaagttgagggagctgctatgccaagggcaagcaagaaacaggcccctgagcccccaggttcacggctgggctttgaagcaggagtttcctcttcgccctcgggccacacctctgtagggtgcctctgcagcatttccctcctcgggcaggagcctagcttgcagaggacagacaggcaggaatgctggcctccatcgtgccaccagatcctgtccccaggcaagcaggaggggaggggaggcagtctcatcactgcagcaggaggggccacctctggagtccgcatggctgtggctgggctgtgcttctagaagcagcagctgtcgcctccactctctagggatttttatctttcctttacaaacttttttttacctttttttttttttttttttttttaagatggggtcttgcttgttgcccaggctggtctcaaattcctggactcatgtgatcctcctgcctcagcctcccaaagtgatgggattacaggcatgagccaccgcgcctggccgatttttatctttcctaccagccttttcatatgagctgagcctgcaggctgtgcctaagcatagccctttgaacttgattgaccatgagctttgaaaggctgctttgcagtctcagttctctggcaaatacaccagctcggttaagacgacttttctttgattgatgtcggctacatctagaaagcaggattgccaccactcctcgaagcaccccacgattagagtgtctgagcgctgcttctgctctgctgaggctggtgacaaattgcctggaaagacctcctgacagaggatgacgggctcgtctgcagcagggccgcttgcagcccaattgcttccaagattaaacctttccaaggcagtctgcactgccccatacacagttgggctgcttggtttaagattatggatgaatgtactgaattggatctcatttaaaaatatataggttttgaagtttgagggctcaggaagaaaatgaaatcctttgtcccaaaccagggcctggttttatcagtggcatgcgtgcgtgtgtgtgtgcgtgtgtgtgtgcatgtgtgttctaaagagaccctagtggcaaggcacagtggcttatgcctgtaatcccagcactctgggacgccaaggcaggaggatcacctgaggtcaggagctcaagaccagcctggccaacatggcgaaaccccgtctctataaaagtacaaaaattagctaggcgtggtagcaggcaactgtaatcccagttactcagaaggctgaggcaggagaatcccttgaatccgggcggcggaggttgtagtgagccaagatcgcaccattgcactccagcctgggtgacaagagcaaaactctatctcaaaaaaaaaaagagagagagagagagaccctagtttagctcttttggaaagcagctgccctgcattgagacacatgtgtcttaagcttgcttctggacgctagcactaaaatagcaatcggactctggatgcctctcacaggcaacttgtccacaaaaccacttccaaatgttttcccaagtgcatgcgtctgacccaggcttctttctcatccgcctcttgtggaaggaagatcgcatcttgagttctaaagatttttaaacaatctcatacctgcagagcaatgtatatttcaagaccattgacattggaaaacattcttgtttaatcaatgactctggtcctgctttagatttctccaaaaatagccagatcccgtgggcacgttgaagctgcagcccattgtgcagaattgcttaatgtgtacctcacctggttttggccttcacacaactgttgctcccttagcaaggggttcatttggttgggttttatgtgcaggaatgctggtgggttgggtgagtattagtatttaagggaaggttttgtttttgttttgttttgtttgtaagagctagggtctcactttgtcacccaggctggagtgcagtggtgcgatcatagctcactgcaacctcaaactcttgggctcaggtgatcctcccacctcaccctccctgagtagatgggactatagggtgtgcatcaccatgccaggctaatactgtttatttgtatttttgtagaggtggggtatcgctttgttgcccaggctggtcttgaactcatgggcctcaagtaatcatcccaccttggcctcccaaagcattgggattacaggcatgagtcaccatgcctggccataggggaagatatttttaaacaagatttgcttttgactagtgtcctgcatttgttaaagaccctagattgctccaggtgttctaaaaataaccaagcccacctgcctgccttctagatatgggctggagggcctgccaggagcattcttggggattgccagtagccccagttagcccaggctgacttacacttcctccctctcttaaccaaaataatgttgaatttttgtgttccttgtcttttaactgaaaagctcctgtttgtttgtttgtttattttctgagacagagtcttgctctcttgcccaggctggagtgcagtggtacgatctcagctcactgcatcctccgcctcccaagttcaagccattatcctgcctcagcctcccgagtagctgggactgcaggtgccctccatcacaccaagctaatttttgtatatttagtagagacagggtttcaccatgttggccaggctggtctcgaactcctgacctcaggtgatccaccgcctcagcctcccaaaagtgctgggattacaggcgtgagccaccgcgcccggccccgtttggtgtttttaatgctgtattgccattatttgcacttattcttttgcaaaatttcagcacctggtggtcaggatgttcctcctggccatgcacatgcaggacacacaacaggttcttgataagcgtgtgctgagcaaaactcactccttccttctggacacattcatcacaggtgtgctcgaagcagcaagagcttgcccctgctcagaagtgcttagttgctaattagatgtttccgcaaaggtactgaaattggaggcatcagtgttcatcctttagctatagcgttggaaaaatgtgattgatttacaactgtgactaaaaaggtgtttagagaactgttctatgtaaaacaagacagtaagctgggcacggtggctcgtgcctgtaatcccagcactttgagaggctgagatgggtgagttgcttgagctcaggagttctagaccagccggggcaacataacgagacccccatctctataaaaatatatattttttaaaaagctgagtatggtggtgcatgcctgcagtcccagctactccagaggctgaggcaggaggatctcttcagcccaggaggtggaggttgcagtgagctgtgcttgcaccactgcactccagcctgggcctcagagtgagaccctgtctcagaaagaaaaaataaatatatatagtgtgtgtgtgtggttgcaacttttgcacatcaccttgagttctgggcaaggggagaggaactgagattggtcactcccttcttgcgtggatggctgtgggatttgggtgagttttttgctccatagtgcttttcaccctgtattttctcataggttttgccccactggggctttgtatagagattggggctctcaggtcccatatggcacttactagcgagagttccgagtggccagtcccctccctgccctggcattggtacaagggggccttgctgttggaccacagtcttccaagagtccagctcccctgttctatcgagtctgaagcaaggtcccacttgggagttacagatcaggctcctttgatgtcagagcatcgcagcggaattctaggccacccggcagtgagtgctctctgcagatctgtgagtggtgctgggccgccctgccacctccatccctagcaccgtatctgtgtgaaaaagctgtgacctgccccttgggtggaagccttccagtccttggaaggggaatctttgctgctgctactgtctgcagagagactctttttatttttatttatttattttttttgatggagtcttgctctgtcacccaggctggagtgcaatggcacaatctcggctcactgcaacctccacctcctgggttcaagcaattctcctgcctctgcctcctgagtagctgggactacaggtgcttgccaccacacccagctaatttttgtatttttagtagagacagggtttcgtgttggccaggctcgtctcaaactcctgacctcaggtgatctgcccgcctcggcctcccaaagtgctgggattacaggcgtgagccaccaagctcggcccagagggactctctagagaggccccttgatcccacaaggggcgggggtctctggccaggcacagcccctccccactaagcccagcacctggtgccgaacacacacacacacacacacacacacacacacacacacacgcccgccccccgctccactgttctgttgtcagttgtgttcgttgttttcttgtaaataaacagtatgacaataaagggaagttacttcttagctgctcagaaggtgaccagagcagggctggagtgccagccttgcattcattgtttgctttattgcaaggctgcttggaattgaaggggatctccgttcgagtctgagctggaggaaggaaggggctcctgtaccatgtatagaacttgggctctccccggggtcaggggcctgggctctggtgcagccccaccacttcatcaggtcaccccaggtggtttcagcctctgatttctcatccctggaatggggtgtttgcagcctcgtaggttgctatggggattgaatgagatatgttcatgagccagtaaggcagccaagatgtcacttacatggaacttacattgcaaccccagttttagaataacataggatattaaatatcaccatctccttgaatactcatagtccgcagtttgcttcatgttataaggtgtttagttctaggctgagcctgtaatcccgccactttgggagactaaggtgggaggattgcttgaggccaggggtttagaaccagcctgggcaacatagtgagacccctgtctctacaaactatatgtatacacgtataaattttataaagatgtttagttgttctgaatttcctaaaaaatacagcttaacttttttgtcttcctttacctgcacctggatgcagtgggaaagattttcccagtagcacaaggtggaccaggtgagctatcctcacccaatggggctgaaagacagggctttgatatcctgccccagagcccggctgttaccacatggtttgatttgcgatgccaagcaggcttccttacgggtccacacacctctggtttttagcttgagattggggcagctgttcctcctctggcccagccaggtataatcaggtacaaaggaaagtgacctagaatgaagaggttgccctgacctggtggtggaattggagcctgggagcacgggtcggatggcttagttcatctgtttggcagtggatcaaatccccctcctcccacatacttgatttatgtggactgggaaagaatgttgggtttcaacataaagaaaacaaatttggctgataactcgtaaatcacaataaactttcattccaagagtgttctgggcttctaagaaatatattcctatctcacatctcagttgatattcacagccaccattgagctagagtcattcccaggtggagaaactgaggcttgggagttatgcctgccttggagagggatggggctaagacttgggctctggtgtcctgaccaccgagcctggttccttccacgtggtctgattcctgggatgtgaagcagccatcctcacagggccacacacctggacaggtacacagtgcagcaagtagagaggcaaagaaacaagggaattgatcaggggtccacacgctttctctaaaagagcctggtgctacatatgttagtcttgacggagaaagaggcaaaatcaggatatcatgtaggcacttatataaccactttaaatgcaaccatttaaaagtgtaaaaaccattcttagctcatgggccataaaaatcccagcagctggctggttttggccggcttgccgcagcttgctgacccctgggagagagcatctgctgctattgcaggcaggggactgcaggtcatccccctgtttgggtcccactcctgcccgtcattcaggctctgtcagcttctacccagaagtacctgggagtcgggggttttgctgtgtcacagagaacttggctctcgatagagtcggaaaggaattctgggaaaactctagagatgcattaaaaaatctccactgggccgggcgcggtggctcacgcctgtaatccctgaggcaggcacattacctgaggccaggagttcgagaccggcctggttttttgttttgttttgttttgttttgttgagacagggtcttgctccatcatccaggctggagtgcagtagcacgatcatagctccactgcagcctcgagctcctgggctcaagcgatgctcccacctcagcctcccaagtagctggaaccacaggtgtgcaccactgcacccgggttaatttttttatttttgcagagacgatagtctccctatctttcccaggctggtctcaaactcctgccctcaagtgatcctcctgcctcagcctcccacagggctggggttatagacgtgagccactgcacctggcctctttcttcttgaggctagttttcctgactgcgtgattcccaaagcttcaccccactgatgctgggttcccctcctctgtctactccacctgctgaggctggggctctcagggacacagtcagcagctcagcctctggaaagacctggaaagatcacatccttctgggaacctgcttctggaggcacaagtagtgtagctcctcttaggccctttcgatgaagtaagagcagctcattagcatcccaggctacaaagcctaaaaccctttgcttttaccaaaaccagagggtctaaagagaaaggtcacgaggagcgagcggccgcgtggatgaggttggccagagaaactggtttgttttggaagccgatggaagatgcgcttggaaggctaaggctgccgaggttgaagtccgtcattctcagtgcagaccctagggaggaagtagcaggaccccagtggggctgcaggcattcagaaagagagctgcctggggtttcccttcagaacctccctccttttaacccgggagtaaagagaaaaagacccgcggggtccactggctcggaagtcggtctctttcagtttggagcctccagttggaaacctgccttttaatggccaggctgatggtctagttactctttgaacagggaagcctcgtcaggctctctgctgaccacgcctcagtgctccctcgaaggacaactctggaatgccagtttttatctcatctcggtagaatggattttttttcttttcttttcttttctttctttgagacagagtctcgcgctatcacccacgctagagtgaaatggcacgatatcggctcactgcaacctccgcctcccgggttcaagcaattctcatgcctcagcctcccgagtaactgggattacaggagcgcgccaccacacctggctaatttttgtatttttagtagagatggagtttcactatgttggccaggctggtctcaggcgatccacccgcttcagcctcccaaagtgctgggattacaggcgtgagccaccgtgcccggccctagaatgaatttttcttttagggaaaataaggttattggtgaatgggtttgggctgtcatcttcagaaactgatttcatctagaacagtttgtgacgggcagatgtggaataaaaccactggatgcatcaggcgtcactgccaagggtgcaaggggctgctccatgctgggcgtgcgagaggagcaagaagccgtccccgcccaccacggtgcaggccgggatgcagcggaaagcccttgcttcttagatttcccacacaaaagtgtatttcttgtagatttcgccagcgcgggcctcctcctctgcttggcagtggctctgcacgagctgccttgggatggatctctcatctttgctgctggcctcatccaaggaacagaccccatgcacggagcctagatgccccgaggtcttcactgatggccctctgaatttttattttgtttgtatttcatttgttactgattgaatttttgagacagggtctcgctctgtagcgcaggctggagtgcaggggcgcgatcctggctcactgcagcctcggcctcctgtacctaagccatggccctctctgactttgaacccctcagttcattctcagatcagaccactcactcactgaggccctcggctcttccacaggtctcagccttttgccccttatagtttttagttgttgcagcctttctgttctcttcccctctcctgttaaggggacatttccaagcaccctggccacagaacctcctcacctcccaccctccgcccctgggtgccagggcctgggttctctgtggaagtcctgccagctccgggtatttcccacgtggatttctcatcatcttcaccaccagatcagttcctggcctgcacccctcctgtctggcttgtggcaggggctgccaccctcacctgggccctaaacttctacaaagccccactctctcctgttcccgtcagtctgcttgccaagtccagtttattttaattctggggaacgttgtcttcctcctcccccctccctcgccaccacccacctctggtgttttttttgttttgttttgttttgttttttttgagatagagtctcactcttgtcacccaggctggagtgcagtggtgcgatctcggctcactgcaacctccgcctcctgggttcaagcgattctactgtctcagcctcctgagtagctgggactacaggcacccgccaccacacccggctaatttttgtatttttagtagaggcaaggtttcaccatgttggtcaggctggtctcgaactcctgacctcaggtgatctacctgccttggcctcccaaagtgctgggattacaggcaccacttctggttctgttaccttcgtccaaacttgtatttcccagctggtatcttccatctccaggctttcccctctggcctgtcctttagcaggagtcaccttcctgaagcagaccctggtctggtctctgcgtactaccttttgcatggttggtggccgtccacccgcctctcaggccatgtctgggttcttctaggggcttcggtgatctgggagcctgtccccgctggccccctctcccatgtcttactccatcagcttcaccttgtttgtatctctggatctcctcttttttccttctgtttgtatcttgtctctttctagaaagcccccccacctctactcgcccctctgtggcaaatatcacccaattcaggtgcccccagcccagcaaagagggattttcattccttgggcccccgttgtaggctagctgcgcctgtctttcggcacatttcatttcctgcctggtatttcggtcgtgtgcgtgtctttattctcctcgtgtaatccctgaggtgcagagtgcgtgtctgtcctcctctgccctctctagagattgggatatgaccagtgttcagcccccaaccaaaagagcctaagaaccccaggtccccagcctgtcctgctctgctgggggcccacatgcctggggacaaggcacctttccttccctgaccttgactaggacaggacatggggtagggcctgaacattgagcaattgtcaaactgcctacttacgatgaacaaaatagcttttcaggaggcgagaccacagcacagtcatggtgaatcctgatgcgcaccccaggtcttttatcaggatttttgtttttcctggtgggcacagatgtaggtggagcagatcagaggcctctcaggttcttgatcactcatggcagttcaggcctgccagtagtgaggtcagagatccatacagcaggggagagaagggaggtacagggaaccctcggccccgcgtgctccagcaggtctgcatgattaacctgaattgcagtgttcagaggctcggcctgccagccacagcggttccagatgaaatgcagcttagaaggcagcatggtgtagtagctttggcgccagccgcacccagagtttggattgtagccagatggcctcaggtgcaatgtataacctctgggaattccagatttcctatttacacgacagggatgattccatacctgaagggctgtttggaagcatctagaagcaagcacagtggagtggctgtcatgacgctgaccgcacaaatgatggtgttaggatccctccacggatgtggccaggtgacacccctcacctaggccgcacagcaccctaatgtacacactgaagaaaggctgcgtggggctgcagagcggctcatttctaagaaggccaaagaaattgctcagtccagaccagggaacccagtttctcttttagaggtgggatcttgctatgttgctcaggctggtctcgaactcctgacctcaagtgatcctcccgccttggcctcccaaagtgttgagattccaggcatgaaccactgcacccaacctgtagcctctttctacaagtaaaataattcaggtgagttcaggcccacgccaggtcttaaaccctggccctctgcccatcttccagcctccaccccttctctctccttacagaatcttctgttcttctgcacaccagcgtggcagacaggttggccaagggccttggacttctttatctctagtacatgttcctgtaaatttaaacctcctcagttgggtaaaagctttggaattactaacattccttttgtgctgcctaacgttcttgccatttaaaagattagcaggcataatttcagtgagccttcgtgactggcgtgcctcacttagcttaatccctggttggtacatgttaaaacctataaagacagcctctccagcacacatggggagcttgaaaatgaaagaaaggttgctctgacctctcagaactgcggacttcttaaaaaagaaagagtgaggtgggcggcctcccttgctgccggtgctagattccatgatatgaaacagcaagggtgcagctgggtgcggtggctcatgcctgtaatcccagcacttcggaggcgggggtgggcagatcacctgaggtcaggagttcgagaccagcctggccaacatggtgaaaccccgtctctactaaataatacaaaaattagccaggcatggtggtgagtgcctgtagccccagctactcaggaggctgaagcaggagaatcacttgaacccagaggtggaggttgcagtgagctgagatcacgccactgtactccagcctgggcaacagaacaagaagactctgtctcaaaaaaaaaaaaaaaaaaaaactgacttggatatgtgcttacataagaaagggagattcaccaagtgaaccatgcatagcatctcttaaatctgtatcatggaattcgtgattgggcctctctttcatatcaggcaacatacatgtgatgtacatacctgtagcttccgggaaagggaaggaagtagagatgacattgtctgttactcgtttgtatgtgtgtgtgcgtatttaagtaaatatgtgtgtgcatagggacatgtcacatgcatgtgtggcacatttataggatgaagaggtgtctaaaagacattgaggaaactcagtgaaggagttctgccggcgggcgtgaggaccacgctaaaagatgccggttgtgctttgtgtctaagctgaaagcatggatatcattttataaaagtaaaattatattggccaggcgtggtggctcatgcctgtagtcccagcacattgggaggccgaggtgggcggatcacctgaggtcgagagtgtgagaccagcctgaccaacatggagaaacccccatctctactaaaaatacaaaaaattagccaggcatggtggcacatgcctgtaatcccagctactcaggaggctgaagcaggagaatcacttgaacctgggaggcggaggttgcagtgagccaagatcatgccattgcactccagcctgggcaacaagagcaaaactccatctcagaaaaataaaaaaaaaaagtaaaattatattgttattgacggtctctttgttcgagtaagccgtctctggatatatcattgtatggtgtattcatgccaaggatttggtgtgagtcttgaagcattcacaccaaattgtggccaagcccagcactgagagcgcagtgggcgttcggaggacacgtttggattttgtgatcctctgcctggcaggagctgctcagcccctacagccccttccccgagaccaccaatgcgtttctcttcagttttgctattctcatacgctggtgatgggattttggagacaaacatggtctcttctgcttgcttgcttgcttatttatttatttttcctcccaggttcaagtgattctcctgcctcagcctcccaagtagctgggattacaggtgtgcgccaccatgcccagctaattttgtgtttttagtagagacgggtttcaccgtgttggccaggctggtcttgaactcctgacctcaggtgacctgcccaccttggcctcccaaagtgctgagattacagacatgagccaccgcgcctggccttctgccttttttggtgaactccctgtgggtgggagaactacccggtggagtcggtacctaaccagggcaggacacggaggtacacccctctcattttcggcagcagggtgagaggatttttattatcttacttagacacttgaatttatttttttattttgagacggaatttcggtcttgtcacccaggctggagtgcaatggtgtgatcgctggtccctgggttcaagtgattctccaacctcagcctcccaagtagctaggattacaggcgcccatcaccacacctggctaatttttgtatttttagtagagacggggtttcaccatgttggccatgctggttgacgcttgaatttatttatttatttcagataattttggactacagaaaggactctttgaaagggtattctaaaataatttcacccaattaggttttaaacatagtctgccatattgttgatttcacaggatttgcttttttaaaaaaatgtattttatttatttagaatttttctttaagagatggggtctcactctgttgcccaggctggagtacagtggtgcgatctcggctcactgcaacctccgcctcccgggttgaagcaattctcatgtctcagcctcccaagtagctgggactataggtgcgtgccaccatgcctggctaatttttgtatttttagtagaaacggggtttcaccatgtaggccaggctggtctcgaactcatgacctcaagtcatgcacctggcttggcctcccaaagtgctaggattataagcgtgagccactgtgcctggccttcagtagcttttaaaggttgtagctgaagattttgtacttgtcacatgggggaatatgataatgaaagcagaagatagactagtcactctacttttcccagcgtcctctctgactggactctttgaaggtactgcccagggtcatgaagagatggccctggctgcttccagaaggtatacattcccgtgtccactctgtgtcctggagagtgggggcggggggagggggttgtccgtctttgtatctctgtctctcagtacaaatttaatgaaggaatgaatcaatgaatgaatgaagcaagcattcccccagagaattcttaaatcatcttagccggtcatggaatttcccagcaagtcagcttttagaatcctgaaaatattttcagtattcatctctttaaggaatatatcaaaagcagtcagcaccaaccacggtttttcagctgattcccaaatgtgtgataagaaacacctaattccttgggggagaaaacttgttcaggttaaattcttgcggtaatccttacggccctgtggtgttcgctaagatgtagcaagaatgtaaatagctaggtactttgatctacctcaaatacttactagtttaaacattctgccattctgccgtcataccaaaaaaaaaaaaaaagcaccatcccagggttatgaatgacgttactgtctttggacatgctgtcttgtgtggctgagacgtagatcaagagaaatttgtaagaaagacaataaggtacaaaaatcgccgaagctaatgtcaagatggagataaatagatctatatttgccatatatggtagtaaaagaaaagtctgtgcaaatttgctcgacatttatggacttctatgattcatctaccagggccagcagctccagccaagagatatagaatgtcttcaactgtatttctttcctaaattgtttcattacaaagaagccatgttgtgtattcagaagaaaattccaggaccgcatgaaagtcactatttgggaacaggcctgagaaagcttgcttagaggaattccaaaagtattcaaaaggcagttattgaccaaacacataataattctctaagcatcaacaattttccatagatccaagctcacatatacagcgtattttctgtggctagtcactccagaaatagagggttctctgctttcttgactgattgactcatatgcaaacgcttctcatttcattttgttatttttttgagaaagggcttgttctgtctcccaggctggagtgcagtggcacagtcacggctcactgcaccctcgacctctctgggctaagccatccttccacctcagcctcccgagtagctgggaccataggcacacaccaccatgcctcgctaatttttgtattttttgtagagacagggtctcgccatgttgcccaagctggtctcgaactcctgggctcaagcaatcctcccacctcagcctcccaaagtgctgggattataggcatgcatcaacatgcccagcctgttttttgttttaatctgttattgagtaaggtgcaatttgtggctccatatacagggacaggttgcaaaacaggtactgagccgtgtgtatccttcaggtccaagcagcttctaaactgtgtctatctctgttcaggtccctggaactctcctgggcagcaagctcacaagagaccgacctctgtggccttcgaagcgggttgctgttagacacaccttttagaagctacattcatagtatctcaaaagacagacataaggggtactcggtatggccaccactcactcccacaacacagccaccatttcccacccagaatttcctgtgaaatgtgctcattttaaaacagcacacatcctgagaattgcaaagttgggcatagagatcaatacaaattagacttctttttagatacgctctacgctctgcagagccctctggggtctccaagggctgggacctgctggataaaactggatgaaactaagttgctgcttctttggtgcccttgaatggactttcttggctgcagtgacgttaggtccgcttcctagccgcgtgctgctctgccatcggggatgctaaagtcggggagggccaggaagcctttctttgcttggaagtttttgtttctccttcgcctgctaggttgggataatccgttgggaagtctctgagcgtctttaaacataaaatctagtttcaaaggtttaaattcccaagttgccccctaagttacatgttgcttaggcttggttgctatctgtatggtataaataattccatttagaaattaagaaattatgggctgcatttttgatgccagtggctctgtagtatcccccaaccaccaaaaaaaaaaaaaaaagaaaaaaagcatctaaaaattgtgaggttaccgcttagctctgtctttctggctgcacatgggttaccaggtgccttgccaagaccctgcctccgtgtccaccatgctttgtgtctgcaagtagatttacccatcgttcattattaattattcctctgagcagctctgtgaagctagtaaatattaataaacaatatgtgctgattatgaacctaagacaaaaggatgtctttttcaagctgcttaattttaggtaaactagttgcacacaagcgatgaataaacgtgaagtcaggcatccaggcggtgaaacaaaatcaaactggaactgcaaaaggagagtgcctgagatctgattttattttatttttgggatggagtctcactctgtcacccaggctggagtgcagtggcgtgatctcggctcactgcaacctccgcctcccaggttcacgcaattctcctgcctcagcctcccaagtagcttggactacaggcacacaccaccatgcccagctaatttttgtattttaagtagagacggggtttcactgtgttggccaggctggtctcgaactcctgacctcaggtgatctacccacttcagcctcccaaattgctggggttacaggtgtgagccaccgcatccagccgaaaggatacagtttatttaaagacaaaggaaaaagaaaaaccataattgtgttcacttagaaacatctcccatttcatactgatgtctttcctggtggtggtgtccaaatgcttatatgtgtgtgagattcattgttaccatgttgggatcagactgtaaacaagctttataaaagttcgtggctcctttcactcatccacccgctatgcatcgtccagatctgagttcacgtgctccttccccaaaggagccttctctcctgtctagggtcaggtctgcctctttttttctttttctttttttggaagcagggtctcaccctgtcaccaggctggagtgtggtggcgcgatcacgactcactgcagccatgacctcctaggctcaagcagtcctcccacctcactcccaagtagctgggattacaggcacatgccactacacgtggctactttttaaaatttttttgtagagatgggatcttgctctgttgcccggggtggtctcgacctcctaggctcaagcgatcctcccttagcctcccaagtagctgggacgacaggctcatgccaccacacccagctaatttttttgatttttagtagagatggggtctggttatgttgcccaggctggtgttgagctccagagctaaagcagtcctctcgccttaacctcccaaagtgctgggattacaggcacatgcccctgtgcccggccaggcttgcctcttaaactcccttcgctccacatgcccttctgcagcaccggccacagataagtgtcatccatgctggtggtgatttgactcatgtctcacctgccacacaacagaggcccaggaggcacagcagcctgtggtctctgctcatgattgaaggagcccctaaaacagggccggaaggcccaaaatagccactcaacaaacatctgtcgcataaatggaagtcacgtgcctcattccaagtctttgctgttcttcaaaaaataatggtactccaaaaaataatgatactccagattacactgagccatgaccacacccctgcactccagcctggacgacagagcgagacctcgttccttacaaagaattatactgagtacctaatatgcaattgcattgctttagtagaattctctcataagtactcccctggtgtcggaatccacattgttcccagttgttctctgttctaaactcatgctgaacattcttgtgcataaatctctgcctacatctctgattattcttacggatagactcctgaaagtactaagaggaaggattaatctgcgttctgattttaaacagcccatttgtctaaatattagcagggcctaagatctggaataaatgacacagtggcaaaagtcggagtcacacgtcctggttggtttcagagagtcctggggtgaaatggtgcctttggggtccatccctgtctagcacaggagtcccctttgcagcagtgtccataaaacgttagcttgggctgggtgtggtggctcatgcctgtaatcccatcactttgggaggccgaggtgggtagatcacctgaggtcaggagtttgagaccagcctggccaacacggtgaaaccttgtctctactaaaaatgcaaaaattagcctgacgtggtagtgggcgcctatactcccagctactcaggagaattgcttgaacctgggaggcggaggttgcagtgagccaagatcgcaccactgcactccggcctgggggacacagagagactccatctcaaaaaaaaaaaaaaaagtgagcttggtgatgagtctgggaagagcatctcttcattcattcagtccacaagtattcactgtgtctgccccgaacctagcaccatcctttggcccaggaatagaacggaggaatgtacatctcctcaaatgtctcctagaaattgagacctcaccattctcgctaagctccctgagggcagggactgtgactgtctcattcactgctcgtagttaatgctcaaatggtttttgaataaattaaaatacaatatgtgggccagtgcggtggctcacgcctgtaacccagcgcttcggtaggccgagatgggtggatcacctgaggtcaggagtttcagatcagcctggccaacatggagaaaccccatctctactaaaaaatacaaaaattagccaggtatggtgacacacacctgtaatcccagctactcaggtggctgaggcatgagaatcgcttgagcctgggaggcggaggttgcagtaagccaagatcacaccactgcactccagcctgggcaacagagcgagactctgtctcagaaaaacatgtggttcctctctttgacaagttccaaatctattgatgtaattgatgtatagatacatcagtaaatcacagatgtattttcaaagttctgaaatgtaactagagatttgtttatttttgagatgaagtcttgctctgtcacccaggctggagtgcagtggcatgattatagctcactgtagcctcaacctcctgggctcaagtgatcctcccacctcacccttccgagtagctcgcactataggcacttgccaccatgcctgggtaatttttttagaaactttttgtagagcaggagtgtccctatcttgcctagactggtcttgaactcctggcctcaagcaatcctcctgtctgggcctcccaacgtgcagggattacaggtgtgagccactgtgcccagtcagaggtttcgacatgagcagttattcagaaagggacctggaagaatattttgaaatcagacctagagtcaaatcagacttatttaagagaattaaccaatggagcctgaatttggcttctcccatttcctaccactgatcccctggccatgaggacagtcctgcaggaaattcctgtgccaggtgggctagcccaggacacatggctttggagactaggcagggaagatccagcccagggtactggagctggcgcttgcatgcccctctcactggggtgtctgatccccagatgccaacgaggctctggctgtcctgtctgagctgcccctgaggccacacacaggatctcagagtggacaaacagcctttcccttgacaatgagcagttctcagctctgagaccagaagaagccttagtgcaaccatttctcaaagtttcagtctcttaaaattgaggactccggagagcttgagtgcgtgcgtgcgtgcgtgcgctgtatctctcagtattgactgtgttagacatgaaagctgaggagtctgcaaagcacaggaacacacaaacacacgagccgctggtgtcagagtgaggctatcatcacacatcgcaggcatctggaaaactccactgtacacttgcgggagaaggcgaggaaaaggcaagtaacaagaatagttttgaccttgtggatccatgaaaggatctggggagccgggagtccccagaccctgctttgaggatcgttggcttagtggcattggcatccaggctccaccataatcctgagccgtggccacgtgctgccagatcacggcctctgtgcagttcgaatctgcccttcttcttagtcctttgcaccatcctcagcctttatcctcctcggtccacattcaggcattgccacttagataaccgcccccgcgcccccctcccaccccacttttcaacatcagacaagtctttttttgtttgtttgttttttgagacatagtctcattctgttgcccaggctggagtgcagtggcacaatctcggctcactgcagcctctgcctcccgggttcaagcaattctgcctcggcctttggagtagctgggattaaaggcacatgccaccacgcctggctaatttttctatttttagtagagttggggtttcaccatgttggcgaggctggtcttgaactcctgccctcatgtgatccacctgccttggcctcccaaagtgctgggattacaggtatgagccaccatgcccggtctcatcatcagacaagtcttgcagatcccctcttgatcaggaactcaggggtccccacctgcagcttcagggtacccctcgctgcttaccagcaggcaccctatgttgaaatcctgcaccctcatctcagttcccaatcccaccagtcccccaaagccagcccttcccgtggtggagttgtaccacgtaccacgcaaaagccacagcatcagcattggagactctgccaggacacggaacgtgttttaaatggcacaaagacatttaaatgggaagaaattatagcaggagtgagtttatccctttcaagataatcttatttaataaccaaaaaactcacaaagatgtgcattttatccgactacaaaagcagcgtggcgggttatatattgtggtaattacatgtttggggtttcattcctcctttaaaccagatttcttttatttcagaaaatcagccattgtagaaaaagactattcatttatttcattgctgggtggcctatacactgtaaaaataggtcaagaacagtaatctaaattgactgctgataaataattaaagctaatggaatttttctcaaacctgtgaactaaaatctttgagaaattgccaggacatacttactgtctgctgttgtatagaaagatattttttatttaatacttgagtttcaatgccatttaaaattacccttttctatcacaaggactggaaggaatatgtgttcatctataaaagtaaccaaaggaacgatgccgtgttgatggttatatggttcatcttcagatgagatgggaagtgacggtttcagtatcctggaacaaaagaaacatcatttttcactgaactggattttaagttgaggtctacagtccacatatcatataatatatattgtcttgtttttaaagactccatacctggtctgagctcttgtatacattgataagggaaacttaacagctatctaacgtgacatccaggaaaataaatactaagaacattttttctttcattagtaattactgttctctcattgctgctaccaggaccttataaaaagacattggggtcaggcgtggtggctcacgcctgtaatcccaacactttaggaggccaaggcaggtggatcccttgaggtcaggagttcaagaccagcctggccaacatggtgaaaccccgtctctactaaaaatacaaaaattagctgggcatggtggcgggcgcctgtaatcccagctacttgggaagctgaggcaggagaattgcttgaacccaggaggcagaggttgcagtgagctgagatcgcgccactgcactccagcctgggtgacaagagcaaaactcggtttggaaaaaaaaaaaaaaaagaaattacaaagtgagctaagaccagaggagaggggagaggcaagagcggagaattaccccagatgagggagatctggaacagaaggtgacaacaggccaagccacagggccaggtccctaagggtccccacctctagcaccattggcaacaaccttgtgagagtcagaatcaagtctttcagaagtgacccagttcagcccctcactacccccaccctgccctagtgctcttggaaagactacattgtctccgaaggagaaagggtcccacccctgaactgtcactgtacaggatggggtaccaccaagagatgttgtacctcttaaatgcagtcagggttatttcccagaaaagtatccaagttactgtaggatgaaaaagacatccagaaaaacctggattatcagatttttttttcccccatttggagacagggtcttgctctgtcacccaggctggattacagtggcacagtcatagctcactgccatcccaaactcctaggctcaagccatcctccacctcagcctccaaaatagataggactacaagcctgcaccaccatactcactaatttttgtatttttttctagagacgggatttcaccacgttgcccaagctggtcccgaatgcctgggctcaagcaatcctcctgccttggcctcccaaagtgctgggattacagttgtgagctaccagatacttttttttctcttttttttttttttttttttttggatggagtttcctgggttgaagcgattctcctgcctcagccttctgagtagctgggattataggcatgcaccaccatgcccacctaatttcgtattttttgttagtagagatggggtttctccatgttggtcagactggtctccaactcctgacctcaggtgatctgcccgcttcagcctctcgaagtgctgggaatacaggtgtgagccaccacacccggcccagatattttaaaaacagaaatgacttgatgactttggagatgtgtttgtaattcacagcctccttctatgtgtgcattgtgtttgtgctgattccagtgagcctctcgctcctgcagacagaggtgaacctccatgcagcagctcagcgtgtcaccagctctgggtccctggcacgcgactctgggatatggggagtggaagagagctcatgggaattgggagcacgaggccctaagatggagcagagccttccagagagggctcgggagtgtgtgtgttacgactcccgctcgtacgttacaggtgcaattgaacactgcatgacgattttgtctctattttgcttttacatcagaatggtttcctccagcaattggcattacctagaaaattccttaatagcattttgctgttcagttctctgacctaaaaactgagttgtgaatcagcagtttcgagaataatggaaatacggccagacacagtagcacacgcctgtaatcccagcactctgggaggctgatgtgggtggatcacttgagcctaggagtttgaaatcagcctgggcaacatggcgaaaccccgtctctacaaaaaatgcaaaaatttgccggacatggtggcgcatgcctctagttccagctgctcggggtgctgagatgggaggattgctcgtgcccgggaggtcacgactgcagtgagctatgattgagccactgcactccagcctggaagagcgagacactgtctcaaaaaaaaaaaaaaagaaaagaaaaagaaaagaatggaaatccttccacatagaaacctctctgtgtaaacatcatttatttgctgtgtactcaaaggagaggaggttgacatgagctattttggcttttgccaaaaggcatatgattggaattatctcaagaacatcactttctgtgcattaagatgtttgttgctttttgcccaatagatgggatgggatggaaacaaggtgaaaacatcactgacaaacctgaattaagtatataactgaattaagtgtgtaacgtgtaacttgaagtaattaagttttaaaacatggccgggtgcagtggctcaagcctgtaatcccagcactttgggaggccgaggtgggcagattacttgaggtcaggagttcgagaccagcctggccaacatggtgaaaacttgtctctactaaaagtacaaaaattagcagggcggggtggctcgcacctatagtctcagctacttgggaggctgaagcaggagaatcgcttgaacctggggggtggaggttgcagtgagccgaggtcacgtcactgcactccagcctgggtgacagagcgagactccatccccctccccgcaaaaaagtttttaaacgtgttcactgcctccttatcatttgttccactgtggttttggccagcctgaaccccactttttccagtttatgaccacaaagaaggattgtgcgggtgtgcatgaggaccagtaagtggcagagtctgcattttctggtgctgtccagacagcaaagagtgctgtgttctagaaagacagtaaatcgtatcatgtccttgctaaccgacgatggagaattctgtgggtcagaattgagcatcttttttgagacagagtctctctctgttacccaggctggagtgtaatggcatgatcttggctcacttgcagcctcaaccacccgggttgaggtggggagcctcccaatgtgctgggactataggcgtgagccgccgtgcctggccagaattgaacatctttgtatctttcttcttagtttagtacaaaactgaataatatttgcaggcagcagaattggatcgggaatttctcaaactgccaaagatgaaattagaatgagtgatttttggctggcagcttgaagtacatatatatcagtttgtgtatgatacgtgtgagtatgtagtggtttttccctcttcaactgtctttaaatatgtgtgcgtgcgtgagtgtgtgtacaaacacacgtagctttaatatcaaaaaggttatttttgtaggtctgttaggagacatgaatatgctcaaaagggaaaaaaatacatggatagggtgagaggagtttgctttatttaaggacatgataaaaggcatagcccttctgcctttctggaatgctgtaacagaatatagaaataattgtatcatctcctgtacttctcagagctggtgtttgcgtgaggctggccctgtgccaggttggcagggttgggggtaacccaggagcatgcctgctaaggcacactgccattcagggcctggccttgcccctgcgccccagccccctgctctcctccatccagctctgccctcttccatttctctgctacagtctgaaatctctcagccacaccagctttctcattccatgacctcatctgacttgtctccttcccctctgaatctgagcccttgttaagcctttttttgttttttctttgagacagagtctcactctgtcacccaggctagagggcattggtgcagtctcagctcactgcagcctctgcctccgcggtttaagcgatcctcccacctcagcctcctgagtaacctggactacaggcatgcaccaccacgcccagcttatttttatattttgagtagagatggggtttcgtcatgctggccaggctggtctcaaactcctgacctcaggtgatccacttgcctcagcctcccaaagtgctgggattacaggtgtgagccagcgtgcccagccatagctattcttccattcattccctcatgcaccctttccatgtcttttgagtccccactgtgtgccaggccccatggtcgttttccctggaccctgctgggatcatagtaatcttcccccatcattctttacgccttccacactcttttcccttgttaccctttgtgttatatgttgtcctctacctttctgaaaagcacagtgggtgaaatgcggtgatgtgttagcttcctgttgctgctgtcgcaacctgccatgcgccgagtggcttaaaacaacagaaatttatcatgtgacagtgctcgagttcaggagtccaaagtgggatggattccccaggctggaatcaaggtgtcagccagagttgtgttcctattagaagctctgggggagaatcagtttcctggcagtttccagcctctcgcgctgccggcattcctatagcattccgacctctgcgtcggtcctcagatctcctctgactctgagcctcctgcctgtctcttactaggagcactgggattacactgggcccacctggataatccagggtcatctcctgactcatgatccctgacataatcccatctgcaaaagccccttttaccattgcaatctaacacattcacaggcgccagctatgaggacgtggttatctctggcggactattattggtgctgaccacagatagccttatttatataaaaagagattggtggccaggcatggtggctcacgcctgtaatccacagcacttcaggagaccaaggcaggcatatcgcttgaacctgggagttcaagaccagcctgggcaacatagtgaaatcctgtctctacgaaaaatacaaaaactagccgggtgtggtggcgcatgcctgtggtcccagctacatgggaagttgaggtgagaggatcccttgaacccgggaggtggaggttacagtgagccgagatcatgccactgtactccagcctgggtgacagagccagaccccgtcttaggtgggaaaaaaaaaagattggtaaagaatctgattattttttgtcctggagcctggtgtaaaaaaatagaaaatcatctagttgaggaagtaacaggattgacttctccaaggaaataatggtatcacgtttagaaatgcatcctttggaacagtatatagttaaaagggaaattataatgcttcttgaccaaatgtttctacaggatcacaatacaaaataacgtgggctgtgatgatatttgtcaaaaaacttgtggtacagtggccaggtgcagtggttcacacctgtaatcctagcactgtgggagatcaagacaggcagatcgcttgagtccaggaattcaagaccagcctgggcaacatagcaagacccttatctctacaaaaaaataagaaaattagcaaggcatgatggtgtgcgcctgtagtcccagctacttgggaggctgaggtgggaggatcgcttgaacccaggaagttgaggctgcagtgagctatgatcacaccactacactctaacctggatgacagagcaagaccctgtctcaaaaaaacaaaagcttgctgtacaggcctgtcctgtaggtccctctgcaatgatggaaaaattctgtgtctgcattgttggaagcagtagccaccagcaacgggtggctaccgaatccttgaactgtggctagggtaactaagaaactgaattttccaaatttatttaactttaagttatatttaaatataaataagcacatatggctgtatgtgttgaataagaagactttttcatctgggatcttgataggtcttacttaggaagcctctgataaaataatttgcagagttttatttctaatggcaaggtcagtagctttcctcagattctcagaaggcttcatcaactaaaatgtaggcctagcccggtggctcatgcctgtaatcccagcactttgggaggctgaggtgggcggatcacctacggtcaggagtttgagaacagcctagccaacatggtgaaaccccgtctctactaaaaatacaaaaattagccaggcatggtggtgggcacctgtagtcccagctactcaggaggttgaggcaggagaatcacttgaacctgggaggtgtaggttgcagtaagccgagatctcgccactgcactccagcctaggcaacagtgagactccgtctttaaaaaaaaaaaaaaaaaaaaaaaaaacatagtttcaatgcctaaactttcagtaaataagatattatcttagtcgagtcttttcaaagtttttgaagcactttctcagttacttcattttaaataaaatgctctgaacaagatcataagcatgcacctatgggatgtcctggtgtttcgaaatgggcactggtggcatgggataaaatttattgtgactctgtcagatgtggattcaaaacaggctgtatctccgacttaacagtgcattaaaatggcagctagggccggccatggtggctcatgcctgtaatcccagcactttgggagatgaaggtgggcggatcacctgagattaggagttccagaccaccttggccaacatggcaaaaacccatctctactacaaatacaaacattagccgggcgcctgtagtcccacttactcgggaggctgaggtgagagaatcactcaaacccagaaggcagaggttgcagtgagctgagatcttgccactgcactccagattaggcgacagagcgagactccatctcaaaaaaaaagaagaggcagctaaaatacagtgcagtggcccaggtccatttcagatagaaacagccaggcaaaccccccattctagtctattttattctaagcagattatctcacttagactgacatcagcaaaagctttagtctgtagcacattcaaaatgaggtatatgtgaccaggagttagtagaaataaaacatcgttgtaggccaggtgcggtggctcacacctgtaatcccagcactttgggatgctagggtgggcacatctcttaagcccaggagtttgaccctcgcctggacgacatgatgaaaccctgtctctacaaaaaaatacaaaaattaaccaggcatggtggcgtacgcctgtagtctcagctacttggtaggctgaggtgggaggatgactctagcccaggaggcagaggttgcagtgagccagggttgtgccactgtgctccagcctggtcaacagaatgagactctgtcttcaacaacaagaacaacaaagaaccacctcgttgtattcttaaataagtttaaatcctgaagcgccagttggcgttattgatgttttaggagtgcaggaatgggtgaggtcccaggcttgctttagatagtgataattagcactgactgccacgctgtttttaggaggccttaaccaatgtttcccttctttctccttctcaaatggctgcttcctgacctccgcctcctgctccaggatttgcgcaagcaggtagcgccgctgctgaagagtttccaaggagaggtaagcttttctattcattttctatcctgagccacccttcgtggctaattggtctttttattcacattaaagaaatgctccgggcaaaaggtgctgcccagatggtgccttcccggctgctccgacccagcgtcatgcagattttgcgctctgtgatgtaattttccattgggtccttggtgaaagccctcctggaaaaggaagctatgctcagaatacacagagctgtggtggattgccagcagaagtgccccgtgtgtggttgcaacaggcaggttgttggcgctacggccttcaggagcccatgcatcccctctaggaagtcgccttgtccccctgagctggtctggggctgccactgccatgagtgtgtgccataagtgtggtgctttgctgagaggctggcgggggcacagggaggccacttgatcacaggcttgaaacacagagcatctagcagaagccacgaggagcaagcctaggctcagtagaaggaagtggtttctaacggatccttccagagaaggacggagccatctggcagacggcacgtgggtggcaagtcacctgggacatccgccctggctacctgttagcgggaacagcagccatagaggggactgggctccacgtgagtgacactctttgccagccctttgtgtgaagattcagtgatgtttagaaaaccagaaattatattattcttgcggatttattgaatctcacctctttagcttctcccgacggaaaaacagaaagtggaatcatagcaggctgataaggaaaggaaacgagacatttccaaagcccctgaaagagcccatattggtacagtcttagggatttttttttttttttttttttggcgacagagtcttgccctgtcactcaggctacagtccagtggtgcaatctagtctcactgcaacctccgtctcccaggttcaagtgattctcctgtctcagcctccccagcaaatgagattgcaggtgtgcaccaccacacccagctaatttctctatttttagtagagatgcagtttcaccatgttggccaggctggtctcgatctcctgacctcaggtgatccacctgctttgacctcccaaagtgctgggattacagatgtgagccactgtgcctggcagggattttattttcttgcaactgctaagtcacagggaacacatgggggaagggacaggagagatatggccgtgagatacaggagagatatggccgtgagatacagtaggttcctcttgggacacaggtgatgtgggccttatatatggaaggctgggttcctggtcccagagctctagagcaagttgtcgggcttccatttgggaaattcatcaactgggagcgagagcagggagtgagtgaatgaaggaggccagggcgattgtagccaaagacagagaggcgatttcaggacatcaaaagggaccagcgtagaaagaagacacagcagttggtgatggctggaaattttcgagggcagaacagtacccctctcttcttatgatcttcttcctgcctcattcagcccccatgcacgtagcttggtccggccagcaggacacctgcatcccagggcttggatggacttgaacagtctttttctcagaacttcatctccaagcccgtagttgatgagtgaggctgttacctgacacctacccacatttgatcttacctgttctgttacctgtccagcggcttttgggagacccactggcttcctagttctctcgctcaaagagttcagtgtgctttctaggtgtttgcttgtttttctttcttattgaaaaatttcaaagctgtgtaaaaatggaaagattagtacagtgaatacctgtatgcttttttttttttttgagacagattttcactcttgttgcccaggctggagtgcaatggcacaatctcagctcgctgcaacctccgcctcctggatttaagcaattctcctgcctcagcctcccaagtagctgggattacaggcatgtgccaccacgctcagctgagttttgtatttttagtagagacggggtttcatcatactggtcaggctggtctctcattcctgacctcaggtgatccgcccgcttcgacctcccaaagtgctgggattacaggcgtgagccactgcgcccggcccacctatatgctctttacccagatccacagttgctaacatttcaccccatgtacctcccccctcccctccccgcccaccacttttgctgaacattcagaagtaagttgcagaagcaggcactgtgtccctcaaacacacgtggaaggctcccgaagttaaggaattattagcattctcctacattaccacaataaccacaaatatcacacctgggaaaattcacagtaattccaggtcatctcatatttgatccaaaatcaaatttttccaattatccccaagatgtcttttataacggccctcctcgcaactgaggtccagtcaggttcacacattacatttggaaatctgtctatctaattttctattttaaaaagtgttttttttttttgagacagggtctcgctcggtaacccaggctgcagtgcagtggtgccatcatggttcactgcagcctccacctcctgggctcagcaatcttcttgccttagcactcccctgcccccaccgccagatagctgggactatacatgtgcaccaccacatccggctaatttatttttatttttagtagagacgaggtttcaatacattgcccaggcttgtatcgacatcccgggctcaagccatcctcccaccttggcttcccagagtgccttgattacagacatgagccactgtacccggcccctgcattatctcttttaatgtaggacatcctctccatctccatcaccttcatttctttttatttttattttttctagacagggtcttgctctgtcccccaggctgggatgaagtggcacaatctcagctcaccacaacctccacctcccaggttcaagcaattcttctgcctcagcctcccaagtagctgggattacaggcatgcaccacctcgcccagctaatttttgtatttttagtagagatgggatttcaccatgttgatcaggctggtctcaaactcctgacctcaagtgatctgcctgcctcagcctcccagagtgagtgctgggattacaggcatgagccaccgcgcctggcctgatttttttgtttgtttgtttgtttgcttttttgaagagtcttagcaaattatcttgtagattagcccacattctcagtaggataatgggtttgattcctgataccttaaatttgaaatacccaagaaacatctaggctaagcttccatttgcctatttttttttaaaggccatatgaaagctaatcataaataaatacataaaattatcatagattttgaacccacaaaagaaaggtaattttttggcaccattaattaatatttatcaagcctccgctaatttataaataaattttattatgtatacttaaggtatacaacatgatgctatgggatacatacagacagtaaaatggttatacggggaagcaaattaacatatgcatcgtctcccttagttactctttttcatgtgtgtggcaggagcagctaagatctcatttagcagaaatccctcatattgcaattatatttactatagtccttgtttgcacattaaatctctagacactcccagcatcatccctcccaaaatgtgacatttatattaaataatttgtacttttttttttttttgagatggggtctggctctatcacccagggtggagagcagggtggcatgatctcggctcactgcaacctctgcctccctggctcaagcgatttgcccacctcagcctcccaagtagctaggaccacaggctcttgccaccatgcctgcctaaatttttgtattttttggtagaggtgggagtttcaccatgttggccaggctggtcttgaactcctgagctccagtgatccgcccgcctcagcctcccagagggctgggattacaggcatgggccaccacgcctggcctggaagtggtttttaaaatattttacttccatcctttcattatgatgtgttcctattaaaaaggtgatcatgtgtggaatcccagcagtttgggaggacaaggcaggaggatcgcttgagcccaggagatcgagaccagcctggtcaatatagtgagaccccgtctcagtctcatgcctataatcccagcactttgggaggctgaggcgggtggatcacctgaggtcaagagttcgagaccagcctggccaacatgatgaaaccccgtctaatagactaaacatacaaaaattaggcgggcatgatggcatgtgcctgtaatcacagctacctgggaggctgaggcatgagaatcagttgaactcgggaggcagaggttgcagtgagccaagcactctagagccactgtactctagcctgggtgacagagtgagactccgtctaaataaataaataaataaataaataaaagtttcagataatgaaatgattacttataattattataacaaaatcataaaatgtaactcacactgaaattagatatcgattgattgattatgatacctaattttgggtgtttcacaagcccagcaaattgatgggtggtgtgggggaggtgtacccttaatatgaagtccaatttaaagcttattctagcccaacaatttagacaatccctttagtaaagtaatgcacataccctctaggaaaatgctgtctttccactagtctggccaatccttgcttctctccctgagaaggggcgtgttatggaaggttgaggggatgaggggctggctcagagaacctcttggtagtgggggacaagtgtcctcagggaggaaaatcctcttaagaaataacttgagtgctcgtattagagaataaatgaaaaacaatctatgaactaagcatcggctttataaaattacagtaggctggtatgatggctcacgcctgtagtcccagcactttgggaggccaagccaggaggatcatctgaggccaggagtttgagaccagcctggcctaacctagcaagactccatctcaattaaataaataaacaaacaaataaatgtacaacagaataagttcaaatagaatgaaagaaatgacaaatataataataaacataagaatagaaatgaatgaaaaaaacaaagagccaggagagaaacattgcaaaagtcatttatttgaaaataccactgcaactgacaaaccactgtactcatcaagacaaaaaatgttaggaataaaattggggatgacattgcagctgctgcagagattaaaaagataaagggaatgttataagcaactttctgccaataaatactgaagtcgaaaaagttccaaaattctgtaactaccaaaattgattaaagaagaaacagacaacttgaatagctttgtaactattactgaaatatttccataaggtctagacagtttccaagagagttttatcaatcattcatgaaatagagagttctcatacttagcagactccttcagaaaatagaaagagcgagcacttcttaactccttttatgaggctaatataaccttgataccaaaacaagacaagaacagtacaagaaaggaaaattaaaagtcagtcttattggccacgcatggtggcttacgtctctaatctcagcactttgggaggctgaggcaggcagatcactcgaggttgggagatcgagaccagcctggccaacatggtgcaaccccatctctactaaaaatataaaaattagccgggagtggtggcaggcacctgtaatcccggctacttgggaggctgaggcaggagaatcgcttaaacccagcaggcggaggttgcggtgagctgagatcatgccactggactccagcccaggtgacagagcgagactccatctcaaaaaaaaaaaaaaaaaaaaaagtcagtcttattattgaataaatacacagaagtcttttcaaaggtattagtaaattaagtccatcaagcttggtatatcccaagaaggctgttttgtttaaaatgttcaaaacttattaacataaatccatgtcattagcagattaaaggaggaaacaatttcagtagttatatgaaaagattttgataaaatttaaatccattcatgattaaaaactaccaacaggctaggcatggtggtcaggagtttgagaccagcctggacaatgtggtggaaccctgtctctactaaaaatacaaaaacaggccgggcactgtggctcacacctgtaatcccagcactttgggaggccgaggtgggcggatcacaagttcaggagatcgagaccatcctggccaacatggtgaaaccccagctctactaaaaatacaaaaattagctggacgtggtggcatatgcccgtaatcctagctactcagaaggctgaggcaggagaatcacttgaaccagtgagtcagaggttgcagtgagccgggatcgtgccactgcactccagcctggtgacagagagagactccgtctcaaaaaaaaaaaaaaaaatacaaaaacaaaaaattagctgggtgtggtgggtgcaggcctgtacacctagctatgcaggaggctgaagcaggagaatcacttgaacccaggaggcagaggttacagtgagccgagatcgcgccaccgcactctagcctgggcaacagatcaagattccatctcaaaaacaaacaaacaaacaaaaaaccctactaacaaactaggaatagagggaaacatcttaggaatagagggaaacttctttaatgtggtaaaaggtatttatcagaaacatacattaatcatcagacccagtggtggtaaaaaaaaaaaaaaaaaaaattcccagaaaaccaggaacaagacaagaatacctactattgctactttaattaacactgtactgcaaatcttagctagcagagaagacaaaaagaaataaagtacagatagctcttgacttacgatggtgcaactttaggatgatgcaaagaaactgtactttgagtacccatacaaccatgccgtttgtcagtttcagtacagtattcaataaattacatgagctggtgaatacctgatgataaaataggctttgtcttggataattttccccaactataagctaatgtaagtcttctgaatatatttaaagtaggctaagctaagctatgatgtttgccaggttagtttattaaatacatttttgactataatattttcagcctacagtataagtattgcaacagaagaaatcaaactgtcatttttcaagtgagcctcaattatttaaccaggttactagatacaaaatcaatatacaaaagtaattatatacccctgtatcagcagcaaacttaaaaagtcatttttaaaaaggatactactggagatagccagccaaaaaaaaaaaaaaaaaactatagctagaaatgaatgtaacaatacaagggaaatctttctagagaaagatgtaacatttatattgaaggatattaaaggagagttaaatggagagagagaaagtatacaaggagagaaatttccactactattgaagcgatcacttttctccagattgatcacagaatcagtcattgtagttccagtaaaaatcccaacaaaattttttttgttttgagacagagtctcgctctgtcacccaggctggaatacagtggcaccatttcagctcactgcaacctccacctcccggattcaaggttatctcctatttgatctaaaatcaaatttttctggttatccctaagatttcttttgtaacggccctccctgcagctgaggtccaatcaggttcacatattacatttgtgtaatcccaagtagctgggattacaggcgcctgccaccacacccagctaatttttgtgtttttagtaaagacggtttcgccaggctggtctcaaactcctgacctcaggcgatcagactgcctctgcctcccaaagtgctgggattacagtcatgagccaccgagcccggccccagcaagaatcttaatgaaacttttgaaaagctgattccagaatttttatacatatgcaagaacaaatggtaaataatagtgaagataatactgaaccactccaagttagaggaattgccctaccagattattaaagctgcagtagttggcagagaatgagataaataaaccaaaggaacacaataaagaaatcagaatctggccgagcgcgttggctcttacccgtaatcccagcactttgggaggccaaggcaggaggatcacttgaggtcaggagttccatacaccagcctgaccaatatggtgaaacttcgtctctactaaaaatacaaaaatcagcctggtgtggtcacgtgctcctgtagtcccagctacttgaaaggctgaggcaggagaattgcttgaacccgggaagcagaggtagcagtgagccgagattgtgccactgcagtccagcctggcccacagagtgagactccatctcaaaaaaacaagcaaacaaacaaaaaaaaaaaaaaacaccggaatctggcctatgcatatatatagaagctgaataaattgcaaagatggtatggatcagtgaggaaaggggggacttttcatggtcctctgacgattggcaaatccttatagattaaacgaagttgagaccgagtgcactggctgctatctgtaatcccagcactttgggaggctgaagcaagcagttcccttgagccctcgtgttagagactaacctgggcaacatggtgaaaccctgtctgtacaaaaacttacaaaaattagctgggtgtgatggcacacgcctgtagtcccagccacttggaaggctgaggtgggatgattgcttgagcccacaagttggagacttcagtgagctgttgatcgcgtgccactgcactacagcctggctgacagagcaagatcctgtctcaaacagacaggcaaacaattaactagagttggagccctaccttacaccgtgtggaaacacaaattacaaggagagtcttagatcaaagctttaaactttatagaataaaatataaaagatgatgactttgggctgggtagaatttctttcttttcttttctttttttttttttttgagacggagttttgttcttgttgcccaggctggaatgcaatggcacgatcttggctcaccacaacctctgcctcccgggttcaagtgattctcctgcctcagcctccagagtagctgggattacaagcatgcgccaccacgcccagctaattttgtatttttagtagagacagggtttctctgtgttggtcaggctggtctcgaactcccaacctcatgtgatccacccacctcggcttcccaaaatgctgggattacaggtgtgagccaccacgcccggccctgggctgggtagaatttcttaaacagaaaaccataaaagagattgttgcagtaaactaccttaaaatttttaaataggagcttttttcatggaaagataccctaaagaaagtggaaacatggccgggtgtggtggctcatgcctgtaatctcagcactttgggaggctgaggcaggcggatcacttgatgtcaggagtttgagaccagtctgggcaacatggtgaaaccctatctctgctgaaaatacaaaacttagctgggcatggtggcacatgcctgtagtctcagctactcgggagactgaggcacgagagttgcttgaacctgggaggtggaggctgcagtgagctgaaagcattgcagtccagcctgggcgacagagtgagactctgtctcaaaaaaaaaaaaagcagaaagataaggccagtacactgctagctccatggtatgttcatgtgaactagaaaaaaggtttgccgttctcaatacttttcacatcacctgttggaaacttgccataataaagattcatacttacctcagtgtttaccgtgatagattcagacatccagaatgtgaagcatactgtctagggctgtgcatcccaccgttgtatgtggggtaaccttggccatgatttacaaatctggaagaggtagttgtcacacctgtaattaacaatgttcacaagatattcaaaatgctcgcatgtcaatggggggagaaacccagtaaggaaatgagtacaagtcatgagcataattgtcagaacattggaatggtcagtagctatatgaaaagatgtctaggttgcataataaccagggatatgcagattaaaataactcatctgcaagttattcctcctgaccaagttggctaaaattaaaaagtcaagttaggagcataagttgatttaaactttttgaaagccaatttggcatctggtgataaagactcacctgtaccttgacgcggcagtttcactcctaaatatatacgctaaagaaacaagcatggcgggtgcggtggctcatgcctgtcatcctagtactttggcaggcagaggtgggagtggcgcttgagcccagaagtttgagaccagctgagcaacatagtgagacctccatcttgacaaaaaaatttaaaaagttacccaagcatggtggcacatgcctgtagtcccagctactcaggaggctgaggcaggaggatcacttgagcctgggagttggaggctttgatagcaacactgcaccccagcctaggagacagagccagaccctattttaaaagaaaattaaatagataaataaacttatttgccctggaaaaccagttcagaaattttgaaaatagttaacatatgaaaacaacccagccggccatcaacaggaaaaagaatatgataaaactttgttgtaacaaaagattaataaagaaaagcatatggatttatttgctgaaagttacgagctctgtatacccagggcctctccttcacgagcactaaataagtgtttattggatgggtggatggaagcatcgtcctcatcttacagataaaaggactaaacccgagagaggattccaagtcacacaggtcataatggcaggactggcctcgatcctggggccgtctggcatcccagaagtgctaaggttggtgtgctctgatactgcttgagcggggaggaagcagtgccttcagcccctccctgatctcagccaacctttccagtctttgactgacactttgagaggccgagacaggcggctcacttgagcctgggagctccagaccagccttggcaacgtagtgaaactccatctctacaaaaaaatgcaaacgttagccaagtgcggtatcatacacctgtagtcccagctacttgggaggctgatttgggaggatcatttgagcccaggaggttgaggctgcagtaacctatgatcacactgttgcactccagtctgggcaacagagcgagaccctgtctctatttcaaaaaaaaaaaaaaaaaaagattgatgttcatcttgcatacagtgctctgcaaaccctgcctgaagcccccttcccttctaaccagcccctcctagacaaattctggagcttggtgcattgtctcgtgtacatccataactgtgtccatgcgctttgctacaaccacgatctgcatcgttggaaggagtggagcccaggttaactgtgaatttcatcacagtatcacctgctgacatggcctgagggagggaccaaggaatgatctgaaacttccctttgtgctgaatgtctcccttacatgcagcgcgctggccacgttcagagctgcatgcaggacgtgctctcggaggctgggttttactctctggtcttcattcaacgcaaccttttcgggagcctcctgcttccagctatgggccaaacagttgctaaagatgtctcattgaatacagtcaactaggatcctgctattctaatgaagggaaactgatgataaacacaaaaggcaatgttagatggcgccaggcactgcgagggagacacactgggtcttggggtagagcgggaagaggtggtagtgacttcttcagtcatccagggaggcctctccagggaggatgacggaacatcagaggaaagaagcaaggagaaccagccacactcagagctgggaaagagcagcaggaagatgggggcagtgagtgccagggctctgcagggatgggcttgcctggcagggagcaataccaaggaagttagtagggcccgggtcatgccagggccttgtaggcagaacccttaagtctctttgtagggaccctttggtctcccctttgaactaggccctttcaaagacgtacagtagaaagcaaattccccatgggcaccggcaggatgatttgacagattctaatcaaataattggggaaataaagttgggtgaactacagcagtctatgaatgagttaaaagtgactacgagtctgctgcccatcttgcagcccatatctgttgagctgtaacatatttaagcattcagatctaaaggccattgctaaataaagccagggcgtccatgtggttcgctccaaagagcatttcacagggagccagtccaggcgctgccgcccaccacctctgtgaccttgggtgagtctcggggcctctttctgcccgactttgctcatctgtaaaacgagtgggttacccagatcctcccccaaggagctccgtagctctgaaacctcatgagactcactggagcagtactttggttgactatcgctagcagaaccgaaaaggacattctccagcaatgtaaatctgttcaaaaatgggatgagctggctgggcacagtggctcatgcctgtaataccagcactttgggaggctgaggcgggtggatcacaaggtcaggagttcaagaccagcctggccaacatagtgaaaccctgtctctactaaaaatacaaaaaaaaaacaaaaataaaaaaattagccaggcatggtggtggcaccagctacttgggaggttgaaacaggagaattgcttggacgaccacctgccagggagattgtcacctcttatccattctttttttttttttttttttttttttttgaaatagagtctctctgtgtcacccaggctggagtgcagtggctcaccataatctctgcttcctgggttcaagcgattctcctgccttagcctcctgagtagctgggatttcaggtgtgcgccaccatgtccggctaattttgtattattagaagagatggggttttaccatgttgttcaggctggtcttgaactcctggcctcaagtgatcaacccgccttggcctcccgaaatgctgagattacaagcatgagccaccatgcccttgccttatccatccttctaaatgccagatcctccaagtcttcccaaaatacccagccagaaacagattcttcctcttctcatctctaatagggcttcatttatatctcccttttgattttttttttttttttttttgagatggagtcttgttctgtcacccaggctggagtgcagtggatgatctcggctcactgcaacctccacctcccgggttcaagcgattctcctgcctcagcctcccaagtagctgggactacaggtgcacaccactatgcctggctaattttttgtatttttagtagagacgggattttgccatgttggccaggctggtgtcaaactcctagctcaggtgatccgcctagtggttaggatttggcgctatctctcccttttggttttgagcctaaagacattctgcccttatagtttgcttaccaaggccttatgcttctaaaatgtagaagggaggatgtgtgtgtgagtgtgagtgagtgtgtgagtgtgtgtgtgtgtgtatgtgtctttgtacctgtttctgtccccatcttaccagtacttgcctaaatactgcattaagcatcatgggtgaaataggattagagaaggttggaccagatcagtggctcccaaagctgctgctgggttggaccagtgctgcactggccctatgagaattgctcacatgtttccagaaatacagctccccaggctcctaccctgacattccggtgtagaaggcctggggtggaaccttagaatctgtcatttttcaaagcccacctctgatgctcatgcactgctagttgtaggaaccactgggctcggttccctgaaagagctctttctcctggtaacaagttctgtgactctctctgcccactcagtcttcttagattggcatgttagaagctccatgacttgcctttgaaatatttttccagcttcaaagtcctggacttctactctggccgaactggcctgtgtattatgagtcacctgaacatactttttgatttcctgaaggctctgttattgttaagacccttttgctgttccctacctataaaactcatttccatcctttagggctgaaccgaaaagtctatctcctttgatcattttcctgaccatctcaacctatttctaactttttccctctttttttatcctcagctctattaaagtatcattaacaaagaaaagttgtatatatttatagtgtataatgtgatggtttggggtttttattttttgagacaggatctccctctgtcacccaggctggagtgcagtggcataatcagggctcactgcagccttgacctcccgggctcaagcaatcttcctgcttcagcctcccaagcagttaggactataggctcctggccaggctaattttatattttttcgattttagtaaagccgaagtctggctgcgttgcccaggctggtcttgaactccagcagcacagtctcagctcactgcaacctccacctcctgggttcaagcctcagcctcctgattagcagggactgtggacgtgtgccaccacgcctggctaatttttttattttttgtagagacgaggttttgccacgttggctaggctggtcttgaactcctgacctcaagcgatcctcccacctcattctcccaaagtggtgggattacaggcgtgatccaccacacccagcccaatgtgatgttttgatacatgcatacattacgaagtgatttccacaatctgacaacatacccattagctcactgtgtgtgtgtgtgtgtgtgtgtgtgtgtgtgtgtgtgtgtgtgtgttgagaacacttgagatctactgccttagcaaatgtcatatatatgattacaagattattaactatagtcaccatgctgtaccttggaaaagaaaacctacttttcttgcttaagtaaaacttttacccttttcaaggactgggggaccttgagtatgtgcagattttggtacacgcagggggtcctagcaccaatctcctgcgtgtaccaagggatgaccgtgtgtatagaaaatcacatgtttattacccatgtatttgttgttggatgcttagtctgtttccatatctttctattgtaaatagtgccgcagtatacatgagtgtgcagataactcttaacaatactgatttcaatccctttgtggtgttgctggatcgtattaattttggggggaacctccgtactgtttcccataatggctgtaccaatttacattcccaccaacagtgtacaaagatgcccatttctccatgtctcactagcactcgtgtgtctttttggtaatagcccttctaacaggtatcaggtgatacctcatcgtggttttgagtcaaattttccagatgattaaagatgttgagcagcttttcatatacctgtcagccgtttgcatgtctttttttagagagagacagggtctcactctgttgtgcagactggcgtgcggtggtgcgatcatggctcactgtagccttgaactcctggcctcaggtgatcctcctgtcttggcctcccaaagtttttgggattacgtgagccactgcgccaggccttatgtgttttcttttgagatccttagcccattttccgtttttttgttttttttggaaagagtcttgctctgtcgcccaggctggagaggctggagtgcagtggtgccatcttggctcactgcaacctccacctcctaggttccagcgattctcctgcctcagcctcccaagtagctggggttacaggtgtgtgccaccacacccagcaaatttttgtatttttagtagagatggggtttcactatgttgtccaggctggtctcgaactcctgacctcaggtgatctgcctgccttggcctcccaaagtgccgggattacaggtgtgagccactgcgcccggccaccttagcccattttctaaacagggtgcctgttttcttgttattgcattaacttttcccctctttccagcctgctcttaagattgtacatgctttgagggcccgtatcttgtcttagatgctttatctattctttgccttatggaagtggttacataaaacattcttagctgaatttccccctgcttctcgccttctccttgttaatgagtacttattgagtgtgatgtgcgagcatctactttggttcctagacgcccacaagcaaaataggtcagtgccctgctgggagtagggaggggttgtcagggtcttctttgggtttgtggccagacaggcgactgtggagcagaccaggcactctggggacaggatgatgcgttctggctggaagatacagggaggcttcccagggaccctaacacagcctgctgccctggacctttgctggggaactgacttctcagccagtatgtctgtccgcaggctcttgggccttctgcagtggtggaggtgacagtggtgttagccgtggtggtcactgtggtgatgtggctgctgtactgtcattatcttatggcaaaacccgcaagcctgacacacacagtgtctccctgtaagttcgcgccatgatggctcaattagggacccgtcggactgcggctcaacatccaggccagctgcataattgaaagcacattttctcctccaaagctgcagctggtttggttctgctcatgcagaaagggatctaaccttgcataacataggaaatgaacagttgagagagaagccaaattcaatttcagtcagatatgttgaggctaagtccatgatctatggaagccggggcaggagccgtgcgcctgtggaaaggggcgctctcagcagtctattaatcacggccgcccgcccggcgctgccgccactgccgggtgccactgcgcccgcgcgccccctccgatgtgggctggagcgcagccaagcactccagaagttaacctcttaaagacccggagctgctttctgttgaataaatgtaattttgtggtcagaaataaatgcttgtgatatagcaggagctttgaaaacaacggcaagctggagcgattacaaattgctccatgttgtacaagtcaacagcagacatcaaaattccacgtggagggcaaattgatttcggcccagagctctgcagctattcaataaaagtcctattaaaccattgtatgtaatgaacaatccagagcaaatctaatattttcagtggataattatttttaacatcctctcggtaactgctggtagatttcttggatgtttacagctcgaactcgggcagagtgggccttcccagctgtcatttggcatctccgccaggggacccgctccagggacccagctgcgtacatggctcctgaacatggggctctggccttggggttcaggttgccaaggaagggtgcatggggtttctgaatctcccagtgcctgggatgtagtaggtgcctgggaaatgtttgttgaattgagctgaactgagttgaaatgcacaagaggaagctctaagaaccccagaatgacttaggaaaatgatattgtggcaaagttgactcaaaacctgaggctgaagagaccagtgggttgcaggtaaggaaattgaggtcccttgtgatagaccaatgtcagcccctatgggagtcgggacagagctggcaccccgggaaaccccaggacttacccaattcacttcccgtttttggagatggactcttgctttgtcacccaggctggagtgtagggatgcgattgcagctcactgccacctccgcctcccaggttcaagtgattctcctgcctcagcctctgaagtagctgggattacaggcacgcaccaccacacctggctaatttttatatgtttagtagagacagggtttcgtcacgttagccaggctggtctcgaactcctcacttcaagtgatccacctgcctcagtctccctaactgctgggattacaggcgtaagccactgtgcccagcccccatttcactcctgttctgttttggtttggtttggatttttttttttttttttttttttttttgagacagtctcactctgtcacccaggctggagtgcagttgcacgatcacagctcactgcagcctggacctcctgggctcaagcagccctccagcctcagcctcctgagtggctgggactacaggtacacaccactacacccagctaatttttgcattttttttttgaagagatgagggcttgctacgttgcccaagacggtcttgaactcctggcctcaagcagtcctcccacaaaggcctcccaaagtgttgggattacaggcatgagccaccacacccagctcacttctgttcttgacagcttgcgaagtgcattctttgtcagggaggccacactgggagagtcgccaaagcgatcttgttgctcatctagtgttcccacccccaggatgctcccctaccttgctcatgacagggctgtaaccctgtccccttccagaccaagagcttctcagggaaggtctgttcattcattgattcattaaatatttgtggagcatgtatgccaggctagaccagaactagaccctggttagtggtggtaggtgaatgaatgtagccgttgccttcatgaagcttaacagtttagcaagatctgtatccccatgtggcacagtgcttggcgctctgttaagtgatggtggatgggtggatggattggtggatgaatgggtggatggtgggtgtgtgggtggatggatgatttgttagataaatgggaatggatagatggttgattgcatggagggagggtgaataggggatagatggatggatgattggatagaaggatggatggatagatgattggatagagggatggatggctggatgattggataaagggatagatggatgggtgataggatagagctatggatggatgaagggagagatggagggagggagggaaggagggagggagagatggatggatggataactggatagagggatggatggatgattagtctagaggtagggagggagggagggatggatggatggatggatgattagaaagcagtatgtgtctgtaagaatagattgactcttactcattttcgtctcctggagtaaaatcatccaacttgtaatgctcagtcatacagtatttatttgactatcgtggaatttaaatttctagggtattttattttctgcagatctcccttcccttggaaaaactcaatatggatgttaattaggttttactaaagttccatcaatttaatgcagtcgttctttaaatgaaactgacaccaaggaccacatggccaaaggaagcccacgttcctgtgtgtggttctgaggagggagcataggatgcagtttgataacagctgagagccctgaggagtttgttgctggatgtggagtattccatgtctcgtccctcccccagtctttttccagttgtgtcacaactccctttgctaataatattttgcacagcattttacgtctacaaagcaccatttccatgatgtcgctcacccttcgacaccaccctgtgctgggggcatcatcatcattctgagttaccaacaggaggggtagcagacagtccaaggggcaaggcagggactcccagctccaggctccagcctctcctcccctccaccctctcctggtcctgtcctgaaatctttggctcccttgaaacttgttatgcccgggcaaatgccaccctcgtgccactgtattcccaccacctccaatgagtgtcccccacctgatggggtcacacacttgtccagccacctgcacagaaaagcctcatggacacagccctgtgaggtcagaaatagaccgaacagggtcactcggttggaaggcgtggtagtgttagaacccaggtgtttgaactcggtctaatattcattccactctttcacacacacgtaagggcacatgaccactattaatcaaattttcaaaaaaaaatcagctgggcacaatggctcatgcctgtaatcccagcaatttgggaggccaaggcgggtggattacctgaggtcaggagtttgagaccagcctggccagcatggtgaaaccccgtctctactaaaaatacaaaaattagctatgcatggtggcacacgcctgtcatcccagctactcgagaggctgaggcaggggaatcacttgaacctgggaggcagaggttgccatgaactgagattgcgccactgcactccagcctgggcaacagagcgagactccatctcaaaaataaataaataaagggaatttgacataaaatcgttaatgttgactgtttcagcctgggtgacagagcgagactctatctcaaaaaaacaaacaaacaaacatgagctccatgtctgtttcatctgttcccctctaagtataaacttcctgagccttctaagtccagccaggtgggccagcggtcaccgagatccttcctcgctgggggatggaataggcctcccctgctttgctgctgttctttggccttgtcccctgcctcttttcttggaccacctacaaggacctagggggacacagtactgggggcaggagctgggaaaggcctgccatggttcactgatagtaagaaatagagactcactcggagaaatttcctctgaaatacagcagactcagcgcagccctttgggcagatgaaggaggctgagaagagcatcccttcagcaacagctgcgtgccagaagcttcgttccgttctgccatttcatctgcacagcagctcagcccggaggggagaggagtaaatgggcccagagagatcaagtaacttccttggagcttgtcagccttgagctgaaacttggactctgatgtcgaactccgaagcccatgcttattctgtaaagcctgaagagtgtcttataattgatttagaagtaggagaagagggggaacctgtgagattacactgtcttccagcataacaagaaaagagaaaccagttggatgcggtggctcacacctgtaatcccaggtgtgatggagaggccgaggcaggaggatcacttgagcccaggagtttgagtccagctggggcaacatagtgagatcccatctctaccaaaaaaaacaaaaacaaaaaaagaaaaacggaaacccatgaaatgatccatgggtacataggaagggagagaaactggttcctagggctgtgggaggaatgaccgcaggcctgccctgggaaaaagctttgcttttcagggagccccttgatgtttggggacttaggagagcaagtctggccctgagatgtgggaccaggcatccccacagagcacacatcagcagataagggctgccgctctaggaacagtcttgtcccagcgcaggcacgaggagggctcaggaatctggctgggagcattcctgccgtccctactgaggagctgccactgtggaccagaacacccccctgataggagcagactcccggggtgtagacactgcttcccttttcacaccgtctcctgaattttctcctgggttcctgcttaaaggagcggagaaaaccaaactgacaaatcactgatcttggagtcagatctggatttgaatcctgacatcatcatttgccagcgtgaccttgaatatctcatgtccgcttctctgtcccatccatataacaggaaatctctctcgcagagcagcgacgttatatgcacatgtttaaagatgatggcataaaagcagtgctggatgggagctggtagctagttattgattataggatcctctaggtcctttaacttcttcaatagccgtagtccccaggatttaaccttctggggctttccctgtatctctgtcccatccacactccagagtaacctcatctgggccgtttggggctggtggttccaaatttttgcctctggcctgggcccgtcatccaacgccaggcctccctggggctcccactgtgggtacctcgctaactaataatcttcatttcccatgtaaacacaggcacctgcgtatgccccatttcgggagaggtaaccagcccctagttgccctggccagaactctgggagaagctatgttcagtattagaccctgtgaattctttttattattattattattattattattatttactgttgtgttgggctctcgctctgctgcccaggctggagtgcatttgtgtgatcatagctcactgcagcctcaaattcccgggctcaagtgatcctcccgcctcaacctctcgagtagctgggactatgggcacatgccaccactccctgctaagaccctgtgaattctatttccctaacctcgctggaatcagctccctccttcccagcagttggctttctccctctctttcctggtctggtctgtctaccaccagttgccatcctgtcctgagtgatcgcttcatttcccaccctgattgacatcctcagggattccccttcagcataagctgcccccaccccgggcgtggtcccttgcacctccctccacaggctggcccctgcctgcctcctcacctcacgtatccccagtcacctcctctgctccaaggcacggcaggtccctgcccttctctgagcaggccactttgtttgaacacgtctctgtgtctttgaatagccctcctctccccactgaagccttctgcctcccaccacgaataaagatgatctttgtcttctttaaaacttgccctaagtttgcaaaacacaggatgtagagcagcatctaatagactatcatttgtgtttgaaaaaaaaaaaaatagggccgggcgcagtggctcatgcctgtaatcccaacactttgagagactgacgcgggcgtatcacctgagctcaggagtttgagaccagcctggccaacatgttgaaagcccgtctttaccaaaatacagaaaattagccaggcatgatggtgcgcaactgtagtcccagctacttagggtaggaaaatcagaggcagcagaatcgtttgaacctgggaggcagaggttgcagtgagccaagatcgtgcctctgcactccagcctgggtgacagagcgagactctgtctcaaaaaaaaaaaaaaaggaacacagtgcatgtctataggtgcttgtaaatgcataaatacctctgggaggatgcccaagactatctttacctccagaccaggcagctggatgacaggtggatgtggatgggaggaagacctacttttcactgtcaactttgttttcgctttgcttttctttttacaattaaatgacttttagtgtattcaccaagtcatgcagccatcaccctaattccagaacattttcgtcagctcaaaaagaaacctcatactggccgggcgcggtggctcacatctgtaatcccagcactttgggaggccaagtcaggcaggtcacttgaggtcaggagtttgagaacagcctggccaacatggcgaaaccccgtctctactaaaaaaacgaagtacaaaaaaattagccaagcgtggtggtgggcgcctgtaatcccagctactcaggagactgaggcaggagaatcacttgaacctgggaggcagaggttgcagtaagccgagattgcaccactgcactccagcctgggtaacagagtgagactccatctaaaaagaaagaaagaaacgtaatacccattagtggtcactcctcatttatcccaaccccaacccttggcaaccatgaatcccccttctgtagatttggccattccccccatgtctctgtagatttggccattcttaacatttcatatcaatgagatcaaataatatattagttttttgttcccggcttcttttacttaaccatggtttcgatattcatctatgctgtagcatataccagtacttgctttcattctttttatggctgaataatattccattgtatggatgtcccatgttttatttatccaattatcagctgatggccatttggagttttgtttccccactttttggctattatgaataatgcttctatgaacatccatatacataagtttttgtgcaggtaaacacttttgtctttcttgcctacctaggagtagaattgctgagtaatagggtaactctatttttaacattttgaggaatggccaaactgttttccaaggtggctgtgtaattttacatttctgtcagcaatgtaggagggttccagttcagtttctcgacatcctttctaacacttagtatcatcttttttttgggagacagggtctcgctctcttgcccaggctggaatgcggtagtgtgatctcggctcagtgcaacctctgcctcgcaggttcaagcgattctcctgcctcggcctcctgagtagctgggattacaggcacgtgccaccatgcccagctaatttttttgtatttttagtggagacagggtttcaccatgttggccaggctggtctcgaactcctgacctcaggtgatctgcccgcctcggcctcctaaagtgctgggattataggcgtgagccaccgcagccggccccattatatgtctttttgatgctagtcatcccagtggatgttgtggtatctcattgtggttttgatttgcatttccctaatgagtattggcattgagcatcttttcatgtgcctattggccatttgtatctttggagaaacatctattcatatcctttgcccatattctaattcagttacttttattaaatatttttaatttttgtggggatgtatatatatatttatggggtggagcacatgagatgttttgatacaggcatgctacgtgtaataatctcatatggaaatggagtatccatcacctgaagcatttatcctttgtgttacaaataatccgattatacttctttaattgcttttaaatgtacaattaagttattgactgtaatcaccctgtcgtgctatcaaataataggtcttaattcattcctcctggcttttttggtacccattaaccataccacctttccagccccactacccctcccagcctctggtaaccatccttctactttctatgtccaagagttaaaaattgtttttatgtttatatcccacaaatatgtcagaatatgagatgtttgtctttctatgcctggctaattgtttttttatttaatgagttgtaagagggcttatatattctggagtatcttttcaaaacttccattctgtgggttgtcttctcacttttttttttttttttttttttgagacagagtctcaccctgttgcccagggtggctgcagtgtcacgatctcggctcactgcaacctgtgcctcccaggtttgagccattctcctgcctcagactcctgagtagctgggatcacagttgtgtgtgccaccatgcccagctaatttttgtatttttagtagaaacagagtttcgccatgttggccaggctggtcccgaactcctgacctcaggtgatccacctgcctcagcctcccaaagtgctgggattacaggtgtaagccactgcacccagcctctcttttcagtttcttggtagcgtctttagaagcgcagaagttttatatttgatgaaatccaatttgtcgatttttcttctggtatttgtgcttttggcatcatacctaagaaaccattgcctaatccaaggtcataaaggtttacacctgtgttttcttttaagaggttttatagttttagctcatatattttggtctttgatttattttgagttaatttttgcatatggtgtgaggtagggatcaaactttgctcttttgcatgtggatatctggtcgtcccagcaacatttgttgaaacactgttcttttacccttgaattgtcatgtcactcttgtcaaaaatcagttgatcataatatgagggttcctttctgggctgtattgatctgtgtgtttatccttatgcccctaccagttcaggtcaatgtagttttgtatttagtattgaaattgggaagtgtgactcctccaaccttgtttcctttttcaaaattattttggttatttggggtcattgcattttcatatgaatcttagaatcaacttgtcaatttctgcaaagaagccagctgggtctaggcacaggggctcttgtctgtgattctaacactttgggaggccaagacgggaggatcacttgaacctaataattcaagaccagcctggacaatataatgagatctcatctctacaagaaaaaagttaaagattagccaagcatggtggcgcgttcctgtagtctcagttactccggaggctgtggcaggaggatcacttcagcctgggaattggaggttgcagtgagctgaggttgtgacagtgcactccaaccagagtgacagagtgagaccctgtctccaaaaaaaaaaaagccagctggaattttgataggcattaccttgaatgtgtaaatcaacttcgtgactattgccatcttaaaaatattaagtcttccaatccataagcattggccatctttccatttagtttagtgtctttcagcagtgttttgtggtttttagagcacaagttttgtatttcttttgccaaatttattcgtaagtattttatactttttgtgatgctattataaatggattttttttttttactttcactttcagatcatttattgcaaacatgtagaaagacaaatgtttttttacagggatactttgttgcattgagctccacttttttatgctttgaagatagtgtgtttcttcaaaaatggaagtctgtagcaaccctgagtcaaacaagtgtgtcagcattatttttccaactgcaggtgctcacttcctttctctttgtcacactttggtaattcccacaatatttccaattattcactattattatatctgatatggtgatctgcagtcagggagctttgatattactatcataattgtttggggacaccacaaactgtgccccatataagatggcagacttaattgataaatattgtgtgtgttctgactactccaccaaccagctgtttcccatctcttcctgtctttgggtttccctatttcttgagacacaacaatattgaaattaggcaaattaataatcctgcaatggcctattaagtgaaaggaacagtcacatgtctttcactttaagtcaaaagctagaaatgattaagctcagtgagaaaggcgtgttgaaagctgaggtaggttaaaagctggacttcttgcaccagttagcccagtcattagtgcaaaggaaaagttcatcaaggatatgaaaagtgctgctccagtgaacacatgaatgataagaaagccttatttctgatagggagaaaattttggtgatctgcatagacgatcaaaccagccacaacattctcttaagccaaagtctaattctcttaattgggtcttaattgtctcaagccaaagccctgactcttcaattctatgaaggctgacagaggtggggaagctaccgaataaaagttggaagctagcggaggttgattcatgatgtttaaggaaagaatttatctccataatacaaaagtgcaaagtaaagcagcaaatgctttggtggaagctgcagcaagttatccaggagatctagctaagataatcaacgaagatgatggcgctacacaacagattttcaatgtaggtaaaataaccttctcttggaagaagatataatctaggacttgcataggtaaagagaagtcagtgtcttgtctttaaagcttccaaatgcaggccgactctcgttaggggataatgcagctggtgacttgaagttgaagccattgctcatttaccattcggaaaaatcctagggccttcagaattaagctacacctactctgcctgtgcactagaaatggaatcataaagcctagatcacagcatctgtttatagcatgttttactgaatattttaagcacactgttgagacctactgcccagaataaaaaaaggttcttttcttttctgagacagtcttgctcttgtcacccaggctgaagtgcaatggcatgacttcagcacactgcaacctctgcttcccaaattcaagtgattcttctgccttagcctcctgagtagctgggattacaggctcccaccaccatgctcggctactttttgtatttttagaagagatggggtttcactatgttggccaggccagtcttgaactcctgacctcgtgatccgcctgcctcagcctcccaaagtactgggattacaggcatgagccaccacactcggctgataaaaagattttttgttttttgttttttgttttctggttttttttttttgagacagagtctcgctctgtcacccaggctggagtctagtggtgcgatctcggctcactgcaacctctgcctcctgggttcaagtgattctcctgcctcagcctcccgagtagctgggattacaggtgtgtgctaccacgcctggctaattttttgtatttttattagagatggagtttcactgtgttagccaggatggtctcgatctcctgacctcgtgatccgcccgccgcagcctcccaaagtgctgggattacaggcatgagccaccgcgcctagccgaaaggttcttttcaaaatatgactgctcattgacagtgcacctggtcaacaagagctctggtggagatgtacaagatgaatgttgtttccatgcctgctaacacaacctgcattctacagcacatggatcagggagtaattctgacactcaagtcttattttttaagaaatacattttgtaaggctatagctgccatagatggtgattcctctgatagatctaggcaaattaaatagaaatcctttccttctggaaaggagtcaccattttagattccatgaagaacatttgtgattcatgggagggggttgaaatagcaacatgaacaggagtttggaagaaatggattccaaccctcatggatgactttgaggggttcaaggcttcagtggaggaaggaactgcagatgcgggggaaatagcaagagaactagaattagaaatggagcctgaagatgtgactgaattgctgcaacctcatgatcaaacttgaatggatgaggggttgcttcttatgatgagcaaagaaagtggtttcttgagatggaaactactcttggtgaagatgctgtgaatattgttgaaatgacaacaaaggatttagaatattccataaactgagttgataaagcagtgactgggtttgagaggattgactcctattttttaagaagttctactgtgggtaaaaatctatcaaacagcaatgcatgatacacagaaatcttgtgttaacgaaagagtcaatcaagctagccaatttcattgttgccttaacaaattgccacagtcaccccaagcttcagtaaccacaaccctgatcagtctagcagccatccaacaccaaggcaagactctccaccagcaaaaagattacaactccctgaaagctcagataatcgttagcatattttggcaataaagcattttttaattaagatatgtacatttttgagacatagagctattacatacttaatagactatgatacaaacataacttttatattcactggaaaatcaaaaaatttatgtgacttgcttcattgcaatatttgctctttttgtcatatttgccttttttgttctatttttgagacagtctccgtcactcaggctggagtacagtggcacaatctcggctcactgcaacctccacctccagggttcaagcgattctcatgcctcagcctcccgagtagctggaattagcaggcatgtgccactacacctggctaatttttttttttttgtatttttagtagagacagggtttcacgatggtggccaggctggtctcaaactcctgacctcaggtgatctgcctttctcagcctcccaaagtgctaggattacaagtgtgagccaccgtacctggtctgtttttactttcttatggtggtctggaaccaaacctgcattatctttgaggtatacccgtatattgatcttgcattgtgaaagtcttgctgaatgtgtatgtttttatacatctacaatttttttattgtacacatatattatctactcacaacaatggtgatgtgaaaatctcaggtaggcatttatcccctaggaagcctgccccactcccccaccgggatttacccgagggaggtaggagaggggagcattaccccatcttaaactttttgggagcagcagtaggaatctgtgtctcccataggctggaatagaacatagcctagcacatcttagcctccttaaatgactttattgacagaatgaaggaagaagtgaagcgggggtgagcaagcagccagcacctccttcctctgaagagcctgctgcaggcaggtttccctgttgtctaagctgtgatctgctgtcctggagcatttacctgctcatgctggttttgcactgtggggagagagaagacagctaatctttcttccccaagacagcctttcagatagatgttgacagccagaatggcagatgtacttggaagggctttgtaaactcaaggagaatagagatgcttgttgctgtttttatcatcttggcttttaatcttgtgctgtcccctgccacaaatctcctctatggatcccacaccctttctccaagccagcggcttcttcggggcctctctagttttcctcttagaaactttactaagtgggaccgggtacagtggctcacacctgtaatcccagcactttgggaggccaaggcgggtggatcacttgaggtcaggagttcgagaccagcctggccaacgtggtgaaaccccatctactaaaaatacaaaaattagctgggcgtggtggcaggtgcctgtagtcccagctactcgggaggctaaggcaggagaatcacttgaacccgggaggtggaggttgcagtgagctgagatcgtgccacctcactccagcctgagtgacagagtgagacttcatctcaaaaaaaaaaaaaaaaaaaaatttaaaaccctcaagatttggcctgcgtacgtgtctgttttggacagcatccgactcagtcttagctgacttctagtgtttaatgtggcccttcaaaccatgctttgctcttgaaaacattctacagccagacttcgagtgagacaaaactaccctatcatatccctgcagttttgttgatttttattgtcctatagtccgacagagctcatcgatttgaaaattcttttaatggcctgtgtttatttctaaatcattagcttgtaaactcccagggcatagaggctagtggattgttcttgaatatgccgtcttcactgtggtcttaaatgttgcttaggggccaggcgcagtggctcacgcctgtaatcccagcactttgggaggccgaggtgggcggatcatgaggtcaggggatcgagaccatcctggctaacatggtgaaaccctgtctttactaaaaaaatacaaaaaaagtagctgggcgtggtagtgggcgcctgtagtcctagctacttgggaggctcaggcgggagaatggtgtgaacctgggaggcggagcttgcagtgagccgagatcacaccactgcactccagcctgggagacagagcgagactctgtctcaaaaaaaaaaaatgttgcttagggtcctggtcctccaggactttccacatcttggcttcctgcttgatttgatcacgacggggaataacctatggtgtggtggaaagaaaggtgctgactttggatttattagcgaaggttagtgctgttgacccggtttctatccagatggtgtcagatacttaatgtaggaggttcccacatttataatcacaacagctcaacaaggagggagttactaccctcacttaatggacgaagagatcaaggcttcagtatatatatacacacacacatatatacatatatatatatacacacacacaaataaacacacacacacacacacacacacacacacacacactttgctgcccagtcctggagtgcagtggcatggtcttgggtcactgcaacctccaccttctgggttcaagcaattctcctgcctcagcctcccaaatagctgggattacaggtgcctgccaccacacctggctgattttttgtatttttagtagagatggggtttcaccatgttggccaggctggtcttgaattcctgaccttgtgatctgcccacctcagcctccaaaagcactgcgattacaggtgtgaaccaccgcgcctggccttttttttttttttttttttttggagacagactctcactgtgtctcactctagcccaggctagagtgcagtggcatgatctcagctcactgcaacctccgcctccagggttccagtgattctcctgccccagcctccccagtagctgggattacaggtgtccaccaccatgcctggctaatttttgtattttcaatagagacaggtttcaccatgttggccaggctggtctcgaactcctgacctcaggtgatccatctgctttggcctcccaaagtgctgggatttacaggcgtgagtcactgtgcccagccaaagacttcagcatttaagtaacctgcctcccggtcacccagccagtgtgtgctggaactaggattcaaacccaagtctgtcttttgatcaaaccacacactctttccattgaccatgtggcccccagccccagtgcgcaatgctggatgttatcatatccctaggaggggccaggagccagggtccaagtaacttggtgggtttctgcgtctgagaaatgaagctggtgagacggcggttccttcactgttttccaagggctgccacggctttgatcttgacagcaaccaagatgtatctccccactttgcagatgaaaaaactgaggcccagagaggttaattcaatggttcaggcagagcacctgttttatgttggagctggaaatcaaaccctcatgtgccaacagcatgcccaggcccttggctgtgtgtggcgtggacttgcctaccacatgggcatggccaggcccctgtggtgcagtggagagatgagccttttttatttcaaaatacacagcacttcttggccggtcacagtggctcatgcctgtaatcccagcacttcggaaggctgaggcgggtagatcacttgagctcaggagtgagccactgtgcccggcactgtatgttactctcttagagatatggccaactcgtgagatctgtaaccatcagcttttactagattatgctgcagtaacaaacaaactgctacaaatctcagtggcctgtggcaaccaaagatcatttcttgttcatgtgtcatgttgactagggctggctgtgactgtgccccagccccgtgggtggtcctcattctaggatctcagtggaggaagtaggtcctataaggtccttgcagcagagggagggagcacactggctcttaaatcttaatgctcagataagacaccatcacttacataccattggccaaagcatttcgtgtggctatgcctgacatcactgaggagggaaagcacccagggggaagttgctgttacaccacaagtcacgtggcagtgggcagcgatgtgtgacgcctcctccagggagcctagatggtagttgggagcggcagcagcatattccatgtgactccgggaacccacagcacagccgtgctggcactcacatggttgggcactttctcaccccttccatatctcagagatctggtggatttctatgaaacttgttttctaaacctagactgagtttttatactatcataagcggatactgattgagagctagattaaaataccttcctatagacatttgtctttctcttattttatttgagacagggtctcactgtcacccaggctggagtgcagtggtgcaatcatagctcattggagccttgacctcctgagctcaagggatcctcccaaagaggtgggaccacaggcatacaccaccacacccacccagccaattttttattttttgtagagacaggatcttgctacactgcccaggttgatctcgaactcctgcactcaaacgatcctcccaccttggcctcccaaagtgctgggattataggcgtgagccactgcactacacatttgtctttaaatgtaacacttagccgggtgcggtggctcatgcctgtaatcccagcactttgggaggccgaggcgggcggatcacctgaggtcgggagttcaagaccagcctggccaacatggagaaaccccgtctctattaaaaatacgaaaattagctgggcatggtggcaggcacctgtaatcccagctactcgggaagctgatacagaagaatctcttgaacctgggcggggaggttgcagtgagccaagatcgcaccattgcactccagcctgggtgacagagcgagattccgtctctaaataaataaataaatgtaacactacattaaaaaaaaaaaaactcagccttatgaaagtgatgttgctgaaaacataaccgtggaatccagtagcggccattagtgcagatgtgcgggtcactgcaggaagacagctggagagcgctgttgggtgtgtacagtggagaaagacacctcccaggagctactgccagccaagtggctgtcatcatctcacagcacacaaaacagatgcttactacacagagaactctttacatattaagtatttccttttctttttttttttttttttttttttgagacggagtctcactctgtcgcccaggctgaagtgcaatggcacgatcttggctcactgcaagcgcggcctcccgagttcacgccattctcctgcctcagcctcccaagtagctggaattacaggcgcctgccaccacacccagctaatttttatagttttagtcaagagagacgaggtttcaccatgttggccaggctggtctcgaactcctgacctcaagtgatccacccaccttggcctcccaaagtgctgggattacaggcgtgagccaccgtgccttgtcaagaaccctttacatattgagcattttcataaatatttaaacctggattcctgaacccttgggtcacatctgcagaccatgcagttggccattgcggaagatattaaaagcatattaaacacccactgcgtgcccgtggtcgggaggaaaaacagttgatgctacagcttagttttccaggaattcagtatccctgagtcaggcagccttatctgtcatcctagaactccaggacagccccaggtggtggtgggaggggccgcggctgggagatggagctgctctgagcctgcagatcagggtagcattcctgggaggcgccttccaggcggaggggaaattgctcatgtgttctgggaactgggagtgactgggtgtggcaggagtgtgaggcatggcaggaggtgagcctgaaaaagaggctgatccctcagagcaggacaggttttacccaaggctgcaggccagtgtctaaccgtctctagatccgtcctggtttagcttcttccaaatagttttgtgtctgtgtgagagtgtgtgtgaaacggagttttgctgtgttgcccaggttggtcttgaactcctgggctcaagcgactctcccaccttggcctcccaaagtgctgggattacaggcatgagcaacggtgccggctctaaatggttttaagggcacggtacctacctcaagctaacgtgcaggcaggcacgaggtagctggaattctagcctaggattctctcttcagcaattcttgccttaagacctcaccttagacgtttgctcattcacagatccctccccttctcagagggagctgtgttaccaagccttggcttgtacctccaaggcatgcagtggatgggctgagctccctgcagggagtcaggcgggtgtgtggggggcatgaaggtgagcaggacactgtcccttcctccctccctcccacggatgctcttcctggctggtagccatgtggacacctggggggaagctgttctgtgtggcagagtcactgtgttgtgtctggtactggggcccttgccagggtaggtcagtgactcgtccaggccctggaggctgctgctgtcccctcctcgtgcagaggaggtggggctggcagtcaaagcccaggctccctccctccctctagactcagaacagcccaggaacccagctcgaggtctggaggaagtgatgtgtgcattgggtcttgcagcatagataggttttgagtggacggagaggttagcgaagggtgttccaagtaagcaaagcacggaactaggaagtcactggctgcagcagggaagtcacacaaagggacaacctaccacagactgggtgagctgcagagggaggatggactaaactccaacttcagggtcattctggttgtttttttttaagacagggtctcacttggtcatccaggctggagtgcagtggctcaatcatagctcactccagccttgaacccctgggcccaagcgatcctcccacctcagcctccgaggagctgggactacaggcgtgtaccaccgtgcctgtctaatttgtatttttttgtagagatagggtctcactatgctgcccaagctggtcttgaattcctaggctcaagccctcctcccacctcagtttcccaaagtgctgggattacaggtgcatgccaccatgcccagctaatttttatttttggtagagatagggtctcactctgctgcccaggctggtcttgaactcctgcctccatttcctaaattgttgggattacaggcctgagccactgcgcccagccttgaggcccattcttgtctgcggagcggaggggactttatcatttagaaaaggatcttttaagtcatctcttttaagaaacctcatggtccatttgcatactgaattcattaaactcatcggcctgaccgtgttcctcaggactgggctggaatttccctgtgttagtggaagagggcacggggagaggactgagagtcttggtccctgtgatacagctctgatgagtggaggaacactggggtttttggtttttatgccggtttagataaaatgacatggatacacgtggagtggttttttttttgttttgttctgagatggagtctcgctctgtcgccaggctggagtgcagtggcgtgatctcggctcactgcaacctccgcctcctgggttcaagcaattctcctgtctcagcctcctgagtagctggcattacaggcgcctgccaccatgcccagctaatttttgtatttttagtagagacagggtttcaccatgttgaccaggctggtctgcatctcctgaccttgtgatccacctgccttggcctcccaaagtgctgggattacatgtgtcagccaccacgcccggctcagtggagtggttttaaaaccccgatgtccacggggctggttccttctgctggctgtaggggagaatctactgtgtccctgtcccagcttctggtggtttcctggtcatcttcttctttgtagatcatcagcccagtctctccttcatcgctctgtgacatcctacctgtctacatgtctgtttctgtgtccaggtttctcctccttattggatccaactggacgagggcccaggctaatgaccttgccttaccttgatcacctgcagagaccctagctccaaataaggtcaccttcacaggtattgggggtcaggacttcatcatctttcaagagacacaattcaacccattatagccccgaagtgtgccgtgcaaattaccaaaccccacatcctggggaataacccaaacaggagacaggaggacagagttcaggatccttccagatcccagcccttgcctccaggagacgcagccacccggtaccctgagtcggaatacctcggaagtgaggggccctccctaggcagatcctaagccagaaagagaagcctctgtgtggccatcaagcggtacggacagcagccagggcgtctgcccagcttcctggacagactctgctacccacctgcctctcttagaagagccccaggttgcgttccaattcatctggagaagcaactccaaatccgttgcttactctagacatctataatatgtgggcttaggtacagttgaaacagtgccatttagacagttcccaaaatttgtaatagatactgagaaagatacatgatacgacagggaaagaaaacacaacacactatcttacgtataggctgatttcaagtacgtacatacacacacgcgttttaagcagcttgattgagatataattcacataccatataattcacccatttaaagtctggagttcattgacttttaggatattcacaaagttgcacagctgtcaccacagacaattgtaaaatgttttcatcaccccaaaaggaaatcccacacccttcagttggcatccaccagcccctccttcccacccacccccagtctgagaccactcttaatgtataatacatctgtctcttgtttgcctgtgtgtctgcatttcatgtaacttttttttttttttttttttttgagacggagtcttgctctgttgccaggctggagtacagtggtgtgatctcagctcactgcatcctccacctccggagtacaaatgaagcaattctcctgcctcagcctcctgagtagctgagattacaggtgcacgccaccatgcccggctaatttttatatttttagtagagatggggtttcatcatcttgaccaggctggtcttaaactcttgacctcatgatctgcccacctcggcctcccaaagtgctgggattacaggtgtgagccaccgcacctgaccacaactctattttttttttatataattaggaaaaaaaaatagaaataaagacctgatagtctgactcctgccggtgagtggaggatttcaattatacttttaaattttttttctatatttttgatatttttctgatcacacaatgagcatgagttgctaataatgggggagggggttattttaaaaacaaggcatggtcttgtcatattaatagtccttgtaggcaaggcatggtggctcatgcctgtaatctcgcctgacccctgaggtcaggagttcaagaccagcctggccaacatgacgaaaccccgtctccactaaaaatacaaaaaaaaattagctgggcatggtagcacactcctgtagtctcagctacttgggaagctgaggcaggagaattgtttgaacccgggaggtggaggctgcagtgagctgagactgcgccactgcactccagcctgggcaacagagcgagcctccatctcaaaaaaaagtccttgcatattgttctgagattctactcaacaccaaattcacaaccttgttttttgttgttgttgttgttgtttaatttgagacatggtctcgctgtgttgcccaggctggagtgcagttgtacgaacacagctcactgcagcctcgaactgctaggctcaggcagtcctcccacctcagcctcccaagtagctggtattacaggtgcattgccaccccgcccagctaatttttttgttttttgtaaaatttttatttttaaattttaatttgtagatagctcattattttgcccaggctggtcttgaactcccgggctcaagccatcctcctgtctctggctcccaaagtgctatgattacaggcgtgagccaccacacctggcccagaatcacagccttatcttatcgggttgagggggtggaaatgtgtctgagttccaaacaattgacttcaaattggaatcttggtgcacagcttgttagaagttggaaatgcttgcattgcgctaggctgctatgtgttcgattttctaggcccagctcccactagccatcgtcccccagttctgagcgccccacatccttaatcaggagacctctctcagcccttaacaaactgcccggtggctcaggtgagaggccctgtaattaaaccgcatcctttgcctctgtaataacatcggagacagcatagttctaggaggggacagacggaatatataatttcctgtcctttgcctgagccagtatgacattggtacatgtgcagtcttgcgtgtttcggctgtaaagtgcgatctgttgtctcagcaagtgtgtaggtaagctaaatattctaacaagtcagtccaaccatggcaggctctttgcatatgcgtccagcatagttgatgaacagacgtctacactagaggaaactggctcagttagtcagttcacaaaaccaatcctggccaccatcgcaaaaccttgccagttgcctaatctggaatccccgggaccgtcctcaattcacctggttcttctgggcctcacgtcaactgtgtgtgtcgctgatctctccagccgccctctcctcctcctcgacacccacaaccactgcccagcgcatctcactcggatgaaagcagtgacgtccgagggttctcttcctccctgccccctcctgtgctctttccaccctgaccgctgctcaggtgatgagggtctccctgcaccatgcacccttgtgcccctcaaaatctcaccccacttgattgtccagctgcgtcacccacagctcctgcatatgtatccgcgttcccacctggcagactctcgtgggtcccctatgccccatggtgtgttgtagccgtgttggtggactcttaatctggactccaggaatagagcacaagctgacatgcaaatgagtgtcttaaaacagaacacataggccagacgcagtggctcacgcctgtaatccccgcactttgggaggctgaggcgggcagatcacctgaggtcaggagtttgagaccagcctggccaacatgataaaacctcgtctctactaaaaatacaaaaattagtctggcatggtggtaggcacctgtaattccagctacttgggaggctgagggcaagaatcgcttgaacctgggaggcagaggttgcagtgagctgagatcgtgctactgcactccagtctgggcgacagagcaagactctgtctcaaaaaaaggagaattttatgaaattctttgctcctgggatttgaatgtgttcgtccgtttacatgcagcatcttacccgtccacctgggtgaaatgctttttaagactctgctctaaggtcacaactttactgcctgaagttcccttctgcatgtccccagggatttaattacttgttaattacatacctgtttccctcctagaccctgagcttctgggggtaggaactgtctcttcccacccacctctgatccccagcagtgtctagcacatggccagctcttaagtcagcatttggagaagacaaaagaccaggaagggcacgccagaccattctctatggaagacccacccagtgttccctgctgtatagtgaatggctccatactcccaaatctctgctcctcccttgtttaccttcatgaacagggtccttttgtgtttgcaggcatttcctctaagaggctgaagcccagttgtcaagcatctcccttgctacgggaattcactagatgtgtaatgctttgtaaattacctcttgacaaatgttgagctctttgtttttcttttctttctttccttccctttcagattgatgcactgagtaaaagaagcaaggaagctgaagcagctttcttgaatgtctacaaaagattgattgacgtcccaggtaagccccggcagtaatggcccaccagtggggggcgttgtgtctggtgagtcggtgggtttttggctcattcttcttggctttcctaaggaaaataaatacaccatcagtggcaacttccccccaagaaaccagggagtgcaggacacatgaattcttcacaacccagactttgggtacggagggaaattggatgcacttgttgaagtactcacgtaatctctaggggatgacttcgtaaaagcagagatccaaatctctggggctacagcataaaaccctgcacgtactgcagagaagatgcagacctgatgtgtgtatgctgtgtggaagtccctcatattgcccaaagccacctttaagactttaggaatggccctactaagacacctggagtgtcccgctcccctgccaggtcatccaagatcagtggcccctggacaagcccttcacttaagggttatgggcagagggtaactgataatccttgcagctacaaccaagtatatcagttgtttcttttattttttttttctaattttatttatttatttttgagacagggtctcgctctgtcgcccaggctggagtgcagtggcacaatctccgctcactgcaacctgcacctcccgggctcaagcgatcctcccacctcaacctcccaagtggctgggaggtacgtgccaccacattcagctaatttttgtattttttgtacaatgagtgcgatgaggtctcactttattgcccaggctggtctcgaactcctgggctcaagctatcctcccacctcagcctcctaaagtgctgtgaggttacatgcaggagccaccacgcctggccctgtttcttcttttagagggattgaagaattaaaatttaaatatgtttgtgaggcattctaagaggtgatggcttccgattctttattctggaaaagtgagaaggcaggtagagtgccttgaactctctggtcctgtttgtgggtcctcgattgccttagaatctggagtaaggtgatggacataactatgtggggcccagctcagccctggagagatgctgatcagaaaattaggaaagtcacttgatgcctttttctgccaagcaaagaattggaattaccaccaccctcccctccccacccattacagttgtgcccttgcccttgttagcaattctctgaatatcattgacatcattagagctacattaacagagcgaggcagactcaggtctcctttgtacctgtacttgtgttctgattcaggtctaccacgggctttgctgtcccctcttggagctgggattaatagaggtcacaccaaacacgggatggcagaaagcacttcggacagggaatgaggagacccagattctccttccctggatgacattccttttcctctctggacttcagtgttctcatctgtaaaatggaacagggtcagggaacagcctaatcgtagagaatggtttgctttgttctaaacttttgctgtcttaggagcttatctagttattggttccaaattctagccttttggttttctgtgagagtttgtatctgactaggagttccctgaagaacctgactgagcttcacgaggaggctccttcacagtaaaatggatcagagtgttaccactggagggtgtccaggttcttggcgttttgagcaatgaattggacaaaatgcacaaagcaaggaaagaatgaagcaacaaaagcagatatttactgaaaatgaaagtacactccacagggtgagagtgggctgagcagccgctcaagggcccagatacagattcttctcgggtctaaatatccccttgaggtttcccattggcaattggtgttcaccccatgtaaatgaagtggtggccctcattcagtctgatcagttgcagaaagcaaccaaccagaggctgaagtgaagttataaaggtcacactcctatgcaaacatcttgattggttgcggaaagtaaccaatcagaggctaaattgaagttacaaagttgtacttctatgcgaacgaagacttggccctgcaatcagtctggttggttgcaaccaatcagaggctgaagttacaaagttacgcttctctgcaaacatctgattggttgcagaaagcaactaatcaaaggtactttcaatttcccatctgcagggcagaaaaggtggaggtttgcaaaggaagtagacgctggtccttttgttacttaggcgtggcaagtgggggtttttccttcgatttagttctaggaagtcagggtgaatcagcctttggttccctgcctgcagaccctattttcctgcctcaagagcactgtccctcgggcatcagcagcctggcgggcatcactggcattttcttgtgcataaggtagtgactgagaattttctctctggactatgtcatgtccatactgacgcagggataaagaatttacagaaaaagcatgacctgggctttgagaaattttattttgtgtttcgaaagagttcattctttgactttttgttggttcctcaggctcaggaaggttctgctccattctattccaagaagttcttgctaccacttctgggagcaggatcccagaaggggagtgttttccagctgagaactttgtccagttggtgatttagtcggaagaagactggcttacttcatctttgccagagacccaaagactgtttagctgctgttttctaaataatatgtaatctcttttctttcttttttttttttttttttttttttctgagacagagtcgcactctgtcaaagaggctggagtgcagtgacgtgatcttggctcactgcaaccttcgcctcccaggttcaagcaattctcctgcctcagcctcccacatagctgtgattacaggcacccatcacgacacccagctaatttttgtactttagtagagacggggtttcgccatgttggccaggctggtctcaaactcctgacctcaggtgatccgcctgcctcagcctcccaaagcgctaggattacaggcgtgagccaccatgcccagcctagctgctgttttctaaataacctataatctcttttcaaaaagtcaaatttgtacctcaatttttccctagtgaaattttccaactgggcagtcactttaaaacattgctaggtttctttctctgcagttacgttctgtgttaatttcccatagaaaaaagaccgtttttctcatcaacgtttcctctttacctgagccaaccttgtccatgtacatgtacaaattttatagaattttgatcatagcatgggtatatattcatattctgcctttctcacttaatattatgattcttattattaccataagcattttcctatattggtaatattcttcacaatttttatttctggccagagaattgaagtttgcagtttaaattgatggatggtgggagcaaagaatgtttgatgttttctgtaatactaaaagtcaatcagaatacatctacattccacatagatccctttcacccaccgcttcccaggtatttcttacaaatgctgtgatctgccacatctaacaagttacttgcaaagcaggaatggtgctcggagcactctccctgtgttttgaagtctgattattgctcagatgcaatcattctgtggctgaggcttacaggaagggcccggtcaatagtgatgatgcatttactgacagtcactcagtcgaggggagtcggggtgccttaactgtctgcatacttcaggccttaatccagtggaatccagaaacattagtagggtgcagtaagttctgctagttgcaagagacagcaactcacactgtcacaggaaaagggaggaagcccttgggaataatgcaacaggcattccagctatatgccacacagccctgctcctggatcacagggagagccgccaagctggccccaggaacagcggagccagagtctcacccagcccaggagtgacaggcacctgaccgcaccagctcccacctgcttccccttcctgaagttttatttatttgtgcatttccttgttgcttatctctgggtctcattagagtgacagctccatgaggatagggctttgcattgtggctctctgcccagtgcctggcacacaacaggtgggacatagtgaatgactgaaggagtcaatggacccaaattcccgccactcccactgagtcctcagcagcggagttcaccaagggttgcactggtgactctcagagctttgtccctggtccaggtctcactcctgagtgccagcttgcatatctgactgccgcctggactttcccactgggatggctggtgggcacccacctgatgtgtccggcagaagccgtcttcttactgcctgccttcttttggcgggtagcatcacctcccaccttactgctcatgttctgagctttttgtttttcttgagatggggtcttgctctatcacctgggctcaagtgcaatggtgtgatctccgcacactgcaacctctgccttctgggttcaagcgattctcgtgcctcagcctcccaagtagctgggattacaggcgtgcgccaccacacctggctaatttttgtatttttagtagagatgagttttcaccatgttggccgggctggtctcgaactcctgacctcagatgatccgcccccctcagcctccaaaagtgctgggattacaggcgtgagcaccatgcctggcctgtgttctgagcattttgtcaccaactctggccatccaacctctaggatgtctcaattccagccacttgccttcacccaaactcctgccctacagtctgcagttcacggtggcatgagtctaagtgcttacagggcggccagactcttcctggctaatcgccaccgacccctctggattaacctgttgagacgccacttcctgacagagaggtcttcctggcctccccagctggtttaggggacccttcccatgcacacacacaccctggccggggaccctgccattcacttcatcataattccttggtaactgtttggccgagagactggttcagtgcggttttgtccctatttcctttatatccaccccagtgcctgccatgtggcagaaactccataaatattgctaaatgaatgcagaaattaatgaatcaaattatttcttcaaaatgctgagtgtttttttggtctcaggctcctactgttcccactgaaccaccctcccgaggttgaagcttcccagtgagggcgagcactgcagagcactaagacaagtcaattgcaggagaacagaatgtatcttttattgagttgtagcagtttaatagctgtctgaactctcattttactttgttgtcattctataaagatttacatgcctgcatggacatttatacagcacttagcattcggagttgcccaaaccagcacatgtgcatctgaggacttcggctctggggccggcccttggtgtctgggatctgtgtttggtttaccagacgtcccgccggcgccccaagcccagcacacagggtaggatctccctccaccccagcttatcccccaccatccccacccgccccacttctcccttggtgttctggctcctccctcttcttcatcttccaccttctataatttccttcacattaaagacacaaaggccaggcatggtggttcacgcctgtaaccccagcactttgggaggccgaagcaggcagatcacctgagatcacgactttgcaactagcctggccacatggtgaaacctcgtctctactaaaaaaatacaagacattaggtgggcgtggtggtgggcacctgtaatcccagctacttgggaggctgtggcaggacagtcggttgaacccaagaggtggaggttgcagtgagccgagattgtactactgcactccagcctgggtgacagagcaagactgtctaaaaaataaataaaattaaaaaaaaaagacaccaaataagcatttagcaatacagtagcattgaaccctcatggtcctcatgtacctctgagtaggtttggtagttcataccttggtgtttgttcttttcatttgccaccagatcgcttcttatttcttagtcagtttcgcgagtactatcagacttgtcttcctgggtattactcgggtcaatgcctgagaccccagcacccctcatgccccacaccacacccccagggcatcaagaaccaggctgagccccagggatacaacagccagctcagttcctgccctcagactatagaggctggtgggaatatgggcattaaaaagtaattgcgaccgggtgcagtggctcacacctgtaatcccagcactttgggaggctgaggtagctgaattacctgaattacttgagcccaggggttgaagaccagcctgggcaacacggtaaaaccccgtctctacaaaagatacaaaagttagctgggcatggtggcgttcgcctgtagtcccagctgctcaggaggctgcggtgggtggatcacctgagcccaggagatcaaggctgcagtgagccaagatcacgccactgcacttcagcctgggtgacagagtgggaccctgtcaaattaaaaaaaaaaaaaaattagaaaaaagaagaagaaaaagtaattgcacaaataactgaattttaggtgcgataagcaaagcccactgggcaatgagagtatagaataaggtgaatcaagcaggacagaggcagctgccctcaggtggcaccaactggggccaggagaagaagccacaggaagcagttttctgaccagagaaagcagcagcagggaggagctgggacaggaaggagaccagcaggtggggagaatgtcgggtcaatggggcttagtgagcagaagaggaaaaggacccagcagcagccaagccctgcagcagccagacggagacactgaagtagtcagaggggctgtgaataatgactctggggatcgggcgcagtggcttactcctataatcactgtactttgggaggctgaggcaggagaggtatttgaggccaggagttcgagaccagcctgggcaacatagcaaaaccccccatctctttaaaaaaaaaaaaaaaaaaaaagatgaacaagtaaaatatgcagcctctgtctctagttcaagaccagcctggcaacatagcaagaccctcccatctctttaagaaaaaaataaacaagtaaaataggcagcttctgtcccttactgtaatgaaatgagaaatgtctctgctcttaaaatgtaatgtgaccctctcaggtagctgggaatattctggaatgaccgcttctaacaggctcttgcatagctggaattttactgagttctaagcaaaattatgacagtatgcataattcgtcagtaattaaccttgtgtgggtgacttgctcttgcttcttgatacttttcatttttttttttttttacaatgagtatgtatttatttctacaatggtggagaacataaattagtaaaatattcaacttgcaatcttagtttctgaataggccttattaatgtattgcagataagaacttagtcaactagttgtagggtaaaacacaagtgtgacttctctgttccagaaacatcttagtaatgtttttgggggtttttgtttgttttttattttttagcagcggggtctctgttgcccaacctggagtgcactggtaccatcatagctcatttaaccgcctcctggctcaagtgatccccctgcctcagcctcctgagtagcaggaactacaggcacacgccaccacacctggctaatttttaaattttttgtagagatggggtcttgccatgttgccaaggctggtctcaaactcctaggctcaagcaatcctcccgcctcggcctcccaaagtgctgagattacaggcgtgagccaccacacccagcctagtaatggtgtattttaaagagttcctaggtagaagaaaaagactaggcactccagaacttctgtgctttggttgcaaagttcactggaagcatctctttgcaagttgtccttgcctctgtctgtgacctgctatcagaaccgtattttactgcttgctgagatgcagtttagttcctacagacacaaacccttcaaatataaaggcagtgcctggaagggtttattttaagatttaaatcttaggaagcacattaccagtgatataaaatattcattgactcatgaaacactgctagaagtcgctgtttcgtgactgactcgtctccctttatttccataggttaactggtctgcctttgtgaaaagtagatgtaggtttttcggaagtcctaaaagagagctggctggaaagagtgcatttgtaggccattccattttcagagcctgctcccaaatgcctgtgctctgaggtcctccccctgggagaggtttcattttggatgtaggaaaaccatctctcctggtgactatccttgtcggcctagcatctgagaatctagaaataaaatggaatgtcatcatttttgagaactgctttttaatgctcctccaggagaataaaatagcagtctggttcttggtgcctgctactttcaagtgaggacacattacaggttaaaattagaaaacactgttcttttatacttctttctccactgcctgcccctcactcaaagatcccacattaagactcctggaaaaaaagttgaagaaatcagcctggcgtggtgactcacgcctataatgccagcactttgggaggccgaggcaggcggatcacctgaggtcaggagttcaagaccagtgtgacaaacatggtgaaaccccgtctctactaaaaatagaaaaattggccgagcatggtggcgtgcacctataatctcagctactcgggatgctgagtcacgagaatcgcttgaacctgggaggcggaggtggcagtgagcctagatcatgccactgcactttagcctgggcaacagagtgagactctgtctcaaaaaaaaaaaaatgacaaaatcttatgatttcgttagaaatagcccctggttttcatgccaagaagttcatcaatgtgccacttggtagccttctcgaaggtgatagaaatgtggccattgcagcctgattctgtacggtgactccagtccacgtattccaggtctccaggtgttggcaaacaagacctgggacccagggcccctccggagagctccctgtaacttcagtagcaggagacatgcgggatccctttacaaatcctcagtttgccttcataaaacattttcattcatgtgattaagaagtaatcacaggccccaaacaaaacaggacagaaagaggaactgggtctggaagaataaagccctgtgggtggcggataatgtgctgactcctgtccaggatacaggtccctggccctaagctggtcctgaaacagcctcgggggacgaggctgtatgctctgtcccagttacactcaggctccggcattagggaaattggaaaccaggcatggaagcagcgtccctaccttcctcggccaggttcataaacctggggctcaatccgcctctccatgtaggacactgtatgtttgcaggctgaggaattggccaccactgttctaaagacaagcaggcatgacaagatgggcgttaggcctgttgccgccaggttttgccggctgccgtccttcccaaggctttcccttctccatccatcctcccccggtccctcgacacagcactagagtgagaacaccctggatgtgacttggggactcctcctcggtgtgcttgcgtggagagtggagaggtgcgtcgtttgtgccccgctttgccatgaccggggtggtcctggcacgccgggtatctagacagcttttcatcagtcgctcatcagcatgctaattgccgtatgactaattatgccctgaattccagttgattttcttaatgagacagctgggttaattatgtaatcgtatgattacattagcctagagtgccctggcgaaaagtagcgtctgccgcattgtgatgtcatcgcggggacggtgctcacaagggggacattcatcctcaggctggtggcaggggacagcccccatcgcccgcagagcgcactgtgcaaacatgagcctcatgtctattaagattggctttttcagccctcacaacctacaagaaaagcagttcaccaccagcagtctcctcgccaccctgcgccctctccacgcccccagccgaatccaaaagccgcctgcaggcctctgcagctcttctgagatccagccatgtgtcctttcttctcacaggacctctctgcaccgaggctgttgggctttatcagggcacaccagcacttccttcagagtgatccgaagaactcaaagcaaaatgtttgcattaaagtcccagagcgacttagttgacgataacatataaacaagccctagactggccccgaccttagatcccactgcgcacgccagatatgctgtttcattccttctttctgcccaatctctaacacacatcatatttactaggaaaatacatgaccgataccttctggtttctggccacttcgctactccccatcacagcagaactcccctgggaggtgactgcctgctgaatcacttcttcacctatttacactcttcctccttagacttttgtggccttctcctcttcctctgccagggctctaaatgttggagtatgccaggacgttattcttagccttttccttttcatttgcattccctccctatctaaaactccacatgaccaaaagagaatgatcatttccccccacgtgctcccaagatagtcagtgacatcaccattcacgcaggtgctttggccactgatatggtttggctctgtgtccccacccaaatctcacctcaaattgtaatctccacatgtcgagggaggtgattggatcatgggggcagtttccccgtggctgttttcatgatagtgagtgagttctcacgagatccgatggttttataagtgtttggcagttccaccttcgctcatctctctcctgccactttgtgaagaaggtgcttgcttctccttcaccttccgccacaactgtttcctgaggcctccccagccatgtggaactgtgattccattaaacccctttgctttataaattacgcagtctcaggtatttcttttttgttttttttgagatggagtctcaccatcgcccaagctggagtgcagtggcataatcttggctcgctgcaacctcctcctcctgggttcaagcgattctcctccctcagcctccctgggattacaggcgcctgccaccatgcccaattaatttttgtatttctagtagagacagagtttcaccgtgttggccaagctgatctcgatctcctgacctcgggtgatgcgtccgcctccgcctcccaaagtgttgggattagaggcatgagccaccatgcctggcccaggtatttctttatagcagtgtgaaaatggactcatacagccataatgcacaactcagcctgggttcccttctttctttcacacccaatagccaggctgtcagtaagtcctagtgagccagcagcctccagaatgtatcccagattcgcccacttacccttcagccactgtcacctagtccaagccaccagtctctgtcacctcactgcactcacacctccacctaacgtcctttgcacagcaggcagacgggtctacgtcagtggtctccaaactacttttgcttatgcaccccaagagtaaaaaagtttgaattgggccaggcacggtggctcacgcctgtaatcccaccactttgggaggctgagggcaggcggatcacctgaggtcaggagttcgagaccagcctggccaacatggtgaaaccccgtctctactaaaaatacaaaaattagctggtgtaatggcaggcgcctgtaatcccagctactcaggaggctgacgcaggagaattacttgaacccaggaggtacagtgagccaagatcgcgccactgcactccagcctgggcaacagagcgagactgtctaaaaataaatacatacataaacacatacaatgaaatgcgctcatttcaagtgtgcagtgtgatagcgtggccaccttcacagtcaagatgtagaacatttctatcacctcaaaagttcccttctgatcccagtacccagcaactgctgttctgctctttgtcacttctggagttgtatagaagtggaatcatttggtctgtggtcctacatctggcctctttcactcagcgcggtgttttgggattcatctaagttactggtgtcattagtcctttcctttttattgatgaatgatattccactgtgtggatatataccaatttgtttatccaacagttatgttgacagacatttggttggttgtgggtattatgaatcagtctataaacattcatggagaagttgttacataggtatatgtttttatttcccttaggcaaatacttaggatgagggtcagggaacctgtacattttacctgataagaaatgccaagctgcttttcaatgtagatgtatctttttttattaatttttttcattttcttttcctcaggatagcaaagttacagttgtattattttatcccctcataagaaattgagaggagttccagttgctccatgtcttctgtttcatcggttattttctaattttagacattcctagtgaatgcgtaatgtatttcacaacgattttagtttgcattttcctgatgattaatgatgcagaatattttttcatgtgcatttttgctttcatagatttttatttataaaggtttcaatcccttgcacatttgaattttggagacagggtcttgctctgttgcccaggctggagtgtagtgatatagtcatagctcactacagcctcagtcttccaggctcaagcgatcctcccacctcagtctctcgagtagctgggactacaggcatgtgccaccacacccgattaattttttgttttttctagacatgaggtctagctgtgttgcccagactggtctcaaactcctgggctcaagcagtcctcccaccttggcctcacgaagtgctgggattatgggcatgagccaccgtgcctggcttctgtatacgttttagattcagcttgtcagtttttacaaaggagttttctgtgattttgattaggattccactgtatttgtagatcaatttgaggaaaattgacaacactatttattcttccataatatatttatttagttcatctttaatttctctgagcagtattttacagttttgatgtataaacctggcacagattatgttcagtttatttctaagtttaagtcatgtttttgaatgttatattaaaggatattttcttttttaaaaaatctacaatgtttattttattattattatttttaatctcgcttcatcaccaaggctggagtaaagtgacgcgatctcagctcagtgcaaccaccgcctcccagattcaagcaattctcctgtctcagcctcccaaatagctgggactacaggtgcctgccaccacacccagctaatttttgtatttttagtagagacagagtttcaccatgttggccaggctggtcccaaactcctgacttcaagtgatctgcccacctcagcctcccaaagtgctaggattacaggtgcgagattaaagtttattttcttttgaaatttgttttccaattgtttgttgcttttatacagaaatataatgaatttcatatattatataatttttacattttaacaaataataaaatatataaatatatattttatattatgtaatgtttatataataataatataggtgacctcttaatgctcacctattagctctagaaatttttttgaagttttcttgaattgtccatatgcccttgaagacaatatatacttttttcttttttttttttttgagacagagtctcgctctgtcaccctggctggagtgcagtggcacaatcttggctcagtgcaacctccgccttctgggtttaagcaattccctgcctcagcctcccaagtagctgggattacaggtgcccgccaccacgcctggctaatttttttggatttttagtggagacggggtttcagcatcttggccaggctggtcttgaactcctgacctcgtgatctacccgccttggcctcccaaagtactgggattacaggtgtgagccaacgcacccggccacaatatatactttattgatgttggatggaatgttctgtaaacatcagttaggtcaagttggttgatagtgttgttcatgtttcctgtatccatcctgatttctgatctataatgctgtatatttattttccttgcttttttttttttttttttttttttggcacttgctacctgtataaaatgttgactagaagtagagaaagcagacatccttgccttggacccaacattagggaaaagcattcagactttgataattaagtataatatcaactgtagatttttttgtagttgccgtttataagatggaaattctctcctattcctagcttgcggagaatttttgtcataaatggtattgaattttctcatattgttttcggcatctttcgagatgatcatatgattttcctcctttattctcttaacatggtaaaataatttgattctcaaatgttaaacaaatcttgcattcctaggataaatcttacttagccatgcattttatgcataatatgcattttataatatattttgtgcattttaaaatttgctggattcaatttgctactgttttactgaggacttttgccgttaaatttatgaggaacgatatggtttggctgtgttcccatgctatctcatcttgaattgtagttcccataaaacccacatgtcgtgggagggaccagtgggaggtaattgaatcatgggggtggttatccccatgctgttcttgggatagtgagtgagttctcacaagatctgatggttttataaggagcttttcccgctttgcttgtcactccttcctgctgccatgtgaggaaggacatgtttgcttccccttctgccatgactgtaagtttcctgaggtctcctcagccacgctcaactgtgagtcaagtaaacctctttcctttacaaattacccagtctagggtatgtctttattagcagtatgagagcagactaatacagaaatatacaactatagttttctggtttttttcctttgaatatccatatagggttttcactttaaggttgcactggtcttgtaaaataagttagaaagtgctccccctttcctctatttgctgaaagagtttgtataagattgcagttattttttcgtaaaattcaattcatcagtgttgccatccaggcctggaattttctttatggcaagtttttaaattacaaattaacttctttaacagatgcaaggctattaagttttttaaatttcttcttgagtcagttttggtaatttggaatttttaaaggaatgatccatttcatctaaattatcaaatttgttggcataatattgtacataatattttattaacttttaaatatctgtaggatgtgtagtgatgtcctttcttatacttcctgacattagaatttgtgaatcctccccccgggcttttttccttgattagtctggctagaggcttatcaattttaaagttatttaaaaatagaaccagcttttgtttgcattgatttttctcttttttttttttttccttgttttcagttttgttgctttctgttcttattagctactttctacttactttgggtttaatttgctcttctttatgagttttactaagtgggcattgttttatttcattgtggtcagagtacatgtttgtatgatttctgttcttttgaatttatcaaaagttgttttctcatcctgtacatcgatgaatgttccatgtgtacttaaagagaatgtgtattctgtagttgtttgaatggcatgttctagaaaagtgagctctgtttagttagtggtgttcttcaagtctcttatatccatattgactatataaaaatcataatattaattaatgtgaatggcttttttcgttgtttttttttttgagacagagtctcgctctgtcgcccagagttgagtgcagtgacacgactttggctcactgcaacctctgcctcccgggtttatgcaattctcctgaatgtggatggcgttttgaaatctaattattattttggatttttcttttttctttcagttctgtcagtttttgatttgcatagtttaaagctttgttttggggcaaatatacctttaagattattatatcgtctctcaattgtttgattcttttaagtttatacaatgaccttcattattcctggaaatattccatatcgtaaagtattctttttctgattttaatataagcactctggctttcttttgatgagagtttttatgttatatatttttctatacttttactattaacctgtctgtatctttatgtttaagttatgtaaatacctacatcttgcttttttatccatcctatctgcctcttaactggaatgttagatcatttacatttaatgcaattatggataaagttggattgaagtctaccatcttactttttctatttgtcttgcctgttttttcttgtatttttcctgcttttgattaactgatttttttaatgtttttatctccccaattatcttattagctataactcttattttcttaagggttactttaaagtgaaaagtaagccagccatgatggctcacacctgtaatcccagcactttgggaggccaaggcaggcagatcacctgaggtcagcagttttagaccagcctgaccaacatggagaaaccctatctctactaaaaatacaaaattagctgggcgtggtggcacatgcctgtaatcctagctactcaggaggctgaggcaggaaaatctctcgaacccgggagacaaaggttgcggcgagctgagttcgtgccgttgcattccagcctgggcaacaagagcaaaactccatctcaaaaaaaaagtgaaaagtaaccatctttaacttatcattttataccttcaaataatacaccatttcacatacaatataagaatcttataatacattgtcactttctcactcttgttcttttgtgcatttttactgattttacttctacctatactacaacgctataatacatggttactattttttctttaaaccattaacttttaaagaaattaaaaatgaaattataatattttatttttactcatctatttaccatttccagtgttgtttattcccttgcgtggattcaagtatgcacgtgaaatcattttcttttggtctatagatctccttttaacatttattatgatataggcacactggcaatgaattctgttagctttcattcatctggggaaaaaataccttaatctcacccttttttttttttttaagacagagtcttgctctgtcacccaggctggagtgcagtggtgcaatcttggctcactgcaacctccatctcccaggttcaagtgattctgctgactcagcctccccagtaactgggattacaggtgtgtgccaccatgcctggctaatttttgtatttttagtagagacggggtttctccatgttggccaggctggtttcaaactcctgacctcaggtgatctgcctgccttggcttcccaaagtgctgggattacaagcgtgagccaccgcgtccagccaccttcatttttaaagagtattttttgtcagatataaaatagtttcttgggtctgccagtcatggtggcttatgcctgtaatcccaacactttgggaggctgaggcgggcagatcgcttgaggtctggagctggagaccagcctggccaatatggttaaagccctgtctctactagaaaaacaagaattagctgggtgtgatggtgcacacctgtaatcccagctactcgggaggctgaggcaggagattctcttgaatccagtaagcagaggttgcagtgagctgagatcgtgccgctgcactccagcctgggtgacagagcaagactctatctcaaaagagaaataaaataaataaaatgaaatagtttgttggtggtttgggttctggttttttctctctctggactgactgtttctgagacaggcgatctccagtaattcatatatatttttttaacctatatacaattaatctttttctcttcaccatttaagattttccttttctaattttgatttcagaaactctcttacgcttactggtgttctttgggtttatcctgcatggagtttgtagagtttcttgaatttttaggtttatagcttttatgaagtttggaacattttgccactgtttcttcaaatacaccctttccctctttctgggaaatgtatgtttggttgcttaattttgtttcataggttgccgagggtttactaactttttttttcaatctttctgtgtatttctgtttggtttgtttctgtgactatatctttaaattcactgatctttttctttcactgtgtctaatctattgttcagccaatcaagtgaattttttccatttcacatactttaagcttcagaattcgatttgattctttatgttttctgttcctctctgtattgtattcatatttttctttaaatccttggacatgctgataatagatgttctagtctgcttcttccattatctcttgtcatttctggttctgtttttatgaagtgatttttcccctgatcatcctgctgctttgcatgtctagtaatttcctattgaattttagacatcatgagctttaactggattttgttgtcttatttaagtttgggcaggcagttaagttacttgcaggtcagtttgatcatcctgagacttgtttgtagctttttggagtggatatgggcaagccttgaagatgagtttagccctccactcaggtgggacacttccagtgtctttactcttcaacaagtccttgctcttcaacaagtgtgtcctctctggctggttgcagttggaaagtcctccagccctcaaactgtgggaggttttcagctcagactttcctttctattcttgcctggccttaggagtttcaccctgtgcataggcactttagctcttggcaaaagatcgcctctctgcagatttctgtagctcttgtccctccttttcacactctgccttgcaaattccaattgctgcagccacccaatcttgtgatgtgtgtccttcaatggacagggagaccatcacactccgcttgggtttttttcttcattgtgatgcaatccagagagttcttcctgccaggaagggtaacatagagctcatctcatttgcttcccttccttcagggaagtcttgttccaccagttgtccagcgtctgtaaatagttgtttcattgactttgcctagttttctagttgtttatgaccagagcacaagttgagtatcagtagatctgtcatggccagaagcagagactccaagttctgttaattttgatttttggttttcatggaaatggctggaaaaaataacttacaaagataaatagattcaaaccaaagaaacacattattggctatctttacaaaaataggattcatatttatgaaatctaggtataggttgagtgtcttttatccaaaatgcttggaatcagagtgttttggatttgggatttttgaattagggatattcagcttgtactaattatgagaaggtatttgttgaaactcagctagtcaattttcattttccatgataccgtttttttttttgtttttttgttttgttttgttttttttgagatggagtctcgctctgtcacccaggctggagtgcagtggcgcaatctcagctcactgcaagctccacctcccaggttcatgccattctcctgcctcagcctcccgagtagctgggactacaggagcccgccaccacgcccagctaatatttctgtattttcagtagaaacaaggtttcactgtgttagccaggacggtctcgatctcctgacctcatgatccaccacctcagcctcccaaagtgctgggattacaggcgtgagccaccgcaccccgcctctttttttttttttttcctagcttttcagaagatcctgcatttcttatattaattaacaaacgatttgaaacttcttttggcaaatgtttactcagatttgagttggtaaataatagtagataacatttattgagtgttaactctgtgtatggcaattttcttaagttaatcctcacggcagcaccatgacatatgcacagttagtatgcccaatttatgcatgaagaaactaaggcacagaggggttaagtaacttgtccaagattgcacaaccaataaatgagagagctgagacttgaacacatgcagcctggctcatactgcagaccattacactacactccctcttgtgtgatataaggcattgaaccatttttgtaaaaggtgctgtctttgcccatcagtatatagatgatggaaacatttccaaatattcacttttagaatgctgtcactgtagcataaaatagttattttcctcaacaagcattaaagcaccacatttattgcaacaacttagagtatgtgtttattttttcaaaagtatctgtcaagcggcatgttactgatatgatagccatttaccatcacaaaacagggcaggtaatttggatcccttagcttgctttttttttcttttctttttttctctctgttttgaggacagggtctcgctctgttgctgaggctggagtacagtggcatgatcatagttcactgcagcctctaactcctggcctcaagcaatcctcccacctcagcctccctagtaactgggactacaggtgtgttcccaccatgcccagctaattttttatcttttatttgctgagacgaggtcttgctatgctgccccagctggtcttgaactgctggcctcaagtgatcctcccacctcagcctcccaaagcactgggattacaggcacgcaccaccccacccggccaggatcacttagcttttctaaagaaaattatatagctcatctttaagcttaaaactcttacatgcttttgccaagagaaaaccaacaaaccattgtgtgggttgaagtactacagttttggtttggtttggtttggtttgaaatggagtcttgctctatcacccaggctggagtgtagtggtgtgacctcggctcactgcaacctccacctcccaggctcaagcaattctcctgcctcagcctcccaaatagctgggactacaggtacgtgccactacacccagctaatttttgtatttttcctggggacagagtttcaccgtattggccaggctggtctcaaactcctgacctcaggtgatccacctgccttggcctcccaaagtgctgggattacaggcgtgcgccatgccgtccatctctggccacttcttgacaggaaaagaattgcatccaaaatctgaccattggctcatttcagacattgtactttcagctctagcatttagtttgcttctttttatatcttctttttctctcctccttgcactcctatttttcttaaaatccttgtgcacaggctccctctcccagatctcttttcccttcctgttctgcctctccttccctgggaccacactggcttctcactatgccttgaccatgccctgttcacagctaccacgggacctttcactgggcgctgcctctgactggggtgaatccttgcgctgcctggcattaccatccagatcttcatccccactcacttcttcagaggccttccctgtccccttgtctctaggacccatttccctcactccctgtgcctctcctctccatgctcagcagcgcaaacgctcctcactcacagtggggctgtgccccagtcaacccatcacaagtggaaaatatcataagtcaaaaatatattcaatacccctaacctaccaaacatcataagttgaaaatatcatgagtcaaaaatgcatttaggccgggtgtggtggctcatgcctgtaatcccagcgcttggggaggccaaggtgagcagattgcttgaggccgggggttgaagaccagcctgggcaatggggtgtgaatccctatctatactaaaaatacaaaattatcctggcatggtcgtgtgcgcctgcaatctcagatacttgggaggctgaggcaggagaattgcttgaacacgggaggcagaggatgtagtgagccaagatagcgccactgcactcccgtctgggtgacacagtgagactccgtctcaaaaaaaaaaaaaaaaaaaagaaagaaagaaaagaaaaaaagagctccttttcccggtttctccaggagcgctcttccactcatctggtctcctgccttgcgtttgtcatttacatgcatggcttatctctgctatgaggctgagcctttcccagagcagctagttggttccgttgcttaggaaatatttgttaaattagtactgaaagagattttctttggctgctggttaagaaaacagaagcttttttttttttttttctgagacagggtctcactctgtccctcaggctggagtgagaccctatctctttaaaaaaaaaaaaaaaaaaagaaagtcatagctctctgcaacctccacctcccaggctcaagcaatcctcctaccttagcctcccaaggagctgggactacaggcatgcaccaccatgcccggctaatttttgtattttttccagagacagggtctcacttatgttgtccaggctggcctcaaactcctgggctcaaacaatgttccctcctcggcctcccaaagtgctgagattacaggtgtgagccactgtgcctggccagtaagcagaaatcatactgagaatttttcaaagtcgtttgcctggcgggcttctttcctttttctttccctccctgggtgagatgcatccaccccatacattgcagagcgggctccgccagcctctgactgtaatggctggaattaacgagataatattgcgtgcacttaggaaaaggtgctgaatatgtacagtattgttgtttgtaataattatgttccttgagccctgtgttgcataacaagctatataatacctccaagattgctttaggaattaagtatcagatgattgtaaaacactttacaagattgtcgcattgggtgggcggagctggcaggaaagcgtgttgaatcggaggaggaggaggctgggaagacaggggttaccggattttgtgtgttcctgttttatatatgggtgtgtcctcttcgcctcctccagacaattccctaattgagctgctaagatcggaggcatctgacgttcgcataagacctgacaatccttgtgtggggtttaaatggcattggaaatcattaacaagacaaaaagctattatttccgtagattaacacacaggttgggttttggcacgccaaaattcattgttttggtctttagcccaaacatgctagagtcattatattgtcatgcagtaattagctgttcctttaatacaagtaataaaaattaagcctaagaagttctttagcaatgcctcttacatatcccaaaacaatattcaaatgctgtaggcatttagccattcaactgtgctgtagtaaagtttggagtttaatgcacagagatgtttgaacatttagctcatcctttagtctgtgaccagctttgctacataggcattaacctttaatagtgtcagactaaatatacatgccatgatgaatgattatgagattgcctgaattttcatttacagtataaggctctgaaaattggtgtaaaggtctggttcctcctcacttgataatgtgcgtgtcattttcatatgtcaccggattccttgcttaaccgcatgggagaagctattttttaattcgaagcagatacagtggggtcctggccttttgaaaagaatgaactggaaatgttgacagaacttttagggagggcaggcagtatactaggtgtgttctttaaagatataatttgctggcacttgtgctagaaagcctacgtgagcaactcttaatagaattttatacgtgatcaaaggttcctctctttacctcctcttccctgacctctatgtcaagtttaaatcgtggttctgtacaaaggaggctgtgaacgggctgttcactttcttgaaaccatttgcccagcacaaggtcgtgaaggtggggaagaggggcaggctgagaaggtgaaggtatccagagaagttatggaaattttttttacaaacagcacctggaatcttttcaggaattctgtttttttgtgttatcacgactcctgcttacaaagaaccatctccccaagatagcatttttttttttttccaagacaggatttcgctctgttgccccggctggagtgcagtggctcaatcacagctcaatgcaacctcgacctcaagggctcaaggacttctcatgccttaagccccccagtagctgggactacaggggtatgccaccatgcctggctagttttttggtttgtgtttttgttttgtagagacaggctttcaccatgttgcccaggctggtctcgaactcctgagctcaagcaatccggccaccctcggcctcccaaagtgctgggattacaggcatgagccactgcagccggcctccaaaatagcttttggagtcaaatttaacataaatattttgatgctgattaaaataataatgaaaagccatgcaccagaaagagatgcaattataggctgtgtatacgtgcagagtaagtgcccagcagccagggattctgcatgatggactgtgttgctgtgaaaccccagcacccgggatctgctgacgttgagcccaacatatcccagcgcctgccttttgtaaactctgcaaagacgctggcatcctaaagagtccctggctcctgctggatacgttaaccgaggcatggtagacctggccctcgattccaggaacctagggtggtctgaaaaattaatgactctggcatttgaaaattaagtgagctcttgaatatatactcttgttgatccgctgggcatggtgtttggcattcttcgactggagactaaatctctgcagccatctcacaagtgacactggcgcccataccagaaatatattcaataatctttctaagccctgtggacttgggtattcttccactctgacggagcctgagaattccaaaggaagtatgccccaggtacccagcaggcggaatataattgcctcttaggcagcagaaagaaaactaaagatcacattgatgcggaagaacatttaaggtctctctatcctgtgttgaattcacagtaaaggcgagagccgtgagtttgtactgtaaattccaggtctgtgacttctgactttggattaaaatccagttttctggaagtgaatctgatggcagatatgaccttgaattggctgcaagaccccagcgctggcctggctgccgtgcagcgcgcgctgctctgcacttagttatcatcaggagtgtggtggcctcctggccagctggtctacgacagggccatgccgggtcaccagctgtgcctctgcaggggtctccagccttgggacctgcggccgctaacccctgactcttctgaacacccttcattagtgaaggaggatcgtaatggaaagtggtcatgtcatgaaatggggtggctttataaagcctaagtgtttctttcctctgcttcacctctgcttcattctttaccttgttgtaaagaatggtcactcagggctgggtggggtggctcacgcctgtaatcctttgggaggctgaggcggtcagatcccttgagtccagtttgagactggcctaggcaacataggaagaccctatctttaccaaaaaatacaaaaattagcccagcgtgcttgtgcatgcctgtagtcccagctacttgggaggctgaggtgggaggattgcttgagcccaggaggtggaggctgcagtgagccatgatcatgccactgcactccagcctgggcgacagagtgagaccctgtcttaaacaaacaaacaaacaaaaaagcatgatcacttggagttaacagacttaggtgtgcattctccatgccaaccaactagctgggtgacctcaggtgagtcattctgcttccctgggctttagtttctgaggcctctttctcgagattgttgtaaggctcaaaagacacaatctccataaagtgtcccgtgaactgtgtggcgttctcaggcatcaggtgtcacttccagcctcataatcactggacccttaaacatcccggcacctgtccacggacttgtccgtcctccacgtgcagctccggggatgtgattgacctcctggggctgctacctggtgtatttctctacttatctgatcaaagaatgaaaatcatgaaagtgtcacaccaggcaggagtaatcggcaaataccagtgaatctcatggctattgccaccccattttcacacctcgaggaccccgggctgggtccatcctttgtaaagcactggagaattctcccacccagcaagggggctggctgcaggggcatgactgtggcctctggggagcccccggagctgatgtcccaggagccccactctgagcctgtgtaccgccgtggagggggcctgtttgctggccgagtggggtgatggctgttttcctgttgtgcagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaaggttggtggaaaatgcgttctttgctttttcttttcttcttttttttctcttctttttattttaattggcttttcccatacttttgagaccagctctccttgtaatatacacgtcataaagtcagggtggggcaggaatctgagtcgttaaagagagatgataatcatgctgagctatttcgaagtaaaacttttcctctgcacaacaacgacgtaagattttattgccctctgatgagaccgatcaggattctttgaaaattcttcccgtatcattacgtgattgggtctgcctcttgaaaggcccatgcattgcctccaggcgacacctgtcagagagccagctcatgatcaaagggtcacacacagtaagtcatttaataattgctgtggatacattaaggcttcagacacatcttaaaggctgcatgcttaagccccgctgttgccttgtcagtatcgcctattcattaggaatttaatgaaagaaaacaacctcttggtgtgtttgcccagccgtcaacaagacagagagggcaaaggttgcctggcttttcccgtcagggaagaacaaaggaatctctcctttacctaaaatccagaggcactcaggatccaggagcctgttggcttccttggcttgaaggaaaatcacagctcccgtctgacagcagcagcagcaggcttttcagccagctccaaagaataattcggccagtttgttttggtttgggaatgtgagtacggaattaaattgaaaggggaggctgcccattcctagtggccttccattgaccatttgtagagacttcaataaagagttaattggggccacgtgcggtggttcacacctgtaatcccagcgctttgagaggccaaggtgggaggactgcttgaggccagaagttcgagaccagcctcggaaacgtagcaatactctgtctctacagaacatcagaaattagctgggcatggtggtgcacacccgtggtcccagccactcaagaggctgaggcgggaggatcgcttgaacccaggaggtcaagcctgcagtgagccatgattgtgacactgcactcagtctgagtgacagagcaagatccagtctttaacaacaacagaaaaagttaattggcaaagacttcttttttttttttttgagatggagtctcgctctgtcgcccaggctggagtgcagtgcacgatctcggctcactgcaagctctgcctcccgggttcacgccattctcctgcctcagcctcccgaatagctgggactacaggagcccgccaccacgcccaactaattttttttttttttttttttttttttttttttaagtagagacgggatttcaccgtgttagccaggatggtctcgatctcctgacctcatgatccacccccctcagcctcccaaagtgctgggattacaggcgtgagccaccgcacccagccaattggcaaagactttctaaaagtgtcctttggctttaaaaacactgcagatagaccagggaagaagaattgtccatgggaatgatccagaaagcatctgtgatgatgtgtgaagagccagaggtagaggcatgggctgtgagggcggcggtgcctaagacctccgagcacacctccctgtagtgtgggcatgggggtactcaagccctcaggccagcatagcttccttgctgaaatttgggggcacgaggtgacaggcagctggggaagccagaccccgcttctttctggctttgcagagagtggtgagcctttaggactagaagggacaactctgtcctgctagagagcgaggcattgggcttactagggctggaactgctgtgagggaaggtattaccttcccttgtaggaagcatttcttgccagaatcacgccagtattgcagtaaaaggtaacctgcaaatctgcacattgagttttcatagatacgctaccctaaaggggagtatcctggttttttttttttttccccttcattgtcctctggtatctaattttgatagatccactctctggtttgtttggtgagtgttttttatttatttatttattttagattcagggtctcgccctgtcacccaggctggagtgcagttgcatgatcatagctcactgcaacaaccttgacctcctggactcaagtagtcctcccgcctcagcctcctgagtagctgggactacaggcatgtgtaccaccgtgcccagcctctttctggcttattttatttttttgagtttgcttttgttttgttggagggtggtgcaggtggggcctggtgggctgtgcaggattgtccttcccttctccttctatcactggtgcctaaattaccagcttcccagtggccagggctttgcacaggggctgaccaggagccaagctgggtgtggatgttctctccccaaagatctcatccacactcaggagtggcttttcacaatgagttatagagcccaagatttaagaacagctccaggccaggtgcagcgactcacgcctataatcccagcacttaaggaggccaaggtgggcagatcacttgaggtcatgagttcgagaccagcctggccaacatgacgaaaccccatctgtactaaaaatacaaaaattacaggcatggttgggcacgcctgtaatcccagctactcagaagactgaggtggaagaatgacttgaacctgggaggtggaggttgcagtgagctaagatcacaccactgtactccagtctgggcaacagagcgagactccatctctaaaaaagaatggctctggaggcagacagacagacctggtttgagtccttttattgctaccacctagctatgtgaccttgggcaaattatctcactttgctaaaagcctctttctcttgggaggcaattctgatacttaccaggtagggttggtgtgagcttaaatatgcatatacacacagcatttggcactcaatagtacctgctacttattcagcagtgtggtttttgaaagaaatttaccctcctttatttggataacaagttttcccaagctccagaaaaatgtcatttcctctcccccacttccaagaataaaagtgattataatttgggaaggtgggcggtgcacatcacttcttgtaattatcacaccagtagtgtaaatgattaaaaagttagagcaggggccagcacaatggctcatgcctataatcctagcactttgggagaccaagtcgggaggatctcttgaggccaggagttcgagaccagcctggacaacataacaagacctatctcttaaaaaaagaaaaaaaaaaagatggtgtgagtccattgtgtgttgctgtaaagaaataccttagtctgggtaattgatgaagaaaagaggtttatttgcctcatggttctgcaggctgtatgagcacgatgccagcctctgcccagcttctgagggtcctcaggaagcttttactcatggcagaaggtgaaagaggatcaggcatgccacaggacaagagaggagggggcatcccagacgtcttaaccaaatctcagtgactcatcaccagagagaggccaccaagccattcatgagggattcgcccccatgacccagacacctcccacttggccccacttccaacactggagatcagatttcaacctgagatttggaggagacaaacatctaaactatatcaggtacataataaaagttagagcaaagagggaacttctgcctcatgggccacagccccacccatcccgcaatgatgagtaaatggaggccccaggtaatgccaagccctttagattcctctctgttatgctggccccgtcctcccctacacatgcctgggaggcctgctgagacacccagcatctgcccgggatacagcctgggccagaaggccagaggcgctaggataaagtggcctctggctgaggttgggctggtccgtgagcactcacccgggtccagggggtggcaaagagacctcatcaggcacagcacactgtcgaggtcacacactgtgatgtgtcactgaggagccccactggagcaagcgttagcgtccaagtgctgtacagccacttccagccggtccttaaaggcaaaaatgaggccaggcatggtggctcatgcctgtaatcccagcactttaggaggccgaggtgagcagatcatttgaggtcaggagttcgagaccagcctcgccaacatggtgaaaccccgtctctacttaaaaaatacaagaattagccaggtgtgatggcacacgcctgtaatcccagctcttcgggagactgaggcacgagaattgtgtgaacctgggaggcagaggttgcagtgggccgagattgcgccactgcactccagcctgggtgacagagcgagtatctgtctcaataaaaaaaaaaaaaaagacaaaaatgctgtatgtttacacgagagtgtagaccattgacgtagcagagcagttcaggctttttcagagctgacctgtctggagtccattctggaagtgtccagctcttgcctcactttggcctcgtccgtatggcttgagagagacgtatcaccaaccactgtgtgcacagagcatttcttccaggacctgaacagccaaaccaaaaggcggaaagttgcccagtcccctctgctgtgccctgatgggatcgttggtggaattccacctctctacggaaagcactctgggacacacctcatgaaaaaggccaacctcttaacaaaagagcctttcacacaaaaattagccaggtgtggtgcgcgcctgtaatctcagctactcgggaggctgaggcaggagaattgcttgaacccaggaagcagaggttacagtgagccaagactgcaccactgcatgtcagtctgggccactgagcgagactccgcctcaaaaaaaaaaaaaaaaaaaaaaagcctttagcttgtatgcactaagccgcgtgggtgttaatcgcccaggtgttttgctcctgctctggccagcgcatgtccgtgcagctcagggagcaggaatggatgtgagttacacacctggcaggtgcccttgctgcaccagagggagctccattgccacaagccctgtctgggcttcccccagctctgcccggcctcggctccttcagtcattcatgccacagtgctttcctgagcacacgtctgtttgccagcactgggaacacaaagaaaatgagcctcgcctgctaagaggtagatctgtagcagcgggcgacaattcctaagagctcccctctcttgggggctggggccacagtgcttttccacaaagcatccagcatgcggagtggcataggcgtatctggaggagggcgcacgtggagttgtcctgccccagagccacccacacacaaagcatccagcatgcggagtggcataggcgtatctggaggagggcgcaggtgtagttgtcctgccccagagccacccacaggtctgttccattcatcaaatccgctttgatattccccatttgggcagttgaggtgatgtctgtgaacctgcagttggtggtaccagagccgtctggacctgcgctttcccaagacagccctgcctcccaaggggcccctcgctgccccacatccttggtgctcacacctcactctaggactcctccaggccacatgccagtcaccggagcatcttcccccaggctacggcaccctctgctctgcacacagcccatgaccaccagagtggtgggcactccagggtgggtcccttccagcccactccctccatgctttatccacctagcaccacatgtttcttgtcacttgtgaaccagcagagctgcagggccaggcctgcttgcttgcttccttccttccttttctgtctccctctctttcttttgctctccgtttctctctctctctctctcactcactcactcactcactcactcacactctgtcacccaggttggagtacagtggcgcaatcatagctcactgcagcttcaaactcctgggttcaagacatccttccacctcagcctcccaagtccctaagctgggactgcaggtgtgtgctaccacgtccagctaattcttgccctttttgtagaggcggggctcgctgtgtttctggggttggtgtcaaactgctgggctcaagggatcctctcacgttggcctcctaaagttctgggattacagatgtgagccactgtgcttggcctgtagactttcatctttttttttttttaatttatttgtaatttgtgtgggtacatagtaggtgtctatatttataggctacatgagacgttttgatacaggcatgcaatgtgaaacatcacatcatagagaatggggtaccgtagactttcttgactccacttcgattgcttcttccaaaatgcacacactattatgaactattttttttctgagaaagtacttaaacccacctaaaactttattaatcatccctcagttacaggactaatttaagactcatcaataagatgatatgatattttaccattgatttccatctccccccacccttttttttctttaactggtactacagaaaccaaagctcttcttttcagcaaaatccattgatcctcctcagcctaaacgtttaaagttcaatttaacatttagggagtaaaaggtctctgaagggactcataaccattgattttgtgtcagagttgaagagctaaggtttaaaacacaccgatcctaccaggttatgagagccttgtacctacagccatatggaattgtatgcttctcttactgtaggtttttttttttcttttctgcagaggttacgataaaagcacttaaagagaaaatccgagaatatgaacagacactgaagaaccaagccgaaaccatagctcttgagaaggaacagaagttacagaatgactttgcagaaaaggagaggtgagcatgacttccaggcacacacagactgacatagcatttgcccctgaacttcacatcatcagacatgttgataaatggatctgcaaaataagcccaggttgtaaccccaaatctataaggggtaaaatgtttcaaaaatgatattctggctgggtgtggtggctcacgcctgtaatctcagcactttgggaggccgaggtgggtggatcatgaggtcaggagttcgagaccagcatgaccaacatggtgaaaccccgtctctactaaaaaatacaaaaaaaaattagccaggcatggtggcgcacgtctgtaatcccagctacttaggctgaggcaggagactcacttgaacccgggaggcagaggttgcagtgagccgagatcgcgccactgcactccagcctgggcaacagagtgagactccatctccaaaaaaagatattctacatttgtgaggtttccttgagcgaaatgcatctgtctttcccaatcggtggatggtgtcaggcagccagtgggcccaagactatccaagccgtgcaggtgcagaggtgaagctcaaggcatgagtcgttagcaaggcggcacctggcagctggacctgggctgagaccagagaggaaagcccatttcccagtgtgtgtcctctggggacaagccctgggctagtgctaaactctttctgccttctcaagcaaattgatatttaatattacacacacacacacacacacacacacacacacacacacagactctctgatgtatttaatattacacacacgcgcacacacacaatctcagtgggttttttggtattgcctctttcattacctcacatatcagggagttagtatcagtaaaatatgttaatgccctatgtaactgatgtgagttttagatttctaatgacttacattaccaaaaacgtttcccacaaataatgagttggttttcccctagtgtgatgagttaatgaaagttagattccttgtaacaacaataaggactattgagcttacggatcccaaccatatagatctttttttttttttttttttttttttaagacagagtttcactctcattgcccaggctggagtgcaatggcgcaatctcggctcactgcaacctccgcctcctgggttcaagtgattctcctgcctcagcctcccaagaagctgggattacaggcatgcgccaccacgcctggctgacttttgtatttttagtagagttggggtttcaccatgttggccaggctggtcttgaactcctgacctcaggtgatccacccacctcagcctttcaaagtgctgagattacaggtgtgagccaccacggctggcctagattggatttttttaaactcatgggttaaattaaggtattaagttttatacccgctcccatcaagtaaaagaaaagcaaaaaagggaaaaaaaagatactgaattttaactctagtatgaagaaatgtatgtatccatcaacaggaagcactaaatttatgactacaggtaaggggccaagtgggactgtggctggtgtgggattttgttgttttattttcagttgacttcctatgctgaatacttggtgaacttttcttttttcttttttttttttttttttttttttttgagatggagtctcactctgtcacccaggcttgagtgcagtgtcgcaatcttggctcactgcaacctccgcctcccaggttcaagtgattctcctgcctcagcctcctgagaagctgggactacaggtgtgcacgccaccacgcccagctaatttttgcatttttagtagagacggggtttcactatgtcggccaggatggtctcgatctcttgaccttgtgatctgcccgcctcggcctcccaaagtgctgggattacaggcgtgagccaccgcacccggctcttggtgaatttttctaaggtgggctctgtaacaatatcattgggttaggaggtggggcttagacactggaccaaattgaagactagctaaaacagggcctggagagaagcagctttctataaaacatgcccaccagtgtgccacatcagtttaccattgccttggcaacacccaggagttaccacccctttccacagcaatgatctcacagcccaaaaggtactacccattccctagaaatttctgtataaactgcctcttaatctgagtacagattatgagtacaaaatatgagtacaaaactgtcctcagctgctactggcagcacacggcctatggggcagtcctacctcacgagaccagtcacagagctgtaacgctgccacctccataaagctgccttcttcagccctaccaccagctcgcctttgaattccctcctggctgaagcccagagcccttgccagctaagccctcctttggggctcgcctgccctgcagcatcatgaaggcctctgaggaatgccattaagctgacttcattcaaaaagaaaactggctgggcacagtggctcacatctgtaatcccagcactttgagaggctgaggcaggaggatcccttgaactcaggagttcgagaccagcctgggcaatatagagatatgccatctctatggcatgaatgaatgtatgaatgcgccatgcatgtcagcatgtgcctatagtctcagctacttgggaggctgaggcaggaggattacttgaggtcaggagttccaggctgcagtgagctatgatcaggccactgcaatccaacatgggtaacagagcaagaccttgtctcaaaaaagaaaagaaaagaaaagaggctgggcgcagtggctcacacctgtaatcccagcactttgggagggtgaggtgggtggatcacttgaggtcaggagttcaagaccagcctgaccaagatggtgaaaccccatctctactgaaaaaatacaaaataagccaggcgtggtggcacatgcctgtaatcccagctactcgggaggctgaggcaggagaattgcttgaacccaggaagcaaaggtttgcagtaagccgagatcacaccattgcattctagcctgggcaacaagagcaaaactctgtctccaaataaaaaataaataaaagaaaagagaactgccagctcccgcccacccggggccctccctgcatcagaacttggccgtaggctttcagtacattctctcactaattgcccagaatggatctgcaatgtagaccatctcttttcatagagggagaaagcaggtcgtgggtgaggtacctcctacagcttttgcggctaatcagggccagaggtgggactttgcaactccagactggcacctgcccatctctgcagcccttgcctccccgtctgctccattgtggccacctggagccctggttgccggaccaaggccagtcccttggggccacgcccaactctgcaggtggaggccgcatccatcgtccctgggggagcgcggcagggcacagactccaggaaaggagtgcgcatcacagagtcaaggctcggacagatgggcagacccttgaccccgttgatacggatttggtcctaagtaaatgccttttaggaaagcactcctcaccagtgagtgatcaagggggaaaacgcgagcaatctcagtgccctgccatggagaaatgggttagtaaaaagaacggaccatccctaactgggatgttatgtcaccgttaaaatattaataatagttatggagaattcatagtaacatgagaaacgtacctaatataatatgaagtcaaaacatgcaccgtacaaaattatttacagtgcagtatgattgtacatcttcctacagcaaactcatgcattaccacaatgtggaaataaacacatatgggaattaaatattattaagttgacttttcttgttttttgagacagagtcttgctctgtcacccaggctggaatgcagtctcacaatctcagctcactgcaaccctccgctccaggttgaagtgattctcctgcttcagcctcctgagtagctgggattacaggtgtgtgccaccaagcctggctaatttttcagtagagataggttttctccatgttgctcaggctggtttcaaactcctgacttcaggttatctgcccgcctcacctcctgatgtgctaggattacagacataagtcactgtgcccagctcttgacttttcaaattaggtaaagggattagctatattaaaatatacaataactgattcttagagggaagggctgaagctagaatttacttcattcattttgtgtgtgtgtgtgtgtgtgtgtgtgtgtgtgtgttttgagacaaagtctctctgtcacctaggctgcagtgcagtgacacgatctcagctcactgcaacctccacctcctgggttcaagcaattctcctgcttcagcctcccaaatagctggggttacaggtgcccaacatcacacccagctaatttttatatttttagtagaacaggatttcaccatgttggccatgctggtcttgaactcctgaccacaagtgacctgcccaccttagcttcccaaactgctgggattacaggcgtcattctttataacaaaaaattgttgatggatctaggatttaaatattataattttttgtcacaaacatactggaagaaaactggggtgcatatttgtttttattaatatgactatataaaacttaaaacagattctcaaaaacaaataataacattttaaaaacatcaacaaactgaagaaatatttgtaccatgtaagacaaaaggctaattttctttatatacaaagaggacttctaaattaataagaacaaaatccgctctacaaaaataggcaaaggagataagtaggcatgtcatacaaagagaaataacatagctttactcagcagtaaaaatttaaatttgattttatcttgtgttggcagagtatacgaaaacacacttacatattgttggtgggagtttaaattggtgaaagttttttgttgggaagtttttcactatctatcaaaacaagaaaagtggccaggcgaggtggctcatgcctgcaatttcagcactttgggaggctaaggcaggcggatcacttgaggccaggagttcgagaccagcctggccaacatggtgaaaccccatctctactaaaaatacaaaaaacagccagacttggtggtgcacacctgtaattccagcttcttgggaggctaaggtatgagaattgctcgaaccctggagcagatgttgcagtcagccgagatcatgccattgctctccagcctgggtgacagaacaagaccctgtctccaaaaaaaaaaaaagaaaaaagaaaaaattgcagatactctttggccattgtaattcctctgttagcatttcatctccaacagattcactctcaaaattatacagcagtatctccacaatgatcgttgagggactgttcagtagaaagaaacctagaaacaatctgagtgtccacagaggcttaagttaattatttaataagaatgagggagaactatgtttgctggaatagaacatttccaaaatacagagaaaagtgaataagggaccccagaatgtggtgcacgttgtgatcacctttgtattaaaagaacagggcagggagattatattatactatactatattaaacacttctatttcagtagcctatttcatattcatattacactatagtatattacattacttcattattacactatagtatcctgcatattagttcgtactatgctatagtatatttcattcatattttgctatactatgtgacatattaatttatattgtgctatagtgtgttacatattcacattatgttatagcatgttacatattagttcatattaagccgtagtatattacattagttcacattccactataatgttacatattaattcatattatgctatagcatgttacatattagtttgtattacactatagcttgttacgtgttagttcatgttacgctctagtgtgttacgcattcgttcatattacgctgtagtgtgttatgtattagttcatattaccctataacgtgttacatagtagtttatgttacactatagtgtgttacgtattagttcatattatgctatagcttattacatattagttcatagtacactatcatttgttatgcattaatttctattatgctatagtgtgttatgtgtttgcttatattacactataggctgttacatatcatatgttacatattcatattttgctatagtatgttacatatttgtttatattacactttagactgttacatatgatgtcgtatttctgtacatgcagaaacattttagaaaaatacaaatgaactccatctgaggagcggaaatgagccaaggaatagtaagactctttcacttcccatgctcttgtcatatttgattacatccctgagtgtccataattgaaatacatgaaaatattaacagtgcttttctagaggtgatgagaattgggttgactttgtaaactgtgtcatttctacttttctgtatcccagtttattattatgagagcatatgttaaattcatatgatataaaaataatcaacttatttttggaggggtttttttttttcccccagattaagaggaaggaatgctatttattgaccagggaattcacttagagatcctgggaaatctgaatctgtggaatgcagttgcgagcattcacaatgtccccattaggtattgcagttgcgtttgcattccattataacagagacggaacagctgccacatctatttagtgcatcctttattccaacaaactccttcattgtgtcagcagaatgtaaatggatcattcttcttgcgctaacttcagaaaacaatgagtgcatgatgatgatttttttttttctttttaaaatctggcatttcaagaacaaattacatttaggataaccttctacgccagttaccacccatcaagccccacgggttgcacacttgccgtgatgtgacacgcagttacaaagttggggtgtggaagctgcgggagcggggcccacggcacacgtgtcgttgcgggcgataccccgtggtgcgcctgccgccagctgagcgcagggagggagctgagctcagccgaaaggcacacgtgcatttcagttggtaaaggagatgaccaatttggcttcgtcctcttcctttgcagaaagctgcaggagacacagatgtccaccacctcaaagctggaggaagctgagcataaggttcagagcctacaaacaggtttgatactctccttcctagtaccatggatgtggggaggacccagggggagagttgggtcagcccctgaccgccccggtccccgcggatacctgttgctcttcggggccgtgggagctgccgggagcccacgctgaagaattccgcagcacgcccgccagctgctgcgcctcattcctcactgactttgagttgttaatgtagaggtgggaggatctcgattccattttcatcccttccacacgccatccttgcttcctgctctttttccaacaaacacttctaaatcaccaaactgtcaaggactgacatttcatttggaacaataatagaaaaaaaaaaaaaaactcacttctaccctaagtgaagttaaggagaacagtaatttcagacctttaaaatttaaaagccaccaaaaaaggttatgctcaagtttttacagtatctttaaacttctttctctctctctttttttttttttttttgagacggagtctcgctctgtcacccaggctggagtgcagtggcacgatcttgactcactgcaagctccgcctcctgggttaatgccattctcctgcctcagcctcccgagtagctggggctacaggcgcccaccaccatgcctggctgattttttgtatttttagtagagacgaggtttcatcatgttagccaggatggtctcgatctcttgacctcatgatccgcccacctcaggctcccaaagtgctgggattacaggcgtgagccaccgcgcccagccctctctctatttctttttttgttttgttttgtttttgttttttttttgagacagggtcttgctctgtcacccaggctggggtgcagtggtgtgatctcaggtcactgaaacctttacctctgtgggctcaagcaatcctcccacctcagcctccccagtaggtcggattacagatgcccgccataatacccgcctaatttttgtgtttttagtagagatgaggtttcaccacattggccagtccggtctgtatctcctgagctcaagtgagccaccacacccagcctctcttttttatttctgaaagagaagcatcaccatgtatttcatttaaatgtatttttaaatttttattattttttttgatgacccagaactgagcagattatttaaatgtagacagacatcagaagtcataattcaacttaaaacacaaatgacgagagtgggagaaaataatcaccacaaatttgacaaacggataattaaaaaatgtaaaggctgtaaatcaatccattaaaggagagaaacagtgcagtcgaacaataagcaagggatatgaacagtcagttcacagaagaaatgcaaatggaaactacacatatgaaaaaatgcaaagttttttttacagtcagggagatgcagattcaattagtgaaagactgttttgcctgtcagactgacagcattttttaattatttatttatttatttttgagacggagtcttgctctgttgcccaggctggagtgaagtggcacaatctcggctcactgcaacctctgctccccgggttcaagtgattcttctgccccaggttcaagtgattttcctgcctcagcctcccgagtagctggcgttacaggcgcatgccaccatgcccggttaatttttgtatttttacgaggtttcgccatgttggccaagctggtctcgaactcctgacctcaagtgatccacctgcctcagcctccgaaagtgctaggattacaggcatgagccactgcacccagcctaattttttatttcattttagagacatggtctctctctgtcgctcaggttggagagcagtgatacaatcatagctcattgcagcctcaaactcctgggctgaagtgatcctcctgcctcagcctcccaagtagctgggactgcaggcaaacaccaccacacatggctactttttttttcattatttcttttatggacatggagtctcactgtgttgcccaggctggtcttgaagttctggcctccagtgatcctcccacctcagtgtcccaaaatgctgggggattacaggtgtgggctaccgcacctggcctttaaaaaaaatatagcaattctggcctgacaaagacttgtcaaaaattattgaaacatccagtgttggtgacggtgaagtggcacttatggaatggatgggcatggaaggagcctcttgggaggccagctgggtggcatttatgtaaagctccagtgcccaagctgttcagccagcagcttcacttccaggtatcctgatgagagaactgaaggttattgccactgcctgggtccacatgtggaaggactcccataccatactgcccagggaaaaaggctagtctcaagaaatattcataccgtcccatttatgggggtagaaaataaaaaaagatatatacacacacatatatacatgcaattatgtatggaaaattttttcttaacgtaaaatacactttcttttattttgttacacttttttgaaatgagtctcgctctgtcacccaggcctggagtgcagtggcatgatctcggctcactgcaacctgcatctccagggttcaagtgattctcctgccttatcctcccaagtagccgggattacaggctatgcgccaccatgcttggctaatttttgtatttttagtagagacagagtttcgccattttggccaggctggtctcaaactcctgacctcaggtgatctgcccgtgtcagcctcccaaagtgtgagccacctcgcccaaccagaaataataaaatacaccttaaaacatgaaatcatccaggtacagtggcccacacctgtaatcccagccctttgggaggccaaggtgggaggatgacttcaggccaggagttccagaccagcctgggcgacatagcaaaaccctgtctctacaacagtgttttaaaatattagccaagcgtagtggcttgcacctgtagtcccagctacttgggaggctgaggcaagaggatggcttgagcccaggagttaaaggttgcagtaagctgtgattgtgccattatactccagcctgggtgacagagtgagaaaacttgtctcttaaaaatggaagggaaagaaagaaagaaggaagggagagtgggaaagaagaaaggaagggagggagggagggaggaaactattaacattggttctgtctttgtaggtgcttgggattagatgaggcagaaatgaagggggatttcctattccattttttgtattttcatcatcttggcctcttttgtgtgtttttaatctttatttttccacgcacctcgctcctcacagaaatctttgcctcttttgaaatgggaatagattacctgtgtatgcattcttttaaaatttcatttaaatagttagtaattctttgcctttcagccctggaaaaaactcgaacagaattatttgacctgaaaaccaaatacgatgaagaaactactgcaaagtaagtctctctgcttggcctcccttatccgtacacatttctcacctgattttgcttgagtagggcaggatcgagaaggttcttgacctctgtgctgctgcagggacacagtgtatttcccatgagttacttgcgtcggttcaatgcacgttctagcactcactgggtaatccttccaacaaacttctttccttctttattgtgaaggctggtcactgctatgccttctgccatgaaaatttgggagttagtttatataagatgtgacacatgggacattttttgtgtggagttgagtctgggtaaatcacatgtctttttcgctgggccacagttcttcatttctcccagggccctttaggaaggcctgccccagaataagcacattcccacgcaggcataggggttcatgtcacacctaacaacgctaggtgtggatatacggatagacacagattcgggcaggcagagtcacaaaaggccaattcctacccagctcttgtccaaaggaaattagaggtgtccactacaagtgtactttttacccgcccatctttcatgcagaacaccagcaaggaagaaataataattgacataaatcatgaaaagatgaagaaatggcagaaattgctcctagccattgcctcctctaccaaactcccggggagcaatgccaggctagagtttgaaccactttttcctgttctggaaggctcttcccatcttccgcggaaacacacacgcgtgcttactgccatgtctcttgggtttccctattccagttacaaaggtccccgcactctgctcacacagtgcctccgtgggcatcggcaagaagacgggtacttctgaatggcgccgctgtcccaccaggctccacctctgtatggggtgccggcacttactgtccctctgccccatctcacgtgaccttgggctttgagggtgctgctgggtctgttgctttcaggatgctgtgtggggttcttggccctttgctctgggtcatttagtagcctgagacctcgagagcccagcttcgtagcctggtggtcagaatggattctgatcatgagtatgaaacttacaaagactaaaacatcaccactagatcagctactctcttctctcaattactgcttggacctgattaagcaacttacttacttgcactaagtaggttgtttttctcagtaaatctgatttttaaaacttactatatttcaccgagcatggcagtgtgcacctgtagtcccagctacttgggagcctgaggtgggaggatcacgtgaacccaggagttgaggctgcagtgagctgtgatcgtaccagtgcactccagcctgggcaacagagcaagaccctgcccctaaaaaaatttttaaaatattgttttagttttaaaaaacatgtcaggggctgattgtccttcacataaaaattagccctgtctcaggactgtagctgagagggcagtggctctcttggggtgcgccccacctgccctctgaagtaagaaacattcttgtctccccagtggtgagccaggccgaggggtgtggtgtgcatgaagggagagagactcactcggttagatgataggcatggctcagagataatagattcattcattgattcaacagacattcacagaggcttcctctgtgcctcgccctgtgcaaattctgagactgttacggctccatggggagacaggccattgcaatccagcatgcccagtgctgcaatcaaggggacagggcgctgacggtcagcaggtcagacagggagcctgcaggtggcaggcagggcactcccattgggatagtcagaagaaagtttggcagggtgcagtgactcacgcctgtaatcccagcactttgggaggccgaggcaggtggatcacctgaggtcaggtgttcgagaccagcctggccaacatggcaaaaccccatctctactaaaaatataaaaatcagctgggcatggtggcgtgcgcctgtaaccccagctactgaggtggctgaggcaggagaatcgcttgaactctggaggcagagattgcaatgagccgagatagcaccactgcaccccagcctgggctacagagccagactccatcgcaaaaaaaaaaaaaaaaaaaaaaggtcaatattgggcctatttgcagaggtgcagttcctaggctcatagtaccggcagggtttccacgcctgggtttgaatgagccagagcggggaaaggtagctagagactgaaggtgagggccccctcgaggggagccgtggccttggggagggaagagggacccagggcagcgccagggaccccttaactgatcccctctctcctcccaccagccaggggagctggggaagggcatagtacatccctagcatcaggggagcgcagggaaagaattgtcgaggaagccttcctaaagagggtggtatgggattcgggattggaagatgagtcaagtcaggttttgcagaggtttgtgaagatgcaagcctggcgaagcctgtcttggggaggacctgccagaggttccgaacgatttgcctgtggggtaggatggggcagcctggtggggcatttcccacatcagaaacggtctggacactgacaaaggcagcctaggaccaaccacgtaatgtaatagttcccagagtaagtcatcccccaaaaatgcagagaatggcctgagagaattggatcttggctactttcttttaactttggaggccatgggctcattctgagacctcccccactgcctttgcctccccttttattttccaggacagatttgtcactattccgtctgcttcaagtccaacctacatgtattttattagaccagacacgttttcattcatgtttgtgaatataagccccttggggcaaatcttttcacatatggtcttacagcatttcaaaaacaatttattttccctcttctgaaggagggattcttagggccaggcgcggtggctcacacctgtaatcccagcactttgggagcctgaggcgggcggctcacttgagcccaggagttcaagaccagcctgggcaacatggcaaaagcctgtctctacaaaaaatacaaaaattatcctggcatggtagctcctaactgtagtcctggatacttatgagtctgaagtgggaggatcgcttgagcccaggaggtcgaggctgcagtgagcctaattataccactgcactgcgacctgggtgacagagcaagaccctgtctaaaaaaaaagggattcttaaatatttgttgacgggaattggagaggcatgaaggaagatgggttttggagaaagactgacttgggattgattcactagggtccactacgagctctctgcgtgaccctgaatgagctatgagctgtccacctccctttctgacctgtacaatgggcataccggaagtcaagtcactgggtggtttttgttgttgttgttgttgttgttttgttttgagatggaatcttgctctgtcgtctaggctggagtgcagtggcacgatcttggctcactacaacctccacctcctgggttcaagcgattctcctgcctcagcctaccaagtagctgggattacaggcgtgcgccaccacatccagctaatttttgtatttttagtagagacggggtttcaccatgttagccaggatggtcttgatctcctgacctcatgattcgcccacctcagcctcccaaagtgctgggattacaggcgtgagccactgcacccagcatgctaggtggttttgaagaggcaggaatgggatgtgtgtgtatagcacctggcatggtgagagtctgaggctaagctgtcgagagatagaagctattcccagcaagctcagagcagggcgtggtatgcgtttctgaaattaacggccttggaggaaattgactttcaccgcatcaccacgacggactgggcccacattgtctgtctgtcgtggggagatgtcacagggtacccatccctctcccgttttggagagaagcccgcaggtctgtggtactgaggctgctccgagaccccggtttatcgtgagcagtcatcgccatgcgtcagctgggacagcacgggctgactgtggcagacaacggcagtaaagttttccatgtgtaggcttgaagcaaaatgtaattagcctttatgtgcagaacaagggcccattgatgaatacagctggtctttgttttgtcctgtcgttgagagtgggaggtaaaagtgttcttcttcatgtttattaatgcaagattccttagacaaatggcaagcacagtttaatatttgttggaacatgggggctttgccaaaacagttgttgtgtaagaggattgcaaggtttccgattataaccatttctgggttaaataaatgaattatttctgccctttttttcttttttgaaatttttttagagtcagggtctcactgtgttgcccagagtggtctcaaactcctggcctcaggtgatcctcccgtcttagcctctcaaagtgctgggattacaggcatgagccactacgcctgacattcttttttctttagttaaaaacatagctccttctcagatggtcaccctgtgtacggatcttcccgcttctcttagcaaatggagatttaccaccctaatagccttaaccttggagactctagcaaaggaacgtgctgtggattttaacatctaaacaattccttgggatggatggccgtggaggtggcagatccctggaatcacgcagcagtaggcagcccagagagaggcctgggcatccctcactgccccaagttcctgcatccgtctcctgcagctgttcacttacttgatcttgggtttgggttgctactgcaccctccagcaggaatgtcgccctcccagccaagcggctagtgttctgggcaaaaatgcaggaattcccatttttgctgaagtccacgatcctatgccctgtccccaagaatctggattggaaaaggagttccagctgcaatacacacagtcagcttcttgcattcctccccactcgtgggccgaggcactgagcctcgatgaaagaaaatattgaatcgcactgaaatactacattttttatagctaatgttagtcttaggagaatttgcacctcccaaacctttcctgccagtaaaattcgtatttcttaaggttactcatgttgtattcctagcctatatgcttttttcaaagaacgacattgtgtatacacatacttacatagtacggttacaaaagagacatttacgaggaacttcacttaggttaattttagagtattttctttataacatgtatataaccagtactttatcacaaaatacaacgtgctctgaaacagcagaaaactttcccgtagctaactcagcactggggagcctctacgcttctttggagggatagagaactccagatcccaaaggaggacataagacagaatttgaaaaggggaggaggctgggcatggtggctcacgcctatcatcccagcactctgggagactgaggtgggaggatcacttgagcccaagagtttgagaccagcctgggcaacatagtgagaccccacctctaccaaaaaatacaaaaattatctgggcatggtgttgtgcctttagttccatttacttgggaggctgagttggaaggttcgcttgagcctggaagttccagcctgtagtaagctatgattgcatcactgtactccagcctgagtgacaaaacgagagcccatctctaaaaataataataataatttttaaaaggaggggaggaggataccagcagttcaagacacaagtctgcatggcaaatgtgggtgggatggatactttctttttattttattttttatttttttgagatagggtctctgttagttattcaggctggagtgcagtggtgcgatcatggctcactgcaacctccacctcccgggttcaagtgattcttctgcctcagctgctggaggagctgggattacaggcttgtgccaccatgcctggctaatttttgctttttggttttttttttttttggagactgagtctcgctctattgcccaggctggagtgcagtggcacgatcttggctcacggcatcctccgcctcccgggttcaagcgattctcctgcctcagtctcccaagtaactggaattgcaggcatctgccaccacacccagctaatttttgtatttttagtagagacgaggtttcaccatgttggccaggctggtctcgaactcccagactcaagtgatctgcccgccttggcctcctgaagtgctgggatgacaggtgtgagcagctgggatggatactttgtttacatactgttctggactatttcacaatgatttcctgagtgttatcttgtttgccctttcctgaagtcactggggcagcttttattgtgctcattgcatggatgaggaagcagtcccaggaacacgcagattcaggccctggacctggtcctttaggctcaaattccagtgctttttgcttgagaccacggcggtcttcaaagcccctttctggtgccagctttgtaatcaagcagcaaaggtgagggctagtcaggtgaaggcaggcgttcctggggggttcagcctttcccagcctcacaagcccccgttgtatttaccatagcagattgatttttccctttttgaacaataattcctcatgaaagactcacagaactggggccaggtagagcccggttgagtaaacctgagaatcacccagctgtcttgaccatcatatttagacaaatattgcatcccctgattgaatttgaaagggacaacttaagcatcctgaaaacagagtctgtctgctgtacctttaagaatgtaaaattttctatttcctgtctttttgatgagtcatcagtttccagtacgagttgctgtaattaccctggttggattaatttccctaaaaatagagaagcagccacttttatggttttcagagtatggacttgaataaagaacctcctgtcctttaaaccttagagagcactaaatcagacttgcagggaaaaaccgatggccttttttttttttcttcctgtgtcttatctccaaaaggggcttgtggattttgtagaattcttgggatttttcatctctgtacaagtattttgctccacacctaaaaattgatgcctgggtgagccctgaaggattttccttgtcttttgtagtaacaccagctgtcttggccccctctgaatagtacaaccatgacctggtgtctccccaggttgggggctagacaaaaacaagggggtggcttcatagttccaagtccaggtagaaattcctctgagcgctgacgattctttgccagttctgtggcccccagacatggctaggaaatgtaattgacatgtaatagacatgtctattgcaaagcatcagtgagaattgccaaactttactcctctccttcattgatgtttagggaagggctgctttactgtggtaggtgtggtgtcaggtgctggaacgatagagtaaggacagggtgggagggggcttacagacgtcacatgcacacacacaggctcacacactctgtactcaaaaacacgtacacataaatagagaggcagccgggcacggtggctcatacctgtaatcccagaactctgggaggccgagatgggtggatcacctgaggtcagaagttcaagaccagaccagccaacatggtgaaaccccgtctctactaaaaatacaaaaattagctgggtgtggtggcgcatgcctgtaatcccagctacacgggaggctaaggtaggataattgcttgaacttaggaggcagaggttgcagtgagctgagatcgcgccactacactccagcctgggcaatagagttagactctgtctcaaaaataaaaaaaaaagagaggcactgtgcatgtggccatgtatataaacatgtttgtgaatataaacatgcaatcagtttttaaaaaatttttatcggccgggcgcagtggctcatgcctgtaatcccagcactttgggaggccgaggcgggcgaatcatgaggtcaggagattgagaccatcctggctaacacagtgaaaccccatctctactaaaaatataaaaaatgagccaggcgtggtggcgggtgcctatagtcccagctactcgggaggctgaggcaggagaatggcgtgaacccgggaggcagagcttgcagtgagccgagattgtgccactgcactccagcctgggtggcagagtgagactccgtctcaaaaaaaaaaaaaaaaaaattatcatacagtctctcaaccagtcctactgcttttttttatttattgattttgagacagggtctcactctgtcacccaggctagagtacagtgatgcgatcttggctcactacaacttctacctcccggtttcaaacgattttcccacctcagccacccaagtagctggtatcacaggtgtgtaccaccacacctggctaatttttgtatttttagtagagatgggggtttcaccatgttacctaggcgggtcttgaactcctgagctcaagtgatccactcatctcggcctcccaaagtatgggattacaggcatgagccaccgcgcctggccaataaagcaatcatattcatccagcatcctttgagagggtagagaaaatcattattcacagactgtcacctgggtttggcgtgcattcctacagattttacctatttaagagatccttaaagtttttctgattcactgttaaggtaagcctagggatcttgcagtgtatatgtgaaggaaatgggtaacggactgttgagtgaatacagtgtatagattgtagcacatatggtgatctgtgaaacgggggtgtcatgacacaccccttcctgcatcccaaaattgtgggggtcagggtggataacgggcatttctgcagcctgcacagcagtgccgaatgcaggctgcaatccagcaatgtcactgctgggtatttatccaaagaaaggaaatggctgtgttgcaggcatacctgcactcacacgtttatcacagcgctgttcacacagcagcctaggtgaggaagtgacctatgtgcccagcttcagatgaatggatgaagaaaatgtgtagatccacagtggaatatgatggagccttacaaaaggaaatcctgccatttgcaacaacaacgtggattcatctgggggatgttacattaagtgaaatgaaccaggcacagaaagacgaataccacaagatctcactcatgtaaaacgttgatcacataaaagttaagaagaatggtggttaccagggggtgaggagaggttggttaaatgatacatatttataggtagacaggaggaataagtttgagagatgtattagacagtgactatagttaatgccggtatattgtaaaattggttagtagaaattttttttttttttttgagacagagtctcccctctgttgcccaggctggagtgcagtggcatgatctcggctcactgcaacctccgcctcctgggttcaagcaatttttatgtctcagcctcccaagtatctgggagtacaggcacagggcaccacgcccagctaatttttgtatttttaacagagacagggtttcgccatgttggccaggctggtctcgatctcctgacctcaggtgatctgcccacctcagccttctaaagtgctggatttacaggcatgagccaccgcgtctggccccattttttaagtgttgactgaaaactacctcaaaagaccggctttatcccacactctgtacaccacaggcttagcacgtcgtggctctccaggaactcttgagccttccccatgatgatgagtgggtcagggttaccgcagagctgaacggcctctgtagcgttcagcctgcagcctgcccaatgaggacgtttgcgctctggaaaggtaaactcaggatgctgttggctcctaagcagaaagcaggcgccacccagccttcaagtgcttcaacagtgaagagttaggacggaggcccagcctggaacattcacgccaccttctgcccccagtaaaattccttaaagctatgaggttctgactcaccacggggagtccctggccgccgctgggagggccttggccatgcaaatctcagtgacatagcacgtcttatttgcttcagaagtggcagaggagaaagtgacttgcctcacgctgcccggttccacccagggaccttgtgaagagacgcgggaaggctggcagaaaggagaaccgtccttcctgtggaatactcccgagatcgcaccactccactccagcctgggtgacaagagcaaaactccatctcaaaaaaaaaaaaaaaaaggcactgtacatgtgtccatgtatataaacatgtttatgaatatacataaataattttttaaaaaattttgtcatgcagtctcagccagtcctgctgtttttattttattttattttattttatttatttttttgagacaaggtctcactctatcacccaggctggagtgcggtgatatgatcttggctcactacaacctccgcctcctgggttcaagcaatcttcccacctcagccacccaagtagctggaattataggctgtttccttttacatgacattattttcccttttttatgttttattttattttatttttgagatagagtctcactctgttgcccaggctggagtacagtggtgcgatctcagctcactgcaacctctgcctcttgggttcaagcgattctccagcctcagcctcccgagtacctgggactacaagtgtgcaccaccatttccggctgtgtgtgtgtgtgtgtgtgtgtgtgtgtgtgtgtattttttgtagagacggggttttatcatgttggccaggctggtcttgaactcctggtctcaagtgatccacccgcctcggcctcccaaagtgctgagattagaagtgtgaggtaccacgcccggcccgtgacattatttttaagtacaaaagccatacatgtttactatacaaagtttagaaaattctcaaagattttttttaaaggaagcagatcatcactcataatcccacagcaaagatgatcattgttaacattttggcctatttccatagtctttttttctatacagattgttccttacaatggcattatgtcccctaaacccatcgtaacttgtaaataccttaagtctaaaatgtgtttagcacacctaacctaaatgtcatagcttagcctcgcctattttaagcgtgctcagaacacccacgttaattagtctacagttaggcaaaatcatctaacacagctgtccccaaccttgttggcaacagggaccagttttgtgaaagataatttttccatggaccagtgcagtggggggcgcggttcaggatgattcaagcacgttctatttattgtgcactttattattatgacattgtaatatataatgaaataattctacaactcaccatcatgtagaatcagtgggagccctgagcttgtttttctgcaactacacagtcccatctgggggtgatgggagacagtgacagatcatcaggcattagattctcataaggagtgtgcagcctagatccctcgcatgcgcagttcacagtagggtttgcactcctatgagaatctaatgctgctgctcatctgacgggaggcagagctcaagcagtcatgagagcaatggggagcagctgtaaatacagacgaagcttccctcctgcagcgcatctcctgctgtgcggcccagttcctagcaggccacagatgtggccaagggactggggacccctgatctatatagtgctttcttttttcttttttttctttttacgagatagggtctcaccctgtcacccagcctgcagggcagttgcactatcatagctcactgcagcctccaactcctgggcttgagcgatcctcccacctcagcctcccgagtagctaggactgcaggtgtgcaccccacaccaggccagttttgtattttttgtagagacagggtcttgccgtgttgcccaggctggttttgaactcctgggctcaaacaatcctcccaccttggcctcccaaagtgctgagtgggattataggcatgagctgcttcgcccaaactcgtctgttttttaccagtggcatagactgataacatgattttgatttctagggtttgttttttgtttttgtttttttttttacctgacatgttgtaaatatttcttgcttatcattaaatattcttcagaaacacagtgcatactgcataacattccatcacgtaggtgagccctaagacttaccacttatttccctgctgttcaggagcctgatttattacactgctttcattgccctttggggtttaatctggggagctttgtccctgttctttctatgccttcatgttctgccagtggctgtggcatctttttcgtgttttttgtttgtttgtttgtttgttttgttttgtttgagacggagtcctgctctgtcacccaggctggagtgccgtggcatgatctcggctcactgcaacctccacctcccagatttaagcgattcttctgcctcggcctcctgagtagctgggactacaggtgtgtgccaccacgcccagtgaatttttgtatttttagtagagacagggtttcgccagttggccaagctggtctgacctcaggtgatcggcccacttcagcctccagaagggctgggattacaggcgtgagccaccacgcccagccggctgtggcatcttgaggtagcctcccaaggccatcatcagacaagagcgtttggaagcccagaattctccaagggctcatggcagtactggcacggggcctctgttcctagactgctgctccatgacgtttgtagatgcctctagtgaaaagtcagggacagtggatgatatgcacggctcagagaccctgactctggtcccatctgtccccaggtgtgaccccacaaagcccctccctcggccgcagcaccggattgggccgggtgccaggcaggacggaggagctggcccttttgtcagcctcttgcactttcttgcccagttctacttcccagagacctggatctcggatgctgtcccccagcagggcctgtttgtggagtggccttcaggcagggctgcatccagggcaccgggcacagcatgagtcacggtgggaagaacctgggtcgcaacatcgtaaagacctgggtttaattcccaactccatgaattatgtaacctcaagcagggcaggaggtttccttactcagaccttagtattttcataagtgaaataaaagaatgccacgcctcacctgtaatcccagcactttgggagatcaaggcaggtggatcacttgaggccaagagtttgagaccagactggccaacatgaggaaaccctgtctctattaaaaatacaaaaatttgctgggcgtggtggcatgtgtctgtaattctagctactcgggaggctgaagtagaagaatcacttgaactggggaggtggaggttgcagtgagctgagatcccgccactgcactccagcctgggcaacagagactctgtttcaaaaaaaaaagagaaaagaatgccacattagtgcctggtacaggacctctataaagggtggctgacattgctgctcctgctgcctgcaaggcacctggcatcacctggcacattttaaaaaggtctgcttacctccccctgctcaaggtctcttcccactcttaagaattatgtcgctttccatgatgagtttgtaaaaatcattatccgcactgcaagacctactcatccatattagcgtgccacagctggggcacccaggtgtaaagctttgtttcccatcatcttcctcagggaccctaaattttaaaatctgcatcagtcaccattgaggtgccactaaatgtggtggccaaaagttccaagttcaaaccattgcacagctgcaaatgccttcatagatgggtctctaaaaaatcaaacaccagggctgggcacagtggctcacctctgtaatcccagcactttgggaggccaagatgggcagatcacttgaggtcaggagttcgagaccagcctggccaacatggtaaaaccctgtctctactaaaaatacaaaaattagctgggcgtggtagtgggtgcctgtaatcccagctactcgggaggctgaagcaggagaatggcttgaacctgggaggcagaggctgcagtgagccgagattgtgccattgcactccagcctgggaaacagagtgaggctccatctcaaagaaaaaatcaacaccagaggttaataatctagtaactaactgtcttctatgtgccacatttttgcaagatccaagttttaaagtgagaacaagttgttcggtccccgcccagctgactgtgacaccaaggtggcggcccgcattggagatctggttccatctgacttggaaaatttggggcaccgtgggctggtgtgaaacaaattaaaagaggtgccaaacagccaggcacccagcaaggatgcccagggctcttgttcggggatttcgttaaaaaactttttggaacccacctcaaagaatgaaaagtttcctataggaaggcaggagcgagcgagataattgaactcattgatttccttcacggcttgtttgccctttcattctcttcccgaggtgctatttgttgaggaatgtctccaattgccagaaagacagtggggtgtctcatatttcctcgccacctctcctttcagccagtgctgagttctaaggcaagcctgcaatatgaatttttaatgccgagctttatggcatcactcccgcacagcccgactgcatcactctcctgagccttcagatttaatgctccaatgaacagagcaaagactggggcattcaacatcagtgagaattaacccccacatgaccacagcagtgccctctgattttcctaaagagggttgggaaaaaataaaaattatgtagtgttggccgggtaaggtggctcacacctgtaactccatcactttgggaggctgagatgggtggatcacctgaggtcaggagttcgagaccagtctggccaacatagcaaaaccccatctctactaaaaacacaaaaattagctgggcgtggtgacgggagcttgtaatcccagctacttgggaggctgaggcaggagaatcgcttgaacccaggaggcagaggttgcagtgagctgaaatcacgccactgcactccagcctgggcaacagagcaagactccatcttataaaaaaaattatgtagtgttgagaatccttgctatccaaatagcctgaagcacaaaagcacagcttattcttgaaattttatggaatagcctatattttgacctttttgcttcttctaagttggacgatgtgtgcttcgaagcatttctgtgatcttcccacccttaaaaaaaaaatctctgcaggctgggagtggtggctcacgcctgtaatcccagcactttgggagactgtggtgggcagattgcctgaggtcaggagttcaagaccggcctggccaacatgatgaaaccctgtctctactgaaaatacgaaaattagccgggcgtggtggtacacgcctgtagtcccagctactcagaaagctgagtcagcgagatcatgccactgcatttcagcctggtcaacagagtgagactccatctcaaaaaaaaaaaaaaaaaactctccagtttgtaggatttaatgaatatatagatgaccggctgttctgcggtttccgtggaaagcccaaatgtaattagaaatccaatttccgatcgatttttccaatggaaaaaggaccagttgtgttaagtggctaattctttttttatgcagatggttgattgtcattttcttatagtagctttctgaatttttgcagacgtcaaaactaagaaaaagttgtatataaaaattgctcaattggccaggtgcagtggctcacgcctctaatcctaacattttgggaggccgaggcaggagggtcgtttgaggccaggaattcaagaccagcctgggcaaaacagcaagacataatttctgtttaaaaaaaaaaaaaaaagtttgaacataaaaactgctcaaatttaagtacattaaagaaggacagagtctttagtaaatggtagaataacaagccaactatgtagaagccagtagaatcagagctgagccccatgcaaaataaaatctatttagttatttttatttattttttattttatttatttattttttttttttgagacagggtcttgctgtctcacccaggctgaagtgcagtggcgtgatcttggctcactgcaacctctgcctcccaggttcaagcagttctcctgcctcagcctcctgagtagctgggattacaggcgcgcaccaccatgcctagccaatttttgtattttagtaaagatggggtttcaccatgttggctaggctggtcttgaactcctgacctcaagtgatccacccacctctgcctgccaaagtgctgggattacaggcgtgagccaccacgctcagtttagatgtttaaaacatttaaatgtgaccagaaagaaatccataaaaacactaggagcaattttaggtgtatatttatataataagggggtggaaaaacttttttttaagcatgatgccaaaagtagaaatcacaaagggaagaaattcagagctttgtggagatggatgggcgggtggatagatggatgggcgggtggatagatggatgggcgggtggatagatggatgggcgggtggatagatggatggatggacagacggatgggcagatggatttagacagactggcaaaaatatttgcaatatatatgagagagagagtgtgtgtgtgtgtgtgcgcgcgcgcgcgcgcacgccacgcacacacgcatctttacagaacaataagaaaaagtttcatttcccaatagtaaaacctctatattttcagtttcttactagacatttctactatgagcatctcaaactcagattaagttgttattctccgtaacttcccccttccctatagtcagcccccttctgctttcttcctctgcccgaccatacctgctcctccttcattccagaaactgagggtatttcgtcactcctttgtgagccctcctgtctaattcatgttagttccgccttcttgcaacattgtacattcccaacttcatcaccactctcactaccgtcattttaatttgtttttctttgcttttctttttttttttttttttttgagacagggtctcgctctgtcacttgcagtggcgcaatctctgctcactgcaacctccacctcccaggttcaagcgattctcctgcctcagcttcctgagtagctgggattacaggcacccgccactacacctggctaatttttgtatttttagtagtgacagggttcaccatgttggccaggctggtcgcaaactcctgacctcaagtgattcacctgcctcagcctcccaaagtgctgggattacaggcgtgagccaccgcacccggccttaatttgtttttcgtctcttggtctcacttcaagatcttctgaacttgaccctctgccaccagtatctccctggacaaaaccaccctccaagcatctgctaaagttatctttctaaaatctgtctgatcctgctaaaacctgtcccacttaaaatctctccgtggcaccctctctcatatctaagggaaagtccaaaatcacagcatgatgcacaaggcactttgggatgcagccctgccttcccagcctcatcttaggccaactcaaactccaccgtcctatagaatcccaggcctttctttccccagctcaccttgcagccggttctacctttcctgacaagctgatcctgccctgccttgcctgctcctatgcccacacttacctgctgtggtgaaagagggctctggtctccctcattctaggggctcttcatgtggggtctatagagagaacctgggggcttcatgaattggacccagaaaaaaatacatcttttttttttttttttttttttttttgagatggagtcttgccctgtcacccaggctggagtgcagtgatgcaattgtggctctctgcaacctccgcctcccgggttcaagcgattctcctgccttagcctaccaagtagttgggaccacaggcatgtgccaccacacccagataatttttgtagtttttagtagagacagggtttcaccatgttggccaggctggtcttgaactcctgacctcgtgatccacccgcctccgcctcccaaagtgctgggactacaggcgtgagccaccacactcggcctagaaaatacatctttatttccatcagtgtctaactgcaatgtagcatttccttccattgtaaatgaagcccccacaccggggtaattgcagactgtgacctcgttgcgagtggaaatcacagaggctttcacatctcattcccgttgttacggaggtcacaaacgctgtttggattcatcactacttcaaaatgtcagtggttcttagatttgttatttagtgcaacagtaaagaacagttgttcctgtatcacaaatctggttttaaaaaaagattgtcctggcgcgctggctcacacctgtaatcacagcaccttgagaggccaaggtgggcagatcactttgaggtcaggtgttcgaggccagtctggccaacatggtgaaacctcatatctcctaaaagtttaaaaaattagctgggagtggtggtgggcacctgtaatcccagctactctggtggctgaggcaggagaatcgcttgaacccgggaggtggaggttgcagttagctgagattgcaccactgcacttcagcctgggcaacagagctagactcagtctcaaaaataaaaattaaaaaaaattgcaataactgcacttcaaaataattgttttccttggtccttaaaacatgattagacttctgtccaataatggccttgtggacttacgtctttaaaacattccaaatagatgcctgtattcttgacaagacttccagaggggaccgtggcaaaggaagggttaagcatctgcgtcagactgacagtgtcttgaccggatcctcctccgtctttcccccaccgctttgcacagtgccacatgactttttatttgttttgagacaggatccagctctgttgcccagactggaatgcagtggcgcaatcacgactcactgcagccctgacctcctgggctcaagtgatcctcccacctcagcctcctgagtagctgggactataggcaagtgccaccacacccagctaattctttttatttttagagatggggtctcactgtgttacccaggctggtctcaaactcctgggctcaagcgatcctcccacctctccctcccgaagttctgggattacagacaggagtcacagcgccaggtccctatttattttactctttgtgtgtttccttatatcctgtaaaaatgggtacagtggaaactgggcagtaattctacacgtattctggattttagctactcacatttatggttacttttacctatcaattaattgcttttcttttcactcgagttttagtgattttcactgtccaaaagaatcgtgtatagttgacccttgaacaacacaggggttagaggcactgacccccgacacagtgaaaaatccaagtacaacttttgactcctcaaaagctttactgacagcctgctagtgaccggaagccttaccagttacatgaagtgccgattaagatgttttgtaagttacatatgttatatacaatattcttccaataaagtaaggcagagaaaagaaaatgttaagaaatcctaaggaagagaaaacacactttccgttcattaagtggaagtggatcatcaaaaaggtcttcatccctgttgtcttcacatcaagtaggccaaggaagaggagggttggtctcgctgtctcgggtgacagcggaggaggacgtggaggaggtgggaggggggccagacacactcagtgtaattttactgaaaaatattcaagttgaagtggaaccatattgttcagacccatatttgagggtcaacttgtgtgtgtgtgtgtttgtgtgtgtgtgtgtgtatgtacacacacacaaaaaataatatatataaaaacatgagtcccagcaatcttatccttaatcatttctaatgtggtttcagtgagagaaaatagtcttttcaggccaggcacggtggctcatgcctgtaattccagcactttgggaggccaaggcaggcggatcacttgaggtcacgagttcaagaccagcctggccaagatggtgtaaacccatctctactctaaatacaaaaattgtcctggtgtggtggcgcgtgcctatagtcctagctacttgggaggctgaggcaggagaatccttgaacccgggaggtggaggtcacagtgagctgagatcacgccaccacacaccagcctgggagacagagcaaggctctgtctcaaaaaaaaaagaaaatggttttttctcctcaatccattttcttatttttcaatgacctattatatctttaatgtgtctgaagtttattatatcatataaaataatatttgtttctgtttgttattctttaatactcagtttgcccaataatattgatgatttcttcccccaacatataatatctgacaaatcaggtataaatacatatagctctggatttctgtctataatttcattctatcagtctagtttttcactctaataagtgccacactcttgatgacgtctccttgttttctatttcagtatttgtatagccagtttactattgttgtttttagtttaaaagaaaaaaaaacaacaacctttagtattttggtcacctattttttctgtatgcatctcgtcattttaccaactttttttttttttatttgagatggagtcttgctctctcacccatgctggagtgcagtggcacgatctcagctcactgcaacctccacctcccaggttcaagcaattctcctgcctcagcctccccaatagctgggattacaggcaccgccaccacacccagctaatttttgtatttttaatggagacggggtttcaccatgttggtcaggctggtctgaaactcctgacgtcatgatccgcccaccttggcctcccaaagtgctgggattttagacgtgagccaccgtgcccggccattttaccaacttttataaattaacttgggagagaaatgtatgtttctttgtatttaatgcagctgcacataaatgtatcattctcttcctttgctccaagcattttgtaatccaatttttctacagatggagtttatgctatgttattttaattcccacgtgcttctgtgtttacctctgttgtaaatgagacagatcttttatttcattttgtggatgtttattactggtgtaggggagtttgttattttcttgtgtttaccaagaaacatagggctttgctgaacgcttgattgtcccagcccatttgctcaagtgaatccctgggatttggggagcacgggactgcattacctacaagtagtgaacgtgcaccctgtgtgacactcagaacttctgatcctcttctttcattcctgtgttcagaaggagcattctgttataggtctgggaagaatcgtggaggctcttggtttaagcctgtgtccctttccatgttaatcaaatgctccaatgatttcccctctgtaaattgaactgtgacctggtttttagatgccatgggatcaaagccccgcaactgtgttagatccttctagtggggtagttttctattaggtcggtgcaaaagtaattgcggtttttgccattaaaagtaatggcaggttgggcgcggtggctcacacctgtaatcccagcgctttgggaggttgaggcaggcggatcacctgaggtcacaagttcaagaccacactggccaacatggctaaaccctgcctctactgaaaatacaaaaattagccgggcgtggtggtggatgcctataatcccagctactcgggaggctgaggcatgagaattgcttgaaccctggaggtgaaggttacagtgagctgagatggcaccgctgcactccagcctgggcgagaagagtgaatctccgtcaaaaaagaaaaaggtaatggcaaaaccacagttacttttgcaccgacctaatagtaggattacacttttaaatagtacatttcattccatttttattttacatattttatagattttcttgcttatttaagacaagttgaagcttatgtttctatttactgtgccatttagcatttcttatttctccctaacattattatgctacatataatattgattagtctggcttcaaaccttaccttaattagccttaaaaaaaaaatctagttggccaagcacactggctcacacctgtagcctcaacactttgggaggccaaggcagaaggatcacttgaacccaggaactggagaccagcctgggcaacgtagtgagatcgtctcactaaaaaaagttaaaaattagctgggcatggtggtgctcactgtagtcttagctactttggagactgaggagggaggattgcttgagcccaggaggtcaaggctgcagtgagccaaaatcgtgccactgcaccccagcctgggcaacaaagtgagatcccgtctccaaaaacaaaaagtctagttaatcattgcctttttactcaaaatgtgtttctaccaccctttttggatttttaaaaaatatgtattttatttttatgggtaaatttggcctaattacattttactgatataactcttaacttaaatttctctttattgttgaattgttgatccttttcttttttctaattcacagtatctctgtcctaggctttctgatctatttaaggaagattgagtgaacagcctaattgaccctctgaatgtcccctgagccttctaatccgccctgccttgagcctcctcttgtaactgaaattcactttctgatgcagaaccattgagcccttctgaaaccttttcaaaactatatatttaaattttcttatcaaactgtactgttattagattacatgtctagcatagcagcaaattatacttcattatattaaccttgccacttccctctacaatgagacccgatcttttataagatactctggacctacaaattcctgctggtgaattctttaaagttatatggattttcaacgatcgtctactccctttacaaagcagctgctgtttagcaggattatccattagtggtaagaatcctttattccctagcatatggtaaatattttttaccaacttgaggtatgccacgtagatcccacgggatttacacacatagacaaaggcattcttctcatcacattgttttaaacaatccagctgccattttagctttcactaaacttagaaatgtatcagcttggccgggcattgtgggtcacacctctaatctcagcactttgggagatcaaggcaggcggatcatttgaggtcaggagtttgagaccagcctggccaacatggagaaaccccatctgtactaaaaatacaaaaattagctgggtgtggtggtatgcacctgtaattccagctactcaggaggctgagacccgggaatcacttgaacccgggaggcagagtttgcagtgagccgagatcgtgctgctgcactccagcctgggcaacagagagagactacatcttaaaaaaaaaaaaaaaaaaaaaaaggaatggtatcaactcgacacccagggtccttctgtaagttaaaacctgggaagtgccctaccctggcatttgaaaagtggctgaatccaatttcctgtccagaattacaatgacattgtattgatacattgatgatcaaaagcatagctaagctgtaaggctggttattggatatacatcttccaagtggagagattattaccacctgaaacagcttttggcttgtccattaagactcctttccagccaggcatggtggcccacccctgtaatcccagcactttgagaggccaagccgggggtactgcctgagcacagaaattcgagacaggctgggcaacatagcaagaactcatctctactaaaaattaaaaccactttccaaaatgaattttttttttaagacaggatcttgatctgtcacccaggctatagtgcaatggcacagtcatagctcactgcagcctcaaactcctgggatcaagccatcctcctgcctcacccccttaagtggctggttctacaggggcacaccagcacacccagctatttttttttttttaatttattgtagagacggggtcttgttacattgcccaggctggtctcaagctcttggcctcaagcgatcctccagcagtcctcccacctgagcctcccaaagtcctggaatgacaggtctaagccactctgctcagcccaaaacaaattctataaccaaaccagaaaagttgttttttgtttagctttttaccttaaaactttcattacccctacttccaacaaagtatttgaggtggatttaacacaagacacagcatcaataaagctcttaagtgaagtctgagatttaaaggagcatagctcagtggggaagatgacttctaaggcttggctttgaataaagcccaactcttcaatagcttggtgtgactaagacatgctctacctatgtgggtttgtttttttgtttgtttgtttgtttgtttgtttttggagacagagtcttgctctgtcacccagggtggagtgcaatggcacgatctcggctcactgcaacctccacctccgggttcaagcaattctcctgcctcagcctcccaagtagctggaactacaggtgcacaccaccatgcccagccagttttttgtattttagtagagacggggtttcaccatgtttgccaggctattctcaaactcctgaactcaggcaatccacctgccttagcctcccaaagtgctaggattacaggcatgagccactgcacccagcctctatgtgttttttttattgttaagagttcgaggctgggtgcagtgacacacacctgtaatcccagcactttgggaggccgaggcgggagaatcacttgaggtcaggagttcaagaccagcctggccaacatggtgaaaccccgtctctactaaaaatacaaaaaaaaatttagctgagcgtggtggtgcacgcctgtaatcccagctattggggaggctgaggcaggagaatctcttgaacccaggaggcagaggttgcggtgagccaagatcatgccactgtactccagcctgggggatggagcgagacttcgtctcaaaaaaaaaaaaaaacagcattactatgccaccctgatacactgcttggctaggagggaaaacttcttgttgcaattaacctttctatttttttcgctacgtctaagtattgtgaacttcctttgtggtattttagtgattagacaggatggagggcgttcttaaagattcatggccaaatccaatgatgtcagagtgaagggaacggacggtcttcgtggggccagcaagtctggccccatctgaattgtttgtctaacacttcacaagcagaataggaaccgctgaattattcattttcaagttgccctaaaaaaggtacttagcctgccgaaaggcagactttcggtgccagcgagaggaagaggaaggatgctgtctttcctatgaacgttctcgtgcctccactgcctgggtcttcagtttcacttcccagccctgcggggtacaggaaaccaccagctaacttaagtgcaaggcaattaagcggggagggaattgtggacaaatctatagaactctgaagccacaggtgagccaagcattgactttactggggaaaaaccaggtggaagaaggttgaaggagcttgggttggtcagaagatgccaggatttgggacctgagccagggaggtgggcccaggaagtgggattgggcttggggatggggaaggagaggaagctgagagcgataactagtatgcaatcagaaattttttttattcttagttttagcttctctgcctctgccaccaaagctttgttttggtttttgagacaggctctcactctgttgcccaggctgtagtgcagtggcacaatcttggctcacttcaacctgtgcctcccgggttcaagcaattctcccaccttagcctcccgagtagctgggattacaggtgcacaccaccactctcagctaatttttttttttttttttttttttgtatttttagtagagacggggtttctccatgttggtcaggctggtcttgaactcctgacctcaagtgatccacccgcctcagcctctcagagtgctgggattacaggcgtgagccaccatgcctggtcccaacctttccttaacacttcctaccacacagtacttaggggagaaagtcattagaaacccttgtacttgggagtaaaggccaggcttttagtagagacaggttgcctaccatgcccttgagcccatgcaccactgcgccgccctgcacctcagtttccccacttgtgaaatcctagcagtcttcctctgtaggtctgcactgctcccctgtggtgtgtcttttgtgcagcgcaggaggcagatgagagagagaagcccgcgtcttgtccaaaatatgatttggcgcattcttgggcagcgtctgttggaggtacaggcgggatgctcacaggtgaagtaaaccaggaatggcaaacagaacctgaaaggtggttctgaaagagagaatgcagaaactgggcaagcagtactcccacctgtaggaaggtttgctggcgaagtttcacactaaaacatgaaggagactgttaaaaacaatgggtatagatgacagaacagcatcccttcctaaacagcctttaaaagtctgaaactagggccaggtgtggtagttcacacctgtaagcccagctagttgggaggctgaggcaggaggatcacttgagcccaggaatttgaggctgcagtgagccatgatagtaccactgcactccagcctgggcaacagagcaagaccctgtctctacaaaaaataaattagccatgtgtaatggtgcacacctgtagtcccaggtattcaggggatcgagacaggaggatcacttgaagacaggagttcaagaccagcctggccaacatagtgagaccttgtttctgcaaaaaatttaaaaattagccgggagaggtgatgcacacttgtagtcccagctacttgggaggccgaggcaggaggatctcttgagcccatgagttcaaggctgcagtgagccatggtcaaaccactgcactccagcctgggcaacagagcaagacccatctattaaaaaataataataataataaaaacaaatctgaaagtaaagaagtaacaaccggtccccatttcctgccaggttgttgtctacccgtgattcctggcacagttggggcaagtccccggagtgcaggagccatgttgcctgcgtctttgtaactgtcccatggccagggggctcaatggatggcaggctgccggcccacgatgtcaacagcaggaacttgtgcctcagtttcctccatcacctaagtgtaggcctctcaccatgacagttcccttcctgggtcagatggtacttggggggttcccttccagaattcattttcttcccattctctgttcttggctaacaatctttttcttttttatgagacagagtcttgctctgtcacccaagctggagcacagaggcgcgatcatagctcactgcagcctccaactcctgggctcaaacgatccacccacatcagtctccaaagtagctgggaccacaagtgcataccaccatacccagctaatttttgtattaatgttttgtagagacggagcttcaccatgttgcccaggctggtctcgaattcctgggctcaagcgatcctcccaccttggcctcccaaagtgctgggattacaggtgtgagtcactgcgcctggcccaatcattttctgtgtcaaagaaaaacatatatatggtatattattttttaaagtcacattcttcttatagagatgtgctctttgtatacatttttttccccttggcaagtgggtaaacgggattccgggaaggtaactgtcttgactaaagttagcagagtctggcatcaggtggaccgcacaggacggccacttcttcttttgtttttttgttttgttttgtttgagacggagtctcaatctgtctcaccaagactggagtgccgtggtgcgatctcagctcactgtagcctccacctcctgggttcaagccatcctcctgtctcagcctcccgagtagctggaattacaggcatgcaccaccccacccggccaattttgtatttttagtagagacgagcctttaccatgttggccaggctggtctcgaactcctgacctcaggcaatccacccacctcagcctcccaaagtgctgggattacaggcgtgagccactgcgcccagccaggacggccacttctaatccatattcttttccacagctgcagccacagccatgcagcgtcctttagattctccttcttcttgagtatttttatgtcttgcttatcaccttgtttcattgcaaatggaatagtagcagtcagcatcagtgcacgctttacaattaatgagtgacgatggagggatacctgactactgtgatgctcttcactttttttgttgtcttattgggttttttgtttatgtttcatatgttaaatttccgacgtacgcgtgacctggtgtcagcatctcccgttcatggcccatcccgtctcacctgtccccactcctgttttgacttgaagctactcccagaatcctttcatttcctttctaaacattttaacacacatatcctcacaataaggactttctttttaatatagtcacagcgcaattagcacattcaaaaataatttttcacctgcagtcccagcaactcaggaggctgaggtgggaggattgcttgagcccgggaggttgaggctgcagtgagctatgatcacaccactacgctccagcctgggtgacaaagcaagaccctgtctcaaaaaaaaaaaaaaacagtaaaaataataatcataataattttttaatatgatcaggtaaatctagccagttttgaaatttctagttgcccccaaacttcataatggttttattttctaaaattattttaatttaggctgggcgcaatggctcacgtctgtaatcccagcactttgggaggccgaggtgggtggataacttgaggtcaggagcttgaaaacagcctggctaacatggcaaaacctcgtctctactaaaaacacaaaaattagctgggtgtggtggcacacacctgtagtcccagctactcaggaggctgaggcagtggaatcacctgaacggagaggcggaggttgcagtgagccgagatcgcaccactgcactccaacctgggcgacagagcaagactccgtcttaaaaaaaaaaaaaaaaaaaaaaatttgaatctcgattcaagtaagatccacacgttgcagttggctggtgtatctttaagtcttggtcattgtatagattccctcttcgtcactttttcttttccttgcaatgtatttgtgctagaaatggggtcatttgtccagaaaagattctccaccccactgctgagattttactgattgcctccccagaaatagtttatcatgctcctctgtcctcatgctttcctgaaaatttgtggttgaatctagaggcttgatcagattcaggctagaagtttttggccaaaagcccctttgtgggtgattgtgatgatctcgcgatggtgtcaggtactggaagtgagcgctcaccagaagagaaaggtcctgactttgatacacaatcataatgaatccaggcatggagcttggtggtttacaaaatcttttcctttctttttgtgttcttgttttatcctcatgctaatttctttgaatttcatggctcctcctgtataggtgactgtccagctcagaagtctgtccaaggtcaaacaactaaaagacaatgggagggccgggcgcggtggctcacgcctgtaatcccaacactttgggaggccgaggtgggtggatcatctgaggtcaggagttcaagaccagcctgaccaacatggtgaaaccctgcctctactaaaaatacaaaaattagctgggcatggtggcaggctcctgtaatcccagctactcatgagactgagggaggagaattgcttgaacctgggaggcagaggttgcggtgagtcgagatcgtgccattgcactccagcctgggcagtagagcaagactccatctcaaaaataaataaataaaaatttttacaaaataaaaatgcagtggagaagaattccaacccattttccaccagccacactcttttctgtagaccacaattttcctaatttcacttgattttaaagaacaaaggaacctgcacacccagcctgctctccacttctttgggtagagcagggctgttagaactctagagagatgcaggaagcagccgccgatgaacccagatgctcatccctggaggcactgtgcggtctcaggagcagaagccgaatgaattatgcaatatcagagcctcattccctgggccgcagctgtcccatgttccctgcctggagatgactgaagcccgagtgacagtcacaggctgttcccgatcacgctggggtcacacgctctggtgagcacccagccggccagagctgtgctattggtttggcacaggtagaaagttgaccccgcacgtgccgtagaaggtcatttcgttcggttcatcagctatactcggactggctaaaggaagattttattgaaatcgtttcccatgaacacgtcaacttgtggggcaggaagggaaattttcttcccgtttgggattgaaaagatgaggcttaaccaaactcgttcttatgttcgttggtttgttttttctttctttctttcttttttttaaacagactctcactctgttgcccaggctggagtacagtggcgtgatctcggctcactgtaacttccacctcccaggttcaagcaattctgccaccccagcctccttagtagctgggattacaggcgcacgccaccacacctagctaatttttgtatttttagtagagatggggtttcaccatgttggccaggctggtctcaaactcctgaactcaagtgatccacccaccttagcttcccaaagtgcttgggattacatgagtgagccactgcgcctggcctaaacttgtttttaatcattacttttgtatcatttaaattagtataatggtaatctacagagaacaaattctggttaatttctgagcagacagaggtgacatcctggccgtttaactgtctctcggcacagtgttacttccagcaaaaatgaaaaccgctatttccagaaggttatctgtagggataaagctccacagactggaccgactctctttccaggcctttgattggggaggggtggggccaccgtggagtgtgacacatttgatccggggcttggcagatgcaagatggcttcatcctcccctctacttctgccaaagcagaagtggtttaaccttgggtggaaaacgaaagatagggcaagtcatacagatgagggctgccaagaaaacctttccccgaaaaacactctctcctcccctcctccccttccccatcagcctccgtgtcttcagtcctgacctggttcacagatccgtgttgggcacggggatgagtgatgagtggtgagctgggccacctggttctgcactccaggacctcacggtccattggacaaaaagaagcctaattctgggtctttcaatacttctcccccaagactattattgccttgtttttcagaggctctgaaaagcgaatcattttccttctgcaataacatcttgtaggctctttccttaaaagttgtatttacaatttgccaaaagaattctaccctttctgccctttagaatactagccagtgaatggctgtctgtcaagaagacaggggacctcaggtatcacaggtgtcattaatttgcatatttgggccggtgcggtggctcatatctgtcatcccagcactttgggaggccaaggcaggtggatcactggagatcaggagttcgagaccagcctggccaacatgatgaaacctgatctctactaaaaaaatagaaaaattagccgggcatggtggcgcatgcctgtactcccagctactcgggaggctgaggaggcggaggttacagtgaaccgagatcgccccactgccctccagcctgggtgacagagcgagactccgtctcaaaaataaataaataaataaataaataaatttgcatatttggtcaaccagtattttgtgagtacctgctgtgttccctggaactatggcagtggataagcaagtaatcaatatatgaacaagagactttgagacgggaataaatgcaacagaaacaaaatgaatggacaatggagagtgtggctgtggagaggcctctcagaggagggccaggagggctgagacccaggcctgtaggtgggacaagcatggtgcttccaagaaacagaacaggactaaagaggctgggcacggtggctcacacctgtgatcctaacaccttgggaggccaaggcaggcagatcacctgaggtcaagagttcgagatcagcctgaccaacatggtgaaaccccgtctctactaaaaatacaaaaattagccaggcgtggtggtgcacacctgtaattccagctactagggaggctggggcattctcaagaatcacttgaaccccgaaggcagaggttgcagtgagctgagattgcaccagtgcactccagcttgggcaacagaccaagactccgtatcaaaaacaaacaaacaaaaaaacaaaaaacaaagaaatgcccatcttttattttaaaaatcttaataaaatagggatatagttggatatttcattaataaatgtatatatataatgtattttatatataactacacattaatgtatgtgttatatatatataatatattaatatatatatattatatattactcaagaacatgagtaagttcttgagtggtgatttgtgagatttaggtgcacccatcacctaagcagtatacactgcacccaatatatagtcttttttccctcacccccctcccaccctttccccgcaagtccccagagtcctttgcattttcatcgcttagctcccacttacgagtgagaacatacaatgtttggttttccattcctgagttacttcacttagaataatagtcttcactcccatgcaggttgttgtgaatgtcattaactcgttcctttttagggctgagtagtattctgtcgtgagataagaaatattcaaagggtgtgggaagagactctgccgtctttatttgcagatgtggtcacaggatgcctcgcaaccccgagagagccactgaaaagttgttacaaaattgaacaggcttccatttccctgtggcctctctctctagacagccgtacctctctatcccagtgtcccctgctcagtaaatctgtactcatcctccagggtacagactggatgtcccctactccgggatactgtttctcctggtgtctgcagaggcccttgtaccactttctgggatgtcactgtgctgaatcgctggtggctgccatttccttccgcctcccactgggtagacaggaagggggtccctgcccacccacccacccatgcccggtatatccctgctgagctcctaggatgtgcagggtgtattcctgtgtgctagcgagaagggagtcccagcgccactacgccattgcccactcctcccctgggacatttgtttcccttgggtgtggttcatggtaggtgccccatgggcgttattggtgggagacctccctgtctcagtctgagctgggcccatcgccatcagggcacgacagccacagcaggtgcctttgctgggagtaatcttgccctggctcgcatgagactgcagaccagcccttctccgtaagttcaggcgtttgtgctccgatcagcttttcctataggtttgtcccccaccccttgcccaactctttgaccccccgagttaaggggattccagacctagagccaagtgaccttcctcagagcctggccctgtctccaccgcttcagcaacctgctctttctggacagggtccagcgagccccacctctgtccgtttcctctaccccctgtgctaaggaagcctcacctgcagtgtaggttgtggtgaaaaatgtccccccttaaggacagagcaggtcatcacgtgcagccctggggtagaaggggagagttcgcttgatcaaacctaactggagcttttcttttaaagcaggaagaattaatctgtagatatttctcctttcaatgccaaagaactttatgatctggtattgagactattggtgggttttttttgttttctttgtttttttgttttgttttgtttgagacagggtctcgctctggtacccaggctggagtgcagtggcacgatctcagctcacttcaacctctgtgaccggggttcaagcgattcttccgcctcagcctcccgagtagctgggattacaggcgctcgccaccatgcccggctaatacttgtatttttagtagaggcagggtttcatcatgttagccaggctggtttcaaactcctggtctcaagtgatccacctacctcggcctcccaaagtgctaggattacaggcgtgagccactgggcccggccgagactattggcttatgaatcaagtctaagaagatacactagtctttgaaggccgctctgtatgtttttccaactgccttgtagatatactttgttttaacagctcgttttaacagctcctgatgccagcgtgcttatttgggtattgaaatatgcgccaacaccgtgccccgatgccacgcgttagcccccaggaggcttgcgtgaaagtaaatactagaatttccagcgtggatataatttcccttccatcgaccttgaccatgtccttttcagttcctcataaaaactgtgtgttagcccagagaataccctgaaatgatctgtggtgaactgattgaacgaactacatattctaggccaaactgaaattattcgctatttgaagtcagagctgagcataataccgggcaggttaatagatcagtggaagctgtttcgtcagctcataaaaacgtgagagatctaaatttttataataaatcattttgctgagcaaacaatatgtgcggttattacagactttggaaaataaatgattttagaccaatgtcaggctgcagatactgatgtggttagttgagccttcagcatgaagagaatgaaaaatctttggaatactgttgacactcacaccatgaaaccacatgccatttaattcattactgcgcttccaagattacatttacagttgtggtattaacccctgggcatttttgtattacttattgcagacagtttgtcaggcaggattaattcagtggggggaggaggcagcagtttggagagaaagtggatgattaagactggggtggggctgggcgcgtcggttcacgcctgtcatcccagcactttgggaggccgaggcgggtggatcacctgaggtcaggagttcgagaccagcctggccaacacgataaaaccccgtctctactaaaactacaaaaattagccgggtgtggtggcgcatacctgtaatcccagctactcggaaggctgaggcagggagaatcgcttgaacccaggagatggaggttgcagtgagctgagatcatgccattacactccagcctgggcaacaagagcgaaactccatctcagaaaataaaaataaaaatacaaaaattagctgtgattgggtgtgcctgtaattccagctacttgggagaggctaaggcaggagagtcacttgaactgggaaggcagaggctacagtgagttgagattgtgctactgcactccagcctgggcgacagagtgagactctgtctcaaaaaaaaaaaaaaaaaaaaaaaaaaaaaaacctggttgggaggtgccccaaagcaagacccgcctccttggtcctggtctgcaaacactgatggccacactcacatcttccaaagcccccgatcgcacttactcagctagttgtatttttctttcggcttttaaaaaagaatacctccttagaaaaattaataatgggccaggcacagtggctcaggcctgtaatctcagcattctgggaaactaaggcaggaggatcgcttcaggccatgagttcaagaccagcctcggcaacatagcaagatcaactttgtctctacaaaaaagaaaaaactagctaggtgtggcagtgcatacctgtagtcccagctactcgggaggccaaggcaggattgtttgagttcaggagtttaagaccagcttgggaagcattgtaagacccctgtctctaaaaaacaaatttttcttttaaattagctgggcttgctagtgcacacctataagtcccagctactcaagagactggggcaggaggatcacttgagctcaggacaagagttggaggctgcagtgagctatgatcgcaccactgcactccatcctgggcaacagaaccagaccctgtatcaaaaataaaaaagaattctcagaaaaatgagtaacaaacatacagatttttgtttgtttgtttttgtttgtttgtttttttgagacagggtctcactttgtcacctaggctggagtgtagtagcaccatcttggctcatgctcctcctgcctcagcccctcaagtagctgggactacaggcatgcaccaccacacccggctaatttttgtacttttagtagaaacggggtttcaccatgttggccaagctagtctcgaactcgcgacctcaggtgatccacctgccttgccctccccaagtgctgggattacaggcatgagccactgcatctggccgacttttaaaataataatcagagcgtttcctcgccaactgcatccctggttcctcccattgtctcctcctgtggtttctggtcccttctgtgaatggagacagcagcccctccgagcctggctgtcaccacaatccctggtatggaataggcctgccctgcaactgcagagtgtggtgtcgtcattgtcattcgaaagcctggggaaagagagttgcttttgtcatgaaaggtaagtgcagtccttgttatcacattcagtattttggtccgtttagcagttgcttagtaaccaaagcacaactgaccaggagatggaaaacttgaaattcacttccaggattgcctcacactgccaagtctgcaccttcccgcgtcagtgggactgatttttttataaatgatgtgaaatcttctggagatgaggcgtggttttccggatattcggtgtcctgatgaaaatccaaagccatgtgctatctgagaagaaatccagagagtgtgcactttccaggaggtgcccaagccccacccaggccccataaacctggcaggaactggactcgacccacatggaccccagccctgccaagccggcctctgtgtaaagctgggcccctggaactttgctcttctctatgcctgggcctttggccactggcaacaccaggtcgcaagtgaggagtggatgaaagcagccaggggcgggccagcacccccaggcagccacgcctccagcttttcagctccgcactcccaagatcagggagctgcacccagggagacggtgtcctcctgttgctgctgctcccggaagagtcaaggctaagtaagctacctggccagagggttttcctggttgccaagcagcagggaggagtcatcggcaaggcatctcagagatgggggccatccccttcccttccttcctatgttcggcagaaaggcattgaatgcctaccgtgtgtttttctccttcaattcgcttgagagacacgcagcagggctggcttctctgtcctcccaccgtgtacattgccagaaagagcggctggtatccctggaggacccaaacacacaagcaaaaacagctgggccccagaggagggcagtgcttctgaaagacacacccagaccccaacagtgggtgtgatatgaggcaggacagctgggccacaaagacaaagcaccacaaaggcactcagggaaacagaggaagatattggcagtgtgaagcgaaaccaacaggtaattttcaaatggaccaagtggaagtaacagcgtaaaaaaattgaataacttaggagcaaagaagaaaggatacattgccagctgggtctgatggctcatgcctggaatctcagcactttgggaggccaaggccagagggttgcttgagctcaggagttcgagaccagcctggcaacatagcaagaccccatctctataaacaaaatgtttttaagtaaataaataaaagaatcaacacaagcctggaaaataaagatgaagatatttcccagaaagtaactaaaaagatatagatgtagatgttagaaagaaaagaaaattagagatcaattcaggagctccaacatccacctaataggaattccagaaagaggaagtagaaaatagttcaggtgcagtggttcacacctataatcccagcactttgggaggctgaggtgggaggatcgcttgagcccaggagttcaagaccagcccggataacatggcaaacccccatctgtaccaaaaaaaaaaaacaaatagaaaaattagctaggcatggtgacatgcgcctgtagtcctagctgttagggaggctgaagtgggaggatcgcttgagcccaggagactgaggctgccttgagtcgtgatcacaccactgtactccagcttgtctccaaataaataaataaataaataaataaataaatagctaaagaccagttagatcaagttaaccttgatccagaaggcagcaagaaaaggataaagaaatagcaaaatataaaagaaaagttaaatgacatggaagacagaagtagctatgccaacaatatccaaataacagtagtctcaaacagaatagaagtattcaaatgaaaatagccagaattaaagaaagagagggcttatataggggcacactggagccattaggaaaagtgctcacctagacccacattcagtgtctcttcactcaccagccggaccagtccccatccacctcccaagttctgcagccagctctgctgatgcattcagaggaggatttaggcaattgtcaacctctgcacatcttgttgtgggtacgcagcagctatgtattttcattgtcatcttttaaatctatgacatagatgagatacgcaggacctaagcctgcatctctatgtgcccattccagcaccaggaaacttttaggggtctgaaacactagtggagctagtgaatgagtgaatgacggtagccagggcagttttgacctgtgtatgtggacattggaaatacacgataggtaactaactgaagtacaaaattgtgtttaaaacttgtgatttgggacaggcgcagtggctcatgtctatagtcgcagcactttgggaggccaaagcgggtggatggcttgagcccaggagtttaagaccagcctgggcaacatggtgaaaccttgtctctaccaaaaaaaaaaaaaaaaaaattaggtatgctggcgtacaccactagtcccagctactctggaggctgaagcgggaggactgcttgagcccaagaggcagaggttgcagtgagccaagatcacaccactgcactctagcctgggtgagagtgagaccctgtctcaaaaagaaaaaaaaaaacaacacaaaaaatccttgcaatttgccttaagtaaagtttgcaagcttttattttgtgtctgaaggagtttacgctctgaattcttcaacagggcgtcaaggtagcagctttctgcattgactggtgattatccttttctgatatgttttaagacccttaacacttttaatttttttaattaccatttgtagtattagactatctttgcacagcaatttttctgtcagatcttggaggtttcactttgagatgatacagaaggatgtttcatcatttaagaagccctgacccttccccactccctgcacccagcactgtattgcagaggcccagtttgggtatttatcttacagagacgctgccttcttcatgaaatcgtcctaaaaatagcttcatttaactaggccatttgacaggctttttcagactttttctcagaccagtctgaaagccggatattatttcaaacagatacaatgaacattgaacccgatcacaaggcatctgttaccctattcaggctgctgggagttgataagactacctcaaatcgctgtgtgtagttaaaggctgcaaaagcctcaggccacaaaaattccccagcccaggggcccggagacagtttttccaactctcagcgtccagggtgtaccttagcctgttttctgttgctgcaacagaacacctgaggccagggtgatttataaagaagataggtttatttggctcacagatctgcaggctgggaagttcaaggacatggccctggctcctggcgagggcttccatgctgcatcataacagtacggatagggtcaaaggggaggtggatgcgtgccaagagggacaacccagggaggttcctggcattatgataacccagtctcaagggaactcatccagtccctaaagtctggtcagagcaagaactcattcactgccaggagaatggcaccaagccattcatgagggcatccactgccatgacccaaacacctccctctagaccccacctcccaatgcccccacactggggatcaaatttcagtagcagttttggtggagacaaaccatagcagggtgggtgggtactctcacttggacgtgcctccttgggaccatggagcaggtttcggaaggatagaactctcattgtcaggcctgtccagcaccctgggctgtccccaggagtagacttgcccgtcacagacaggatgggccacatccaggactctggcatccaacgtgacgtgcagccctgtgaatacaggacaaattctagggatatagggcaaaagggacctatggcccagcattcagagagagctcacagcgtgggcacccagtgaaaactcaaacctggaaactaggactagggacagtgccacttcctgagacagagctgctgagagggtctgggaagggtggatggggtggaagtaggagatgaggttccctgggacgagaaggcattcaggcaggcggcgcaggtggaggcctagtgccgaggaaggcctggctctttggggtcccgcacgagatgggagttgttagagcacagggtcctgagaaagagtggcgggtaaggccaagaggaggaaggagccttggcatggaagggccttgcgtgtggctgagggagggattgcatcctgaaggcagcagagtgcaggtgcatgtggactcagagccacagcatgagagccctcaaccccaaccaggtccctgtggctgtaacattggctccatggcccttgggtatgctaaaaaaaaaaaccttccttgggtcacagacagttccagcctgtggccttctaacagagaccatcctcaggacctgcttgcagacattggggtggtggtctgcccgggtgtgctgctctaacctcccataggcttttggagttggccgtgcccttctcaaaaggactctccaggccgggcgcggtggcttatgcctgtaattccagcactttgggaggccaaggtgggtggattacctgaggtcaggagtttgagaccagcctggccaacatggcaaaaccttgtctgtactaaaaatacaaaaattagccgggcgtggtggtgcacgcctgtagtctcagctactcgggaggctgaggcaggagaattgcttgaacccaggaggcggaggttgcagtgagccgagatctcatcattgcactccagcctgggcgacagagctctgtctcaaaacaaacaaacatacaaacataaaagcactctccgcattcctctctcatgatgctctgtgttgggttcgcgtatttgccttcagattactcaaggaagtactttcaaaacagaaaaagggaaagacagaacctggacaattgcttttacgaccaggctgggccatagcaatgaacccaggctgtctgcactgcagcctgtacagtcccccaacctgtgtcaccatcctcacctgccctcctcacctccagttggccaccttctcctggtttcctcattcctggtgaggctttcactgccaagtgccttttcctaaagtagcctttccccagctcctcctctcacccccagcctggcaaacttctactcatccttcaaaaccccacttacctgtcacctcctctgcagccttccttgattccctcccacaaagagaatttatttctccctctttttttcagagcactctgctcagagctctttttgaacccttggcaggacatgctgtattttatatttttatggttatgtctccccaatgagattgggaccccatcaaaggcaggcaccccatacgcaccagacacatgattatcaaaagagcgcatggcatcagcaagcacatctcttcccccagtgtgagcccacctcctcctgctggacagcattgactcacgggtctgcacagcccttcccgagccctgagctaggaagctgtcccatcagtcaccccctgagccggtctccttgtgactaacctgctctctccctctcaccctcctagggccgacgagattgaaatgatcatgacggaccttgaaagggcaaaccaggtaggaccctggacgcttttagtcctaaaacccacaatagcgggcccgtttctggcatctcggaagatgcgtcacccgaagttagaaggccggttatccttccattttttactgacagctttcaacgtcgatgctccttctgttgtcatgagaagtaggaaaagacataaaaagtcctaggaaccatttccttggcaaagtctttgatgtggttccaacatctcagacatcccatggtgaacatcccctccaaagtggtaactgtctccttttccctactccatctctaaacacccgtctttgtagctgtggcatccatgacagtgtagacatctcaccatggaattatcctcggagagttccttagtgtagacatctcaccacggtgttatcctaggagagttccttagtgtagacatctcaccacggtgttatcctaggagagttccttagtgtagacatctcaccacggtgttatcctaggagagttccttagtgtagacatctcaccacggtgttatcctaggagagttccttagtgtagacatctcaccacggtgttatcctcggagagttccttagtgtagacatctcaccacggtgttatcctaggagagttccttagtgtagacatctcaccacggtgttatcctaggagagttccttaccgccacgttctcatgggtcgcagccacttgctccaaagagggctctcagctgacggcccctttttggctgacacttggtgctcagagaggccttatggcaagtacccagcacagtgtccggcccagatcaggcacaggacgcatcttaaccattagcgtacttttgggtgattctaaatactctgcttcctggaaaattcagccatccccaaaaccccttcctccccccaggagcccacagaacaggaaaacattttgctttagctggtgctgctgttgctctgaaaagaaagtggtcccccagccgggcacagtggctcacgcctgtaatcccagcagtctggggggccaaggtgggaggatcacttgaggtcaggagtttgagaccagcctggccaatatggtgaatccccgtctctactaaaaatacaaaatttagcaaggcgtggtggcaggcgcctataatctcagctactcaggaggctgaggcaggagaatcacttgaaccctggaggcagcagttgcagtgagccaagatctaagcctgggcaacagagcagaaactccatctcaaaaaaatacaaaataaaatttaaaaataaatttttactacccagccttgggctgggtgtagtggctcacgcctgtaatcccagcacctggggaggccgagatgggtggatgacttgaggtcaggagtttgaggccagcctggccaacatggtgaagccccatctctgctaaaaatacaaaaattagccgggtgcggtgacatgcacctgtcatcccagctgttcaggaggctgaggcaggagaatcacttgaacccagaaggcagaggttgcagtgaaccaatcatgccaccatactccagcttggatgacagagcgagaatctgtctaaaaaaaaaaaaaagcagttactggaaggagttaccttcatcatagatcactattcctatttctcaagtttccaccgactccacctctctcctcaaggccagtcttgggcatgccttgcctttagatggcactttagggcaatctaatgtgcccaacaggagagcctggtttgttaaacgggagagccttatcctgtgaatatcagtgctctatccagaacaggttctctgtggtctcagaggcagtccccagctacctaagaagtttggcaaagcgaatgcacttctcaaggtgccaaagccactcggtggaccccagtcttaggagacaccagacaaggctgtagggacaggtgctggctccgcaatgacacgggttcagttcctaactcggtatttcctgtgtggccttgacgggtctcttaatctcttaaatttcttggtcataaaaaaatcaaaagaaaagtgaaccttgaggccattatgccaggggaaatacgccagtcacaaaaaaagacaaatactgaatgattccacctgtatgaagtatctagaggagccaacttcagagagacagaaagtgccacggtgactgccagggacgaggagaggagggaaatacgaagttgttgttaaatgggtacagagttttggttttgcaagatgaaaacattctggggattcattgcacaaccacgtaaacgtccttgacgctactgaaaagtacgctaatggttaagatggtaaattttatgctttgcgtagtttgccacgatttaaaatatgttaaaaaattttttgaaagaaaggaagggaatttagctaatgcttcctttgcaagattgtttcgaggatttgaggtaaaatgccagagtaaaaagtagatggtggccgggcgcagtggctcacacctataatcccaacacttggggagaccgaggcaggcggatcacttgaggtcaggagtttgagaccagcctgggcaatttaacaagtcccccatctccataaaaaatacaaaagttagctgggcgtggcagtgtgcctgtagtcccagccactcgggaggctgaggcaggaggatcgcttgagtccaggaggtagaggttgcagtgagctatgattgcaccactgcaccccagcctaggtgacagagtgagaccctatctcaaaaaaaataaaagaagtagatgcctaaataaatgttagttccgtagctgctgaagaagctcaggttttgggggaattgtaaagtcctgccttcaggaaagggtggtgaggggtagaggtgagttctcaccaacaactcagccagagtttatagcctgatacggctacattaatagaaatacagtttctagaatgaaggaggtggtgattctgctcattggcagcaaggagtccgtgcctaggaaattccattttttaaatttatttatttttcttctttgaaatggaattttactcttgtcatctaggctggagtgcaatggcacgatctcagctcactgcatcctccacctcatgggttcaggcaattctcctgcctcagcctcccaagtagctgggattataggcgcccaccatgcccagctaatttttatagttttagtagagacggggtttcaccgtgttggccaggctggtctcgaactcctgacctcaggtgatctgcccaccttggcctccctaagtgctggggttacaggcaagagccaccgcgcccagccggaaattccattttagactggaagccacagtataaggaaaacagctccttggagtgcattcagagatgactccatggccaggacagggaggggctctaacataaaaagaactagggggttcggagacgttcctaatcttggggtagcagggaaagacggcagcaccactggacagcaggagcaagaggaataatttcaggaatctgggacgcgaaaagataagggggaagggtcatgggggcatttgtgggttctgtccttgtagttctcaagagccgaccagaaagaaaggccaggggacggagccaggctttttctgagagacccctgtagaccccagccaagcatagaggctggcgagaggaaacttttttgtttttgcttctgagacagtcttgctctgttgcccaggctggagtgcagtggcacaatctcagctcactgcaacctccccgtcctgggttcaagtgattcccctgcctcagcctcccaaatagctgggactatgggcatatggctccccatcctgggttcaagcgattctcctgccacagcctcccgagtagctgggactacgggcatatggctccccatcctgggttcaagcgattctcctgcctcagcctcccgagtagctgggactacaggcatatggcaccacgcatggctaattttcttatttttagtagagataactcctgggctcaagcgatctgcccacctcggcctcccaaagtgctgagattacaggcacatgccaccacacccagctaattattgtgtttttagtagagacggggttttgccatgtttgcccaggctgctcttgaactcctgggctcaaacgatccacccacctctgcctcccaaagttctggggttacaggcatcagccaccatgcccagccaggaagcttattcccagtggtctggctctccagagttgccacgctgaaagatgcttgctctggagagagtgagctccctgtcaccagagctatgcaagcagattcaggccagccctcccagagagcatgagatggggaatcacgcacagagtggaccgaaggagggattgaacaagaaggctcaaagggtcccttttgaccctgaagtctaggatttcgtgaagctacaggtgaacccattggcatgagaagcatccagggaggaaagatgcaagcccttggaatatcgagagaatatttccagcaggaaaagaagtggaaggttaaaggaaagccagagaaggggacgttgccctgggccatcaactaagagaaaagctgcccagagccaggcatggtggcggcggtgcctatagtaccggcagttggagaggccgaggcaggagcatcacttgagcccatgagtttgagaccagcctgggcaacatagtgagacttttttctctacaaaaaagtttaaaaaaaaaaaaatagccaggtgtggtggtgtgcacctgtggtcccagctaacccaggaggctgagatgggaggatctcttgggcccgagagttcaaaaccaacaccagagatgcgggtcagagagtgggctggtaggacgggacctggccaggcctgtgggagggtctgagtatgaaggattcatcctgggagcagtgaagaatcgtaggcgggattgagacatcaggtttgagttctagaaggatctctctggctatacattggagaacagatgggagtggaaagaccagaagccaggagagctgtgggaggctattgtgtaagtatggggagagatggcatgggcctgagctgaggccatccctgcggaggtgagctggaggcgggctgggcaggaagaggagggcgcagacacagtccaacactggtgcaggtggcaggcatctggaccaacacctttcccatcaggaaaccccccaggaggagcaatttactagctcactggcatacaacattcgttttccctgggtgtgtagttagaatgttctacggagacctgaagtgctcgtttattgctcaaccactgtgctcctgttatggagaagtagcagaggggtcggcacctgtcagttatgtccgagcctcattcacacctgtttgttgaacatcagggcactggcataaatactcactgtcccaattggtgacagtaaaggatcagatctcttgagacttcatggtcaataagaagccacagctttacactttgaactgcatgtgaaaccccgtcccgtccgggggctttcagcaattcacagcctttttgtggtgaaaaaaagtggcccgcccaccacccctccggggcctcctttctgagcagtggtgatccgagttgctggtgggtctcaaactcctgggctcaagctatcctctcgccttggcctaccaaagtactgggactacaggcatgagctactgcgcccggctttgaagccagcatttctttactacctacgaggcctgctcagagtccgtgctcaaaaagatgtattgaatgaatatgggctttgacgcacaggctggagcgcagtggcatgttctcctagcccacagtggggctgggagggagtcattgaagtgagctgccctcttcctgttcacctgcctggtgtttatgtcacaagactgccctagtggaggactctccaggttgaggttaggggttggaaaccacagctgaccctcaccacggagagtgggtctccatggaggccttggccactggtgcagcatcagcgtgggacacgtggtggtcagcatttggtctccagctgtggtagctgttcccgacctccttcctgcagagtcagtgacatggagttacctctgggagtcgagatgttcactgtaattgcatgctgcgggtagggcagcagggccttagcccatcatcagctcctgggtctactttgttcctcgggggacttgctcatctctggtgtcctcaagcctgagttttaatggccatgcaagcagagaacaagagacaaaacctggggccaagaagggggtggaagattggatcagagaaaacccccctcccccgccatataaaaccagggacttcaaaggccacactctgaaagtgtaaactggcagggtgggggaaggagtctgcccttaaaggggagacggtgagggttctctcttgttggttccagagggagaagaaaatgagcctcccaagagaattcctaaccacagccacctctccacaggtctggggccatgtcgcacatgagaccccccagccctctccccacaccttcgccccaccaggctgcagctggcccaaggccctgtctttatcctctgcaagcccacccctctctgtgtccttcccatgatgccttaccacgttttatgagtcaaattgttcagactttagaggcctggaagtagctgtctacatcctgtattcacatcccaatcgggcactgcggttaggggaaagcttttttttttttttttttttgagatggagtctcaccctgtgacccaggctggagttcagtggcgtgatcttgactcactgcaccctccccctcccagattcaagcaattctcatgccaattctcatgtctcagtctcccaagtagctgggactacaggtgcacacccccacgcccagctaatttttgtatttttagtagagacaggatttcaccatgttgaccaggctggtctcaaacccctgacctcaagtgatctgcccacctcagcctcccaaagtgctgggattacaggcgtgagccacagcacccagcaaaagcatttacttaccatccttcctggggcctttcagggacccttgagggatgggcaggggttggggggcccgtggaacttcttctaggatgaggtgacctcgtggacccctggttccggctctccttccccaaatcacccagtgaggaatatgacaccagcccagggagcagaaaagcctccttcaccttccccagagaagcgaggctcccctgggtctcacggtggaaaccatctctgtatttgctggcttgactctaacaggaagaattcctgagacacggtgtcgctggctgcttgctacctcccaggtgactgctgaggggaggcagagtttaacctgatgccagctaagagtaatttcccccaaaagggtcttccattttgagatgaggaggatgtgaggtgtgcctggggccacacatgccagggaccttcgtgacaatgtcctggacaccatcgccaggtgatgggcatcggcttgtgtgagccccgtggccaccagtccccttgccgggtggctgttttctgccatcgtggtctgggttaccactgatatgcaagcagtatcctcctcgcccctgtgtttctagcatcaactctgatttctcagcaaatgacagagaatagacaagaaagagcaagaaagatctcccaggacagtgctcaggcttggcgaggggccgttctcatggtggggcagacacaaaagtagaacgagggctcccagtggccctgtctctgcagggacacaggaggagacgggagtccggcggtgaccacagggaagtgatgtctcagggccgccaccgctagatctggggttccagatctagaaacacagctacagctggtttaacaggggtcttcaggaagacgccagagcctcaaaaccagtgtcaccacacgccgacccgggacagggcccccttcttcctgcctcagctgccaatgatgggctacgcttacttctcagctcctgaaatgaatttatcccagctccagatcagtgtctgtttccctgttccttcctttcactgccattaggcctgtttttagtttgaattctcctgtttcgtggatctcaccacacaaaccacctcaacgcttcattttgtgagttttgtattttttttcgacgccctcaggacagaaatcctgaataactatgtgatcagaaagttgcgtgaaagtaacgaaggcaagccacaagtgatagaagtctgacaccgtgaccgccaacagatgggccacagagagactgtccgtgaacttggaaactgattgcaagtgcaaatgctccacagaaattatgcaatcaggccgggcgcggtggctcacacctgtaatcccagcactttgggaggccgaggcaggtggattacttgaggtcaggagttcaagaccagcctggccaacatggtgaaaccctgtctctactaaaaatacaaaaattagctgggcgtgatggcgggcatctgtaatcccagctactcaggaggctgaggtgggagaatcacttcatcctgggaggtggaggttgcagtgagccaaaatcataccgctgcactccagcctgggcaacagggtgagactctgtatcaaaaaaaaaaaaagaaaagaaaagaaaaagaaagaaattatgcaatcagaaattgaaatcatcaacagctagatcccttcttttgtgaaccatcaccctgtgatgagatggtatccgctctgaacggctaaatgcctgcttgagaccatgtaggctcccggggacaccttgtaaccagatgcccgggacttccccagcgctggccgttccagaacacttcagagccagtgttacaagtcagggtggtgaggccacctccttggctgccaccagaacagcttctccactaggctaagaaataggttttctagcccaagagaccaggagaaatatctccaaatacatcttattccaggcagagtcttagatattttctgcccaagagttgaactgaccagcaagggaggcgtaagctcttcagtgatttgacgtgatcatcagaaacacttggcatgacacatctggaaataaactgggaaaaatcttttttgttgaagaggacatttttctgtagtcttaatagttgattaggtcggatgcagtggctcacacctgtaatcccagctctttgggaggccaaggcatggatcacctgaggtcaggagttcaagaccagcctggccagcgtggcaaaaccccgtctctacaaaaaatataaaaatgagtcggttgtggcattgtgtgtctgtaatcctagctactcgggaggctgaggcaggagaatcgcttgaacccgggaggcggaggttgcagttaactgagattgcaccactgcactccagcctgggtgacagaatgagattccatctcaggaaattaaaaaaaaaaaaaaaaccagttgattaattagcatgaaccagaaatcacctctacagtcctggacatacaggtcaccttgccaccttcctgatggctggttctagattcagtgtggacgagagatagtgacagaggtgacctgcttgggcctagacacacccacccaggcaccacatgaattcaactgaatgtaattccaagagctcctggagaggcaaggcaggcggccaccagcaccgccctgggcggacggaactgccattagaaatatcctaaattggctgggcgcggtggctcatgcctgtaatcccagcactttgggaggccgaggcaggcagatcatctgaggtcaggagttcgataccagcctggccaacatgtgaaaccccatctctactcaaaacacaaaaattagccaggcatggtgggcacctgtaattccagctactcaggaggctgaggcaggagaatcgcttgaacccaggaggtggaggctgcagtgagccaagatcatgccactgcactccagcctaggcgacagagcgaggctctgtctcaaaaaaaaaaaaaaaaaaaaaatcctaatttgtctgtatgcagggcaaatagattcaatgctgttgccacagaattgcttaaagctgccaaagccactcctcctagaactagattaatcagccagttccaggacaggccaacttcttgtttgtctttctgagtcctttctcagccattgttagccacacgctgccatgccacaaaataaaacacacgatggagacgctgcttggccaggcttttcttttcttttcttttcttttcttttattttcttttcttttcttttattttctttttttttttgagatgtggttttgctcttgttgcccaggctggagtgcaatggcgtgatctctgctcaccgcaaacctctacctcctgggttcaagcgattcttctgcctcagtctcccgagtagctgggattacaggcatgtgccaccatgcccagctcattttgtgtttttagtagagacgaggtttctccacgttggtcaggctggtctcgaactcctgacctcaggtgatctgcccacttcagtctcccaaagtgctgggattataggcgtgagccaccgtacccagccaattttttgtatttttagtagagatatggtttcaccatgttggccaggctggtctcgaacccctgacctcacatgatccacccgcctcggcttcccaaagtgccaggattacaggtgtgagccaccatgcccagcctttggccaggcttttctgattgaatgtttctagcagtggaatgtaagtctgggaggaagaagcagaactttcacctcagcccacgtgtcccatgtcattcgccaccatctcccacctgtcttagaactgtgcctcagtcctaagtattaagccggcacaaggccattcacaaacgacctctgcctgagttgtgtgtcctgggcacttccgtggctagggaccgtgttcccattttccagacgggtaggcagcagctcagtgagtttgggtaacttgccatggtatgtcttttcccagacaccctgtcgggtggtgggcactggggtgacctgtcctcgtcatccagtgggaaatccccatctgctctctgggggtggttgtttccttgttcaggaattgcaggcaaatgatggaaaagtccactcatttgtcccgcagcccccagcactggtctatgctgtcctgtctacgtcctcggattggcctggttggctgaaaatgccaggatcagcattcaaaacactttgtccagtgaagggttaaatatgttgaaataagcccggcctttacaaaagcagtggcatttacatcctgtacgtttatggaaatccttgctgaagaaaaacaaccacaacattgtttgtgcgtgtttttaggaagagaatggccaaagtgtctttaattcactgtttacccgtgagaattactcccaggagtaatcccgcaataaaatcttcttggtctatgagaatagaaagaaattgaatcaaaagactcgatttccacttgtatttattcagtctgggaaattcagtgggccggagtattagtatcagcaggggattcctttgctcctagcgttaaattactgtcataatcgctcaattatttcttccttgtactgtttaaaataaaaatccatcacattctgtgttttttttcctagcatttattaggttgagtgtttaggaaaatcaattatagtcagtcaggcatgaattgatgaatgttcttgtaataattgtcagttgttaaactgaatgtactttctctttcaccccttttcatttccttcagagggcagaggtggctcagagagaggcggagaccttaagggaacagctctcatcggccaatcactccctccagctggcctcacagatccagaaggcaccagacgtggtgggtagccccggccccgtgggggactgtccccgcctggcctccgcaccttcgagttacagccgcttgctcctttttgttttcagcatctctttttgggaatcacgttttaactagtactgctttctcggtggggtttgctttgaccaattgggggccggagcttgttaaagtcgaaggaagagctttgctaactgtgcgtgggtgggctgaggctagcgtggcatccacccagggccaaggtggaggctacgcaggcacagtcacagacacagtcacgatgccccagccaggcctgggggtgtgatcgctggcatgcgggtgcagacccgaaccaggagcctctccagaatgacacggagaaattgagggtttccgctgtgcctttccaagatgaggaacagttcaggatgagctgggagggtaggggtgggcgggcagagaggtaataaaataacattctgcaccgagtttatagagcaggaagagtgggtatcacaccacttttttgcagcttgctttttctgaaattagcgcaaatggctcttagcccaaacattcccagctcgatcaaggtggctttgaactatgggtttccagactctctttcaatgctgtatagggacaaggaacagcgtaggagctaagaccttgggtgttggagccatagcccccagtgcagaccccagctcagcagtctggtgatggggacaaaggagcttaacgtccctgagtctccgtttccccgcctgtaaactggggggttggtgcgaaagttattatgagcaaataacttagagcaaagctggacatgtaataagactaagtaaaccttagcagtaattctagttgtagttggcaccattatctctgatccctcagttttgggttttttttttttttctttttttttctaagacaaggtctctctctgttgcccaggctggagtgcagtggcgcagtcttggctcactgcagcctccacctcccaggctcaagggatcctcccagctcaacctcccgagtagctgggactgcaggcgcacaccaccacacctggctgattttggtattttttatagggactaggttttgtcgcgttgcccaggctggtctcaaactcctggacttaagtgatcctcctgcctcagcctcccagagtgctgggattacaggcatgagccaccacgcctagcctgatccctcaatttctagcacataatttcatcactagttcacttacaaacctcagttttcccatgtgtaaaataggaattaagtgatcacaaggccgctctatggagccctcatcctaaggttacaatgagtacatatcagttgtaggagtccttttatccaacagtgactccgtcaagcccttgccgtatgctagggcttgtagtggacacccgaagaaccataaggagtaagatgaggctggttgcagagagtacagtctcatcagaagaacttgctcttgtaataaattcaatcattgacaatcattatttccacccaatctgtgaaacagaataccgttatttcttttttttgagagagagtcttcttctgtcgcccaggctggagtgtagtggcgtgatctcagctcactgcaacctccacctccacctcccgggttcaagcaattctcgtgcctcagcctcccaactagctggagctgcaggcgcataccaccatgcccagctaatttttgtattatttgtagagatggggttttgccacattgcccaggctggtcttgaactcctgtcctcaggttatccacctcccaaagtgctggggttacaggcatgagccactgcgggatctcactcggtcacccaggctggaatgcagtggagtgatcatggctcgctgtagccttgacctgggctcaagcgatcctcctgcctcagcctcccaggtcttgaactcctgtcctcaggttatccacctcccaaagtgctgagattacaagcatgagtcatcattcccggccctatttttttatatagatgaagaaacaaaacctccatgaatgtaaacaccttttcccaaagcacagtcaatctaatggctgagctaagacctgaattgggcgttctggcaccccagactgtggcttttaaattattccccaggaatgaatctagatcaaggtattaagactcccttctaagaaaagattttagccttctttttaaaattaacattaattaaaacatttgttgctgggcgcagtggctcacacctgtaatcccagccctttgggaagctgaagcaggaggatcacttgaggccaggagtttgagaccggccagggcaaaatatcgaaaccccatctctacaaaaattttaaaattagctgggcatggtggtatgtgcctgtagtcccagctactcaggaggccgaggcaggagaattgcttgaacccaagaggcagaggctgcagtgagttatgattgtgccactgtgctccaacctgggcaacagagagaaaccctgtctccaaaaaagtaaatatgagactgggtgtggtggcacacacctgtaatcctagcactttggggggccgaggcgggcagatcacctgagatcaggagtttgagaccagcctggccaatatggcgagaacctgtctctactaaaaatagaagaattagctgggtgtgatggtgggcgcctataatcccagctactcaggaggctgaggtaggagaatcgcttgaacctgggagacagaggttgtgcagtgagatcgtgccattgcattccagcctgggcgacagcaagactccatctcaaaacaaaacaaaacaaaaaaagatatgattgaagtgttcctggatgtagagaaaagatttgcattgagcaggccatcacgtccttcatacttcatggactctggaacttaattttaactgaatgtccccttggctctgttacagttccttcctctaagtttagacaaactggatccagcaccatggctagggtgggaggcagccttcaggacagggtcagcggcttcccctggcccctggggtcctgcttcattctgcaaaggaagtcgtccattctgatgtgtctacacggggcccctgagctcagtgttttggttgaaaagaattctggcactatcctggactgcagcaaccaaaacatttcagaaggaaatgaatgtttttgcaggtagagtccgttgtggatcctaggggcgcttaaacacttcatcatcggttaagtgccgtgtttacatggcaccggttcagtctccccagagcagccccgtggggctccccgcgggcgtgtattcccacatagccagtgggttccagctgcagccagttggggagcaaacataggaaactgggccagcggaaaaatggtctgttgggcttggctggcagaatgcagcagagaaacggtggagtctgtagatctagcaaaggccaaaacccatccattgggtatcccagtggaatctccgattctagaaggtgagcggtcactgagtgagctgctggcccaagtttgcagccatgctgggctttgcatagttttgtttgtttgtttgttttttagtgagatgtagccccgctctgtcacccagggtggagtgcagtggcgcaatctgggctcactgcaacctccactcctgggtttaaccaattctcctgtctcagccttctgaatagctgggattacaggtgtgcgccaccatacctggctagtttttgtatttttgctagagatggagtttcaccatgttggtcaggctggtctcaaactcctgacctcaggtgatctgcccacctcagcctcccaaagtgctgggattacaggcgtgagccaccgcacccagcctccctaaagctttgaaggccacctcttcctctctctgatttcctctctagcttttgcccatgtctctcccagccatcaccctatggactgacaggccgctgcttctcatccaggccccctggatcgctccccaagcccctctctgtttctttcttcattctcccttatgtccttgtgacagcacaactgggagtgcccactgtgttgagatggagtgagccacagtttcagataaaggaaggatgggccaggcgcagtggctcacacccataatcccagcactttgggaggccaaggcaggcggatcacaaggtcaggagttcgagaccagcctggccaaaatggcaaaatcctatctctactaaaactataaaaatttgcctttgccaggcatggtggcatgtgcctgtaatcccaactactcaggaggctgagacaggagaatcgcttgaacctgggagggggaggttgcagtgagctgacgtgacaccactgcactccagcctgggtgacagagcaagactccatctcaaaaaacaaaaacaaaaaaaacagatagagggaggatggtcatgtctgtgtcatttccaaggtcttactgctttggggttcattttcacctcatttagttcgtgcgagacagcgatgatttttgctgttttatgaaggaggagtttgtggcttgagttgctgggagttggccagtgtggccgagctcttgtggccatgcccagccgggcgcaggagttgagccctcgaccacccgctgcccggtccccactctgggtccagggacagcactgaaatccacacctttgacctgtgtcactggaagcacctgtcccagatacattcactttgacttgcgccttgtaaaacccacattcccttggctggttttactgacccttttcgtaaaagccctttaatcagtgtctatggccagcacccctcagggtggaagattaagatgaagacgtgatatagcatgattcaacctgtgcccagactgacctccctacatgtcacttctgccatgtcccctccttgctccagagctggcagggactccccagggctgccaccacatgtccaggcgcctctggctacccctggcagctgtcactcctccagccctgccccacactcctgccagcctctgcacctgcctgcatgtcctccgcccttccccggcacccaccctgagatggagccccctttccttccgacaaggtcccgccagccctcccgaggcccacccattcccccctcctgtggctcagccccacgtgccactgtcctggtcctcctaccctggagggctcgtgacgttggccctgcccggcattattcagagcggtgctttccagactccctgtgatggacagttttgttttgttttttaaatttccagtctgtggcagactgatcgttttatataaaagacatttaaaatgtcaccgaaatgccgaatcgctataaaagtttctaaacacttattctcgatttctgtaattgcctcactgtgcaccagcaacagtttgcaaattggcaacgatccctgcagctcacgctgcacagaacgggcctggacagcctgtgcctggtaaataagccgacaggagatgctcgctccagccccccagggccacgcgcacagctgtcagaggtcaggagaaccgaaacacctcttttacaacctcatacaaatcaaagaagcaggaaggagtaccctctttgcacacaaaactttacagacttaaatggtaaaggcctcattttccccgagggagatataaaacattatttccctgagtgaatgcctgcctgtccccaaatttgaaaatccgtggtgagcacacggtgcatgggatggcccagctgtacctgccagctggggccacggtgccaccctttccccacaatacaagcaagatcaggacgtgaaactgagcacttcagaggggggacagcggcaaggacagtggctttctgtgttacagcatgagctgcccccaggattcggctgtcatagacaccatgcagctctgccctctccacccctgtccccgtctgtcatgcccagaattgcatctgccctgcagaaaatatttcagaatctttcaggagccaggattcctttttttttttttttttttttttttttgctttgacacagagtcgctctgtcacccaggctggaggtcagtggtgcaatcatggcccactgcagcctcaacctcctcaagctcaagcaatcctcccgccccagcctcctgagtagctgggactataggcatgcaccacaatgccttgctaatttttgtatttttttgtagagatgggttttcgccatgtggcccaagctggtctcgaactcttgagctcgggtgatccacccacctctgcctcccaaagtgcttggattacaggtgtgagccacagcacctggccccgtgattacttttaaaggttgaaaaaagtactacttgagtcattgagaagtagaattacagatttgactttttcctttttttttttttaataccttagcttttttctattttgcgtattttccacaatgagcatttagtgaggttaaggggtgggtagccaggtttttttcacatcaattatcctaagagttcttcaacaaaggaacaccaaatatacattttccacatcttttaattcttttattaaataaaatactggccgggcacagtggctcatgcctataatcccagcactttgggaggccaaggtgggtggatcacttgaggtcaggagttcgagaccagcctggccaacatagtgaaaccccatctctactaaaaatacaaaaatgagccaagtgtggtggtgcccacctgtaatcccagctacttaggaggctgaggcaggagaattgcttgaacgcaggagacggaggttacagtgagccgagatcgcgccactgcactccagcctgggcgacagaccaaaactctatctcaaaaaaaaaaaaaaaagaaaagaaaaagaaaatgctgatacagagttttcaatttgtcagacaatatctcagcttccgggtaatttaacagtgaatctcaaggaccttgaatcccaccttgtggtggaaaatctcggtggtttgggagcattggagggaggcttcctcctctgagccacccactctgctgttcccctgcctggagcactcttccctcttccccaacgctcagcagcccctccccacctcctcctcctccaggtctctgctcacacatcaccatctcagtgagtcttttcctggccatcttactaaaccccctgcctctcagctctgactctggcctctgttttaagtctcctttgacagtggtcaccccgcacacttttcattactaataagtgtattttctgcatctcactcatcctgccgcatccctgctgggctgtaagccctgggaagacagggacttttctcctgtttttttttgtttttttgagacagagtctcattcctttgcccaggctgaagtgcagtggtacaatctcagctcagcgcaaccttcttctcccgagttcaagtgattctcctcctcagcctcccgagtagctgggattacaggtcaccaccacgtgcctataattagcccagctaatttttgtatttttagtagagacggggtttcaccatgttggccaggctggtcatgacctcctgacctaaggtcatccacccaccttggcctcccaaagtgctgggattacaggcgtgagccattgcacccagcctggactttctttgattcactgctatatggttggtacatggtaggcactcagtacatatttgtccagtgaatgaatcgaggtggcagctaaccacagggggaggaaggttgcataggggaagtgcaagcaagggcaagaagtgacatcctgccatcaccatccacacactgacatctgtgcagcttctgtctcagttgccagcacaggtagcctcgagcacccgcctcaaggccagcgcagttttgtcatctcttttctcctccccaggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaagtaagggggctgcggggcccgggggtggcccgaggaggcagggcggatggctggacacacgcgcacacacacaccctctgcctttctggacttgatagcaagtgtggcaaccttgaacctctgtaaagtagcaccaagcagagtcccggagtccatggcagggagactggatgttaaaccctggcatcagcccttgtgtaaacagcatttccctctttttttttggagtcggagtctcgctctgttgcccaggctagagcacggtggtgcaatctcggctcactgcagcctccgcctcccaggttcaagtgattctcctgcctcagcctcccatgtagctgggatcacaggcgtgcatcaccatgcccggcttatttgtttatttatttattcattcatttatttttgagacagagtttcattcttgtcacacaagctggagtgcaatggcatgatctgggctcacagcaacctccacctcccaggttcaagcgattctcctgcctcagcctcctgagtagctgggactacaggcgcctgccaccacacccagctaatttttgtatttttagtagagatggggtttcgccacattggccaggctggtcttgagctcctgacctcaggtgatctgtccacctcaggttgccaaagtgctgagattacaggtctgagcctctgcacccggctctttaactgagttttgcagggcatcctagctttctgaggatacccctacaggaggagctggtgtactataactccagcacttccggtgcatgagccaaatgaaaccccagaggtccatggaagtcacatctgaccttctaagggacattctcttgtccaagcaccttttccctcagtggcccctgtccaggtgctgcttcagtctaggctccctcccactaggcactcttggcttttccataaatttctatcccagacgcagaacccagagctttttccacatattaaaaagtaatgattatactttaggtatttatgatccgttgaagcaagtgtaatttgaagagggtcctgggacccttgattcacaggcttcagagccaggggagactctcggagttgtctgtcttgacagcgaagaaggcaggaccttcagggcagggcttcagccccaggccaggggttccctgctctgcccgggggctgcccgttcaggcccattccttccccaacccggtacctccatgttgggtgggtgagggaatgagtggctgtaaagtatattcattgtatgaataaagtgggtcagggttcattgtgaacatttaaaggaaaccttttctggtatgaagtagtcctaggatgtacttaggtccattgtgttttgtcgttgttgttgttgttgttgtttttgagacggattttcgcttttgtcgccgagactggaatgcaatggcgcagtcttggctcactgcaacctccgcctcctggattcaagcaattctcctgcctcagcctcctgagtaactgaactacagtcacgcgccaccatgccagactaacttttatatttttagtagaggcggggtttcaccatgttggccagtctagtctcaaactcctgacctcaggtgatcaccagcctcggcctcccaaagtgctgggattacaggcgtgagccactgccttttttttttttttttttttgaaacggagtctcactcactggcccagactggagtgcagtgacaggatcatagttcacggcaacctcgaagtctcgggctcaagcgattctccttgcctcagcctcccaagtaactgggaccctgggaccaaagacatgccccaccacacccagctagttttttaattttttgtggagatgggatttcactgtgttccccaggctggtctgggacgcctgggctcaagcaattctcccacctcggctcccaaaacactttgggattataggcatgagccgctgcacctggcccaatgtctttttttttttttttaattgaaattttctttttgacacatgaccaaatttataccaagactaagtttccagcaatctattgcctatgctgatggctcccacgaccctccctcactcctttcttctgcctctttggggtgaatttcacccattcactgagaactgcccagcgccgggtcccttggaggagacagtcctgccgactttggggaaatggttgaaacctggttctgtctgtcctcagccaggtcgttttttttaaatttttattttattttattttattgtattttattttattttattttattttattttattttatttgagacggaatttcgttctgttgcccaggctagggtgcgatggcgccatctccactcactgcaacctctgcctcccatgttcaagtgattctcctgcctctgcctcctgagtagctgggattacaggcatgagccaccacttccggataattttgtatttttagtagagatgggatttctccgtgttggtcaggctggtctcaaattcccgatctcaggtgatccacccgcctccgcctcccaaatgctggaattgcaggtgtgagccaccgcgaaccaggtcatttattttgtcaccgccgtttcttcctctctcatcagcttacccaatgagtaccaggattcagtttttatttctacatttaatctcattttctcatgttacagccatttctgaccccagcaacggcattatgatgagataatttgcctttctctccattgtcaagttaaagggcgtgactcagatacacaccggctacaagagagcaaagctgtagacctcacattttttattatagagcaatttcttccaaatcagttaaggtttcaatgtttgccttcacaaaaaaatgaaacgcggttttgcaaattaatgttcgttatccgtatcttgggggaattgtttaataccgtgcagttaatgaaacaattcagcgatacttcttccaaaatcattgctaccttatcttcatctaatctaataatcaaaacatatcttctagtaacaagacttctgattttaattatcttaactccttgttgccagattgtcctgatacgaaacccacatgcagaaagcatctgacttcaccaaaccagggtttcctctcgccccaaaggaataaggttaattgaatgagatatgttctgagggctttttgtttttcctaatgtgtataatgtatagcctcaaatataacctaaaggaatacaattattaggaaaatatttttatgaataagacttggcaaattggcaacctgatgcttttgccatggggaaccctgcccccgcagtcttggctactcaaagaactcacctttacttaccacggagctgctttctttctttcttcttcctgtccccttcccctctttcatgtcttacgggggaccctcggacacacgatggggccttgaatcaggttgctgtttgggagaggaggctccaagctcccagctctgggctcagctgtttggagttgcaggtggttttcccatgaacacttggcagcaggtccttgatctttgagacatgtgccagggtgtttggtgacagtcacttggggagagggcatttcccataagcagaaggcttattgggcagaatcttttgtcctgagttcactgagttgtttccacccatactttccaatgatactttctgtagttggatatatcagaggactgactaattggttttctttctctaacccattgaaattctccatctttctgccactgagatttctcctcttccctcaaatttgatttgttatttcacaaggataccagacagctgcacatcttcgagtctgtcctgtccagggctctactttttcaagcaaagctccccataaatgccccgctatccacgtgtgtcatgggacatcgctaacctttaattaggcatggaaacagacgcaaaagtggaagatgtttcctcctgcctaatctgacaagtgcttaagcatagtgccacttgtaaagaagaactgtttttgcaattaatgaaatagcccgaccgccgtgacaaggctgctttttgataactctctattctgtggtcttctgttggaatgctttaatatagaagcagtataattagctagtcaactgcactgtacttgctacagcacagaagataatgctaccaatagcttcgatttaaaatagatatttataagaaaggctaactaaaagaacaccagtctcccagaaggagaaattatatttttctagagatgcgttaaagatcagtgcttcccactgggtggatggtcacatgcgttagaatcacctaggggtcttttccaaactgcttctctttccccactcctgaggttctgatgggtcccatggagacactatgggatgatgctgtgtccctcggggcactgaggtggtataaaagaggtggtataaaaccgtccctctggccttgggtgtctctcttttcatcttgcattctcggagcccaggagttcaagaccagctaattttttgtatttttagtagagacagggtttcaccatgttggccaggctggtcacgagctcctgacctcaggtcatctgcccgcctcagcctcccagagtgctgggattacaggcgtgagccatcgcgcccggccccatctcttaatttttttttttttaatgagccagagtggtggcacatgcccgttgtcccagctacctgggaggctggggagagaggatcattggagcatacacagcacccaccccattgctttggagatttggactcaccgtccagagtccacagtatccttgggctcctccccaactcccagcatcagcagaacctaaatctccatgcctgctgcctctgcctgaggaaccatggagacacatgtccttatctatggagagtccttgtccagtagaagaggaggtgcatgctgcccaggcctggaccccagagatgcagtgtcagctaagggtctgtgcctcagacccctgccctgggccagggggtccccgtgagaccgaagactcccacaccaactctaacctgagccagtcagacagcaccatgtggagcctggccccatttatctgcactgcagatgccactctgcccccacggtcagaattttatggaaaagagatattgtcaccttgaccactggctgtgcaacctggaagacatgacctttccctgggtctctgccttagtcagacctgccagaggcccctttgctgtttttttgagacagggtctcactctgttgcccaggctggagtgcagtggcaccatcatagctcactgtagcctcgacctccctggctcaaggaatcctcccacctcagcctcccaagtagtcgggactacaggcacacgccaccacacccggcgaatttttatatcttttgtagagatggggtcttgctatgttgcccaggctggtgtcgaactcctgggctcaagtgatcctcccacctcagtctcccctagtgctggggttacaggcgtgaaacaccatgccctgcagtagatagacatagtttatagattaaacacctaatttgctaaagccaaaatagttggcattgtaaagtttattatcatttaagtcttagccaggcttttaagagcttcaaatagacaattcttctggcatttcaggacccagctggggagcaccagctaggtttctggagccatgtgggctccgtgtatcttttccatcgtattattacaacaggcgtgtttgattggcacttgatcatcctacatctcaccactgtcctttgaaaacccatattcattctgaatctccccattcttcagatgagaaatgtgaggcccaaacaggctaaggttatccaaggtcacagtcagctagggtaggaccaggttggcagccaggtctctgacacttggccttttcttacctgtctgtgtaaagcccacgtgtgttccttagattcatgcattttattttattttatttttaaagacaggatcttgctcttttgccccaggatggagtacagtggcgtgatcataattcactgcagcctcaacctccagggctcaagtgatcctcccactttagcctcccaagtagctggaactacaggtgtgcaccaccacacccagttaatttttaaatttttgtagagacagggtctctctatgttgcccctgctggtcttgaactcctaggctcaagcaatcctcctgcctcggcctcccaaagtgctgggattcaaggcatgactcactgcacccagccagacaagtgcatttttcaggaagatgaccagttcccagattctctttccacagccttggacatgaagttacccttgacagcgggagccactccagggcacatgtgctctttctctgtggctctgctacagaatagcggggaccctgggaggtgacaggctgagatccgcagaccttcacgaacagagcccctggagaaacagaaccagagactctcttcagatccaatgtagccagattcaaccccacctagcagggatgtagtaattgtagtaacaaggacagtaacagtgctaaccaccatttacagagcactttgccatgtgcccacactgtactaagctctaagtacccaatatttttttaatcctcatcaaagcactgtaacatataaacatgatccccattttatagataaggaaactgaggcttggagaagtcaagtctgggtgggtaggttggttggttggttgattggttgatttatttatgtatttagagacagggtctcactcttttgcctggggtggagtggcaccatcacagctcactggagcctccacctcccagactcaagtgatcctcctgccccagcctcctgagtagctgggactgccggcacatgctaacacacccagctaatgttttggggttttttttttgttttttttttttggtagagacggggtcttgctatgttgtcgtgcttatcttgaactcctatgctcaagcgagctaccacacctgacccaagatgttgagtcttatctaggttcaccctgcaagtacgtggtggagccaggatctgtcggactctggagtccaggtttgcagagagcccccggctcatcctggcctctccggcatctcacttcctccctgcaggcacgtaggaccggcctcagctctgtcaagatctgcactgtaggaccccagagatttttttctttctttgggtagtcagacccatctgcaaaagttttgcaatcatgaaatcagatagcgtatgaaatgctaggaataagcgcaggtctagcataccacgcggccagcggtagcgtgacctgacaggaggagtgcgtcttcagagacattgggaaactggcgtgcctgtcgcccgtcccagggtcagagtcttcgaaaccaggctttctgggaacccaacaaggagtttctgatcgaagaaccgcactgaggacagttagtcttttttccacactgggcattttcagcattggaagtcaatgggagccctgcgtctgcaggttttgagatgtggcactcacagcagggtcactagaatggagacatccatgggaccaggttacaggcgctccggcagttgggagaagcgtcgccaagcagcctcccctaggctccatccagcttgtctgcccaagacagaaaacgtcatagaaggtttacagaagagatcttggggacttcctagttcaactgcccctaggtagatggcagaaccctcaatggaagctgtttagctctcagcaaaactcacggccaactaaaatacagtcgtgtgtcacttaacaatgaggctgtgttctgagaaatgcgtcaataggtgaatgcgttgttgtgcaatcatagtgtgtacttgcacaaacctagatagtatatatatatatatatatttttttttatttatgcctatttttcatacagaaaaccaaatgtcccagcaccattactgagcattagtcatttcccttgcttgatctgcagtgcctttataaagggccgtatgtcaactttctctgtatgttccattagaatcttacgggactcaggccaggcgtggtggcacacgcctataatcccacactttgggaggccgaggcgagtggatcacttagtgttaggagttcgagaccagcctggccaacattgtgaaacttcatctctactaaaaatagaaaaattagccagacattttgcaggcacctgtaatcctagctacttgggaagctgaggcaagagaattgcttgaacctgggaggcagaggttgcagtgagccaagatcgtgccactgcactccagcctgggcaacagagcgagactccatctcaaaaaaaaaagactcttatgggacttaggcagcctttgttgaccaaagcgttatgcggtgcatgattatacatggattccactcctaaaaccttccaattagggccaatcacaggccttcaaagaagacctgcagccgtgcccctagacagaaactgtaatgggacttagcagtgctaagagtcccaatatcaagccaggaacctggaatctcggcactttgagaggccaaagcaggaggatcacttgagcccaggagttcaagaccagcctgggcaacatagtgtgacctcgtcactacaaaataactttaaaaaaaaaaacaaagagtcccactgttgagggcccagagttgccaacatctgaactggttctttgctttgtgcaaacccttgagtaattgctgttattcccattttacagatgagaagtttattaacttgtccataggcacccaggtcagaagtgacagactcgagttccaggctcaggctgtcggccttcttggtctgtgccatgccaggctctgagaccctctgtgtgctcctccctctgtctgccttattcccagccggctcctattctctggatatgaccacgtttatgcacgctaaatttagaccacacctggctaattttttgtattttttttttttttttagtagagacggggtttcaccatgttagccaggatggtctcaatctcctgacctcatgatccacccaccttggcctcccaaagtgctgggattacaggcgtcagccaccgcgcccagccctgaatttttaaaacatcgggcaggttgggatttggatggtgccatctcctccccaaagtctagaatgttctcagttggctttaaactgtggtcttagccatggctagtcaagggcacctacaggcatggtggctcacgcctgtaattccaacactttgggaggctgaagtgggagaatcacttgagctcaggagtttgagaccagcctgggcaacatagcaagaccccctctcttaaaaaataaccgggtgtggtgatgtgcatctgtagttccagctactcaggaggctgaggcaggaggatcacttgagcccaggagttggaggctgtagtgagctatgatcgcaccactgcactccagcctgggtgacagagcaagatcctgtctcttttttaaaaaaaaaaagaagaagaagaacaagaagcataatacctagaaaccctgtagaggggaagttaccggaaatgacaattgttcacctctagcttggaaacatgctgaatggccagaacaccctcccggcaccgcccctccatattcttgttttatgtagagttgcctcatttcctccaaggagctccctttagaaaagatcaaaagcaaactagtccaaaaacaccttcagagaagaaagcaccccctacgaccaccctacagcaatggctcctctcacaagaaagccctgcagagctgtgggcagaaacggccacatcaggctgggtggggtggctcacacctgtaatcccagcactttgggaagctgaggcgagagggtcacctggggtcgggagttcgagaccagcctggccaacatgacaaaaccccgtctctactaaaaacacaaaaaaaagtagccaggagtggtgatgcatgcctgtaatctcagctactggggaggctaaggcaggaaaattgcttgaacttgggaggcggaggttgcagtgagcgaagccaagatcacgctactgcactccagcctaggcaacagagcgagagtctgtctccaccaaaaaaaaaaaaaaaaaaggattaaaaaggaaaaaaaggaaacaggccacatcaatccccagtgagctcacagacctttctggagcccactggagcgtcatcatactttggaaatgtgccatccctcccctaggcccctgagagggagcagcatctcggtcagggccctccccgcaggactcagaccagctggctgtcagggaagccaccaagcactcgactgaacaggtccctgctcctaaaaccccagcatccaggggttcaggagtggaaaggcctttgccctgatgcctatctgatgcctactctcaatacaaaagggctgtgtctctcgttagtagaggtcctcccaaaggtgttgacaaccagctgtatgagtccctcagcctaatatattttgtttaaaaccacacgctgcttttcagacaccaggaaagcctctcctcctgtcctcctgtttgctgtttcatggcacttcctacaaagtacacttttcctcctctgcttttcacctctgcaaagattcttccttcttttttttgggtgcggggggggatgcttttttttttttttttttaaaaaaaaaagaggtagggtctccactcctcactctgtcacccaggctggagtgcagcagcacaatcatagctcactgcaccctccaactcccgggctcaggcagtcctcccacctcagcctcccaaagtgctggaattacaggcgtgagccaccacacccttcattctgcttttgctaagttgtacgttacaaccttacagcatccctacacactttgccgtgcctgggcacgcactcacactgggcaggccaggagcgtgagggacaaaagatggccccagcaccgttgactccattcgcaagggctggcttcccctctcaggcacagctggctgttccgcagtgaatgccgtcggtgaagtccgtcgacctgttgtcaggcatggccactgatcaaattcttctctgttttcagcaactggaagaaaaactcaaaggccaggctgactatgaagaggtgaagaaagagctgaagtaagtacggagagccctgtggcccctcacacgctggggcgcattagggccatctgctaacaatgccaggctggtggcaggaagccttggccccctgccctctggctcagcagatgcccgtaaatgcagccagagttctaccactgcatggtgtcctgggctacccaccactgtgggcgtttgcccttgggcctgtccctgaattctttggacttttgctaaaagctgtgcattgcaggtattccagaatgtatggaatcaggggcatagggcttttacagaaatgatcaaatatgaccttgttttgcaactataaattccccaaacagaaacaaagcacaggagggaaatgttttcgggttgaaggtgggcatatggcctcacgctgccccggcctcctggactcaggaactctgtcttccaaactctattctccatctgtgaggctgtagccgaaagcttatcatcttttcagggctaatgatggcattctcagttctcaagcttcaaagttcctttctcggccagcagcccccacctctgcctcctcaccctgagcctgctttggcactctggagctcccaggtcctggtctttacctgtccccccacatccataatgctccaggctcactgacctcccctgcaagcctggagcctgtggtcagaccctctacgttcatacagctcccctggatcgtcagccattccaagccttcccactggcatgcccgcctcactcctaggttattaagcactgcaaacgaaggttgcctagggcatggtgaccagccccacaggtcccccgtgcttctcgcggctggagctctgctggttcgaggcttcctcaggggttcctccctgcccttgtcactgttaccccaaccactatccacagatgccctagccctctgctagggacagactcccgcctctggtcttgggtgccacctcccatctctgcaggctgccccctctgcctagaccttgagtcccttccttcctgcccctcctgctgtcccatcagcccctttctctcttgctgctattttccatttctccttttaagatgagcctacacccactcaccacgttttctttgtgttgttaattccattctgctaagaaaagctcctcgggcatcctcttgaaccatctcacttccatgaccagctgccttctctcgcctgggacccccagcctccctggcgtctgctggccctggtagtccctgtccccaccatgctctccccctgagcggtctcatcccctctccagctgcaaagcctctgccggcacctcctcggacagacccctacatccctctaacagttccagcctctgtaacttacttacttgcttgcttacttatttatttatttgacagagtttagctcttgttgcccaggctggagtgcaatggtgctatctcggctcaccgcaacctccgcctcccgagttcaagcgattctcctgcctcagcctcacaagtagctgggattacgggcatgagccaccaccccgggctaattttgtatttttggtagagatggggtttctccatgttggtcaggctggtctcaatctcccgacctcaggtgatccacccacctcagcctcccaaagtgccgggattacatgtaacttattattaaacattacctggttaaccttctctacctgcctctcctatcccattctttccttcctttccctcttcttccctcttccaaaaagaaaaagaaattgggccttttaattttgagccagagaaactgctgcgaaggcctttgcccagcctcaccctgggagttagtcgtcgtcttcattgtcgtcttcgttgtcttcttctttcttcctctcttcttctttcttcctcctcctcttcttctttcttcctcttcctcttcttcttcctcttgctcctcctcctcctcctcttctcccccaacccccacgttcacttcatcccctgggagctgaggcttccaggctccagcctgcaacacataccgttctactccctctcatccacagcctgccggaccacaggctgcccctacccccactgaagggctgccacaccagccccgcttgtcactgcatttctgctaactctttctgttgcgtccgcacatgacaggccccaccaccatgtgcacatctggaagccccactcaggtggcttctttgcccaaatgcgctcctagttttccacttcctggtgaaccagctgtgctcttgagctcttgcccgcgtccccttctcagcatcgtcccatttccacttcctcacccccacgcaacaggggatgctgacctcagatcctcatgcactgcagcacaagacaccctgtcccttcagggcccttctccaatgcttgttcatcatgacactgagacgtggtctccaatccatcaagatccctcctgctggggtcctcacaagttctgtcttaatggaccacttggagtcttgcctattacctgtaatggcctgtaaatttcctggagtacggaccaggagtggttctgattccccacggcaacaagcggatagcaggctgctggtaaagatctgtagaatagataaagagccacgtggtcttttattacataatcctaaagaaaataggaaacgaaggacaggattccatcttaagaaacccctttcagctgggcgcagtggctcacatctgtaatcccagcactttgggaggccgacagatcacctgaggtcaggaaaccagcttggccaaaaccgtctctactaaaaataaattatccaggtgtggtggctcacactagggggacagaggccgaaattgtggctgcaggaacatggcgaaggtccggttgactctgcacctgcgagtcgtaaatctcacggtccagccagcctgctctgggtctctctcttccatccttggtatttcaaagaaacacttgcagctccttcaaagccacatagcctcacttcccctcttctccctggtaaactcagcaaaaaagggacatccacagcaaaaggaactcaagaaacagtaataatcctggggacctggactcactgagacagcccagagaccgtagtgatcagggtgcggcccttttcagtgccattgagaacaagggagggagaagtcaccttctcttgccacatctttgtcattgcactccttccccaacctggggctgcagagaaggtctgcccacctggcttctgagtcatccaagtctaggaggttgctctttgcctatgtcccctggtccccaggtaggtgccagttaggagtgaggtgtgggcagtggccgccctggtgggttcccctctctctggcttctccttacaactttttccttccctttaagctttacaaatacattccacttgcaacaatgttatgtctgtattaaactttaaaattatactctgaacagacctggtgtgattccatatggaatgatttacatgctaggcaagaaacttttgccagccaactgctagttgaatagttattctagagacattatcagattctattactgccagggaagttgttaaagttgacagttcttcggttcctggagagcaggaaattgtaatgttaatgcttattaatgtggctgttgtcaaaggtataagtagaaaataatcactctggtggctcatgcctgtaataccaacactttgggaggctgaggcgggtggatcacttgaggtcaggagttcgagactagcctggccaacgtggtgaaaccccgtctctactagaaatacaaaaattagctgggcatgatggcacatgcctgtaatcccagctactcgggaggctgaggtaggagaatcgcttgaacctgggcagaggttgcagtgagccaatatcgcgccactgcactctagcctgggtgacagaacgagactctgtctcaaaaaataaataaaataacccctctgttgtgctcttgcagcattctgaagtccatggagtttgcaccgtccgagggcgctgggacacaggtacgtgtctcacctcaatggtcagcactagcatcagccccgctgctggttaccactggtccctccggcatatcccatgatccactgtttctacgagacctctcacttacagccgatgagtcatacttcaagaacatttaaccaagttgaagcaaattatctttttttttttgtctcctttttttccatgtgtccaaggcatgaaccaggcatagatcaaaagccaagctggggatgaacaagggattgcttcatccctgactgataggagatgggcactaccaaaaagcaaattatctttaacaaaaagaggcaaaaagagaaaagctagtgttttccaaactggtaactgaagtgaaattgtgatttcacttcagcaggtactaagaacataaataaaaaacaatttcagattgtgtttaagaaggccaggctcagtagctcatgcctgtaatcccagcactttgggaggccaagacaggaggatcgctttgaggccaggaatttgagaccagcctgggcaatatagcaagaccatgttgctattaaaaaaaaaaaaaatagccaagtactgtgacatatacccgtggtcccagctacttgggaggctgaggcaggaagatcgcttgagcccagtagttcaaggctatagtgagctatgatcgcaccactgcactccagcctggacaacagattgagactgactattttttttttaattgcattaaagagcagccaaaaatggattggtttaggaactttagttacatgctgcctcagtagagaaggtacaagggaaggatgactgtggcccagggtcatctggtggccaattaaaattgacatcccagaccaagcatggtggctcactcctgtaatcccagcactttgggaggctgaggtaggtggatcacttgaggtcaggcatttgagaccagcctggccaatatggtgaaaccctatctctgccaaaaatataaaaaattagctgagcgtggtggcgcacgtctgtaatcccagctacttgggaggctgaggaaggagaatcacttgaacccaggagccagagggtacagtgagccaagatcatgccactgcactccagcctgggcgacagagtgagactccatctcaaaaaattaaaaaatcaaatcaaataaaattgacatcctaagtggaatctgactcctgatgcccagaagacagccaacatctttgtggctggcaaaaaaaaaaaaaaaagaaaagttccctttacagtaacgttcggacagacgtttgtggcttggcagccagtcttatggccaaatgaggcacgggctcaggtcgcttgagtttgagaacagatgagagaataattaatttttttaggagctgtggaagtctaagaaggaaaatgacttcaactagaatccattctttctaaagggaacttgttttccacgtgtgttaaacgacttggggggaaatcagctgtccgcagcccacttcctaatcagatcgagagctgggtgggaacgcggacagatggagggaggcagggctccaggcctggtggccccgggagcgggtgagtggccggccccgcagtgagacccccgctctgccccttctaggatgcggccaagcccctggaggtgctgttgctggagaagaaccgctcgctgcagtccgagaacgccgcgctgcgcatctccaacagcgacctgagcggtaggttggccgggcttcgcgcgtgtgcggtggttggttcgcttccaggggtcggtcgaggacgaggaaggtgaatcgtgagtctggacagatgcatggccagagaagcgccggttgacgagaacctttgactaacgcgtgttgggtgccctcctcctcaccgctcctcccttcccttccccgccctgcttaaagctggatgtcgagacgggccagccgcacaggctctgcggaggtcagttaggggcagtgcggctggaatccccgggagggacagctcggaggacgtcggcctttctgatctgtgtctggttgtgctgcacagaggccaggggcagtgtgaacccagcctcgctctggtggtgttttcagggacagccccgggcctgccgggtccagtagaggtttttcttccttggtcaggtttcccctggggacgcgtcccccatccttagcctttcttggctcatcccccaaatggtggcgtcacttgactgtgcttctggtttgggcagctggtaaaacgcgtacaggtgtctcgggctctaatggtattgcattctcaaaacgggcgcgcgcctccacatcgagggggctcggtacggtgcatcgcctcagagcaagaggtgcgagcgaatccattggtcctaaaatgtcagtgtttgctgctcctccggccggggccagcgggcccagtaagaggcccgcgacccgtcaactcttccctgtgtgtgtcaccagctccttgtcacgctaggagtttgagtctatgtcaaggggactctccaggctgcaacgtacaagaaaggcgcaaacatgaatgcatgttgcttgttttgggaagcctcgtttggctgacttacaaatttaatcggaaaacaaaccaacccacctcattggcccttgtaaaaaaaacctgcacttttttttgttttcccttttgcgggggcaaacttttgcattttggtcttggtttttttttccccctttggaatcccccataatgcattctgtttgcccttccttgtagggtcagccaggaggaaagggaaagaccagcctgaaagtcggcgcccgggatctttgccggccccccctccttctcagttgccccgcaacccgggggagcaggcttccaatactaatggtacacaccagttctcaccagcggggttaagtcaagactttttcagctcatccctggcaagccccagcctacccctggcttctacaggaaaatttgcactaaactctcttctccagcggcagctaatgcagtccttctactccaaggctatgcaggaagccggaagcacaagcatgattttttcaacaggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagaggtgagagactggcgttgggtggcgccagcgtgcgagcccgtcacagagttgcacatgtgtgtgtgcatgcgtgcgtgtgtctgtgtgcgtgatgaaacatttgtgcatcacatcaggtaaagttctctttgcttctgccacgtccagagctcaagggtggcccggcatgagttaaggctgttagatttgggagatctggcctttgaaacgcactcagcactccatacttaggaaaccctatagtatttcaatactagagatcgtatcagagggaattgcattacatgatgtatagcgtctccgtatgcttagtggccgcgggtccaattggccttgggtgctggtctcacttttgggaggagcccttaagtcccctccagccccatagcagcaacgttgactgggctcgatcctcatgcaaagctggttctgtagggagaacacatcacagatgacacctcccctcttcccaccccgcagaagagggcgtgtcccatggccaccttccctacattgttcacggtccattagtgatttgtttagcattatgagtaaaacaggcctggcttgagtaaaatacacaaaagttttatttaagcaccctttctaccccaccctccgtaaaaagataaaatgtcagtcacattcataatttcaaaaaatcccagccgggcacagtagctcacgcctataattccagcagtttgggaggctgaggtggatggatcgcttgagtccaggagttcaagaccagcctgggcaacatatattttgtaatcttttgatctacaaaaaaatcaaaaggttagctgggcgtggtggcgtgtacctgtggtcccagctacttgagaggctaaggcaggaggatggcttgagcccaggaggtggaggctgcagtgagccatgattgagccactgcactccagtctgggcaacagagtgagaacctgcctcaaataaaaaaacaaaaaagaaagttccttttctgtttaagaccaggggatcaatgtgccacatcaacagagctattgagaggtcatttcatcagacatgtttgaaacaccctgaaatttagactcaaacagagcagggagatgttttgaacagcatcaatttgcaccaagaaaatgcagtgttttatgaggatgttaaccgaaattgaatgtctttggatgattaatgcgagctttgttctgggggctggcgggtgatcctccttcaaggcagtcctccctcccatggacctccctggcctcaatgccgtaggtcgctacttagatttcccccatctccttttgcagcagagccacggcctctgcgggccggtcagccagggaagggcctctcagaagattctagaaactcccgagttgcacaggcagccctgagccctttctttagtgacaggcggctcagatttcatgtcacacagcccatatcgtcaacaccaccattcccctgattgttttgttcttaccacacttgtttttcaacagagaatccaggccagagcctgaacagactatttcaggaagtaccgaaacgaagaaatgggtctgaaggtatgttgcaggcaggcgttttctttgcagtcagtcacctagggaagcagcatgtccttagctgtgtatttgggttaaaactgtgcagtgtgattctggcctggaacctgatggaaaaacagctagtaagtataaaacaaggcacgggttcaagcacacccagccccttcctcccgagctgcctgccctctcccaagcacaggcgggggtgagaagaggcattgctaagctaagccccccgagtctgaatcccagcccacttcagatcctaattacccggtcccccgtttttctcagacgcagttgaaaaaataacagcggttgctctgagaaaagtcaggtgacccgtcaaattaaatactgctgcttcctcgtatttttaactcggaaacacactcaaggtcctatggaacggacgcatcccacatcgtcccggtggcatacttgtttttaaatggtggtatacttgttttgaatgcagtggttcctatttaggaaggtagtaagaaattaaactatccgggtggcttcccgaaagagctggggccagcccctgggccatagtagcctcatttcgtcggcacgtgtgcctgcacaaaacatcaccatgtggccgaaagaatccatcctccccacttaggaatttctgcaggctcctttcctcgtatgtaaattttaaaaagatattatgtgataataggtgcaaacaattttttaagttaagcctttcttcaccctgtgcctctgaatgattgatagacaatcagcctcaaaccctctgccctccttttccgtttatcctgtgtgggaccccagcatccaataaacatctaaccccgaggagagtcagtcccaagccacagcagttgcttctaagtgactcatgagaaacattgccttttaatcactcgccttttatatatatggattaaatgatcggttctcccgggtactaacccacgggtggtgtccggctttggcagagtaacattgaccgtaaggtcaaatgagcaggaaatccctcctgcccggtgtcgctgtgaagttgcactcacagcaaacacaggccactgggaggccacatctgcctccttgtgtcaccagcccccacccggggctatatatcagaatgacgtcttcgcgcagcgctgatttttgtccggggtttgggtttgatgtcattggcgcaacttctccccacaggtaacatcaccacccggatccgagcctcggagactggctctgatgaagccatcaagtccatcctagagcaagccaagagggagctccaagtgcagaaaactggtacagcttccatttcttcatccactgtcttcaaacttaattaagagaattgtcatgagtgctctggtcagcagtaattaactattttttttttaaacaataatgaatgcctgttctcaagcatttaggcacgtagagagaagcaggtctgtgtgatctgtatttgcctaatagttacctttttttttgagatgcagtctctctctgttgcctgtgctggagtgcagtggcacgatctcagctcactgcaacctctgcctcccgggtttaagcgattctcctgcctcagtctcccgagtagctgggactatagacatgtgccaccatgcccatgatatttgtgtttttagtagagacggggttttaccatgtcggccaggctggtctcgaactcctgacctccagtgatcctcccacctcggcctcccacggtgctgggattacaggtgtgagccaccgcgcctggcccctagttgtaattattcacagaaattacgctccttaactttgacagaaccacttgcatttcagaatatagcacaggaaaatgaataccaagtataaaaattatcagaggtcaggcgcggtggctcacacctgcaatcctggcattttgggaagctgatgggggaggatgacttgagttcaggagtttaagaccagcctatgcaacacagtgagagaccttgtctcttaaaacactagccaggcatggtggcatgcacctgtggtcccagctacttgggaggctgagctgggaggattgcttgagccagggaggtggagggtgggtacagtgagccgtgatcgtgccactgcgctccagcctggacaacagcgagatcctgtcgctaaaaaaaaaaaaaaaaaaaaaaaaaaaaattctcggggaaaggagccccaggagggcaggtcggggagcactttcactgacaccccctttattaccctctacatctgtgtgtataccaaaggccaccaggtcatcaagctgtagtgtcaggccctggtccttggttgagacaagatgcctgaatgtttcactgacaggggccatgctggggaaatacacagtgtggttctcccaaataacccacactttgcagtaggtcaagttaggatgagaagcatgtccccagctgaagggggccgccctgccacactctcacccctgtttctccatgcagcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtaagggatctgctctgggggctttggttctcccatctcttctccttgctgaggaccaagtatctatcccgcagcctgtgaccctcacccatttcaattcacccaagagcagagcgtaaggcatcctctgctcccagacttccaaggtgcggctggtgaacattgcagccccgatcccatttgccgagccccgactgcagccaggttctaggctcagcctttcacctgcatgctgccctttcgacccctcacttggcgctgggaagtggatggtaaaatccccaattgacagggaaggacaccaaggcttggggacgttaactacttgccccaagctgaccggcagccgagtccacatccagcttttgctgccaaggggagctgagaggcacccctgcaggcttccttggccaaaaaaaatcccatctgatcacacagagggaccaccagtacgcagagagccaaaagggacttactagaaaaagctgcagagagcattattgttcctttctgtgtaactcttggatattgttcagtcagagaggtcaagcaacctgcccggggacacacagcttggggatggcccaagcagggtggcccgtgtttccctatcatccttccctggctcaggaaagtgtaatcgtgcatggacgagcttctaggcctttctgttcttggcactttcctggtcactgagattcaggagaatgagggttaaccgtgcctgccaaatctaaaataaacatcatgtcctagtatcattttatttatttattttttgagatggcgtctcactctgtcgcccatgctagagtgcagtgacgctatctcggctcactgcaacctctgcctcctgggttcaagcgattctcctgcttcagcctcctgagtagctgggattacgagtgcccaccaccacacccagctaatttttctatttttagtcgagtcagggtttcaccatgttggccaggctggtctcctgacctcaagtgatctgcctgccttggcctcccaaccccctaccattttagattaaataacggagtgctgaatagaaggagaagcacccctctcccctaaaaggcaccttcctgagggagcacgtggctggatcagcaggggacaaatcccaccccctcccctgccaagccagggtccctgcatggcgccgtccccgcactccccaccccgccttccactcagtgtttgccgtatgctgtgctgtgaatcccggtggtgtccgatggcgaactttgccctgattttgcaaaaggtgaaggggggcgactagaaatgaggatgagtatttcaagtcccttgagatttctagttcagtgttgtaaaaataccatttgagaacattgaaatagacattcgtgctcatgccttaaatttagcagagacttaataacattgaacttgtttggcccgtgagtgcagttttattctggaacttgagaacttttcaaaagagtgatcggatgcagcccctaaatatcccagggcggcatctgtgtcctgtggggggtgtttgtgcctatacatatgtatggccatatgggagcgtcagaaaactcgggtgtgtacacgcaactcggcaatcatctgcggcggaatgtcactcccaggccggctccccaggtcccaccagctcacctctgggcccccacctttgatcaggatgtggtcagaacaagcagacctttctaaatgctggcctggctcagcgtttgcagaggacaccagcttcgccagtcccaccggcacccactgccccacctctggagggatcttgtccctggaaccttagcctttcccggtgccaccaagtgaagagcaaggtgcttgtacacacctcctccgcggggtgtcagggtgacagccctgccatcttggcaggatcaagaccctgggatgagaccctcttccctccctgggagctgagagctgtggctgtaaccatggctcacccgaaagtccccctgtgccggggtctcagccaccgttgatctttaaatgcatattccctgcccacaagctgtcaccgccaccaggccgtggttctgtgctcagaagtcagccctagacgcgccctctgcgtggtgggtgtgcattgcagcagcatctgtggtgtcatgctaatagccaggcactgatggcctgtgtgttcggtgccactccaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccaggtaatgggggtcctgccacaggagaggggctgcccccccatagcaaggacctggtcacagcagccccacctgggctatgcagagagggaggagggaactccgccccaggaggtggccaaccacactccccaccgtgggctggtgctgggggacagaaccgtccccttcctccacaacctgttgccgtgggactgacttcagtgtttaggagagatcatgcctgtctaattttataagcagcagaaaatgagttaccaatttaaaaaatgctgtttatacataaatacaggtaaaagtcaagtagctgaatcagggagtcaggaaagaaagtcagccaaaggtacaaaagtggaagatgtcacaggcgaaacctttcacctgctcccggcccgggggcctggccttgcaacagcagcgcctccccggcccgtgggtccccatgcccgcccctccccaggaggaatgggaagcctccccgggccttgccacattcagttaggaagctttaagccctgggccgcgttccttcctttaattataacctttttctactttagtcctccactccgtgacatcgctccaggacccgctgcagcagggctgtgtgagctcaggtaagcagccagtttctgttgcttttgcatgaaatgtctcactgccttttctgttgtcccgtgctgtggtctgtcccggcgagactccgagggaccgcacattctggatttggggagctgaaatatggcatcctatctgcaaacggggtccctctctgtgtcagtttctaatggagagcgagctgacagtgcatggagggactctgccaagatttgcacgcccactgtcatcctttgtcggcccagagccttgtgttcagggctggggtctaagtcggagacagattccccactcagggggcttaccgtctgataggaagggataaagcacgggcacacgtccctctcctggtggggtcatgtcgggggacttcttatctaaccggaagacatccaggcagcctctgagcaagaaaatggggagctttgagcttgagcagtgggaaaggtagggtagcagaaaggaaatggccaggaagcccctgaagacagctcaggtgtgaacgaatggagagctggggactgagatctgagcctgggagcaggtggtggcggagagtggtggctgcaggctgagaaactcgggctccttcctgtctgcatttcacagcctcgaggtctccaaccacacttgttctctttgccacatggtgcctggacacagcccaccgaggctgacccatggccacggctcccaggctctcgtctgcgcccccccgcctcccttctcgtgcgccaatcccacacttggagctgagcttttcacagccagcttttaggaacagccagcactgtgagctggtcctctttttccctttctgtatttttctaaacatgttgattcgtctccatatcccattgattcattgaaaacacaaacaaagctaacaggagcacgaagcccgccagcttgccgcaagctccacgagggggaacatgtgtagcacggggaacagctgtgtggcagtggctgctgcttctacaagagaccaaaccctcatacagatgcagccggggcacctcggtggcatccaagtccccagttgagagttctgcgtgttttccgtgttctgatttgactctgaccaacgtgggggtcgagaggctgcatctcacccgcgccgtgggtcttcttggctggacatctaggtggagcgggtgcccattggaagaagggatcactcattctggcttggccaatttaattagaaagtaccaagaactaatccagcactggctcgagttcagaatacttcaggggaaataatggacatagctgtttgtgctggagttttacggacgtctgcttggaaagttagccttgaccccctgctctaacgggaagttggccttcttgaaactcacgagagtatttgattccattgaggcaggactgaacttggcagaaagtgactaatgtattctagatcaaaaccccttgttagaccaggtgcggtggctcacgcctgtaatcccaacactttgggaggccgaggtgggtgcatcacctgaggtcaggagtttaagaccagcctggccaacgtggtgaaaccccgtctctactaaagatacaaaaaaattagctgagtgtggtggtaggagcctgtaatcccagctagtcaggaggctgaggcaggagaattgcttgaacccaggaggcggaggttgcagtgagctgagatcgtaccactgcactctagcctgggcaacagagcgagactccatctcaaaaacaaaaaaaaccctcgtcctacataaaacaggaagtctcccctggtgccaggcctgctaatgatcgatgccagaagcaacttctatgtgacggaacaaatccttgaagaatgacgttttactttgtattgtaacggatcatcgccactgtgctggaacgtttgtacaacagtcacatttcaaacctaggaaaaacacactaggctcctaagaggaatgtaaatgatatttgtaaaatatcaattgactttatagaataaagttagttaagactcctgggcaatctcgcagattggaagcaggagagagaaaaaggcgatgagcccctggatgaaacggaacagagtgtagaagttgccagtggtttttgtgaagaggcagcagatgggtgtgtctcccccacccgccttccatgtcattccagcaagaggggaggttgagcacaaatcacttacccaaaatcttgaagtcataggaaagccaccagcagaagcaaaaatcgtggtgactagggagaaaaatggaaaaagatttcttatttgcaggaaaaaatatttttttttttttgagacagagtctcgctgtgtcacccaggctggagtgcagtggcacaatctcagctcactgtaacctccacccccccaggttcaagtgattctcctgcctcagcctcctgagtagctgggaatacaggtacccatcaccacgcccggctaatttttgtagtttcggtagtgacagagtttcaacatgttggccaggccggtctcgaactcctgatctcaggtgatccccccaccttggcctcccaaagtgctgggattacaggtgtgagccactgcacctggccaggaaaattttaaaaaattgtatagcataatgatggccaagtgaaaatatttctctggaccaggaagactaggagggctttgccagaaagaaaagagattatcatatggttttcctcgtctgaatctttactatcagaggttacttttcaagggagtttcacacagaggctcacatctgtaatccaagcactttgggaagccaaggcagacagatcacctgaacttaggagttcgagaccagcctgggcaacatggtgaaaccccatctctacaaaaaatgcaaaaattagccaggtgtgatggcatgcacctgtagttccagctacttgggggactgaggcgggaggattgcttgagcccaggaggtcgaggctgcagtaagccaagatcacgccactgcactccaagctgggtgacagacggagaccctgtctcaaaaaaaaacaaaagagaaaagaaaaaaagctatgttcacagtatatggagtgtgtgtgtgtgtgtgtgtctgtgtgatggagtctcactctgtcgcctaggctggagtgcagtggcacaatctcagctcactgcaacctccgcctcctgggttcaggcgattctcctgcctcagcctcccaagtagctgaaactacaggcatgcgccagcacacccagctagttgtatttttagtagagacggggtttcgccctgttggccaggttggtcttgaactcccaacctcaggtgatccacccgccttagcttcctaaagtgctgggattataggcatgagccaccgtgccccacctagtatatggaatttaatttagaaaaatagagttgctaacagtggtttttagtaaatccttgggattagtgacatgagagactagaatcttccttgactgtgtctctgtggaagcttccagcagtgctgcccctgaagcaggagagcgagcctctgtcctaagattgctacaggattccgattccctgttcttcccatggctaccccagaatcctttcaagaggcccccagacccagaagatgctccctccattgcttgcctcaagtagctcgccgtggtagaaccaatgtctgcagaaaggtcattgcaagcccggcttggcttcttcctgaatgtcagtgagaaatgctcagtgcttgagattctgggcctcgaagatggactggcggttggttttccttcccaggtaggcagggactttggacaacttgctcagccagccacagccctgcagtaagggaatcgggcttacagcggagtccgtgggggcggatggctctgtgctctgtgctcggttaccatggtgatcaggtgccctgcgctagagtggcctcgcccatctgaacagcaagctgctggcccaggagtctattttcttttcctcactgagagctcccgtcagccttttcctgccgggctctgttgccttgtctgtccttccgttttccttaatgacttagacgccaatttgccaaaaaggagagagaaactgacatttcattcacatcatcactttttcctcttggtggatacaactggttctgaatgttcctctaagaatccgagcatgggggtgacgggcttgggcattaaggaaatttgatgccatttttaagcagcagcgtcactagtgacccaccactttttcttagacactgttgaggccttgaaaaggcgtaaggtgagcggtaggttccatgccagtcatgagtaactttttttttaagaaaaaggatttttaagagacaaatcttcagatcagttacctgttcatagatttcctggtacgtcttaactttctacaaatatttttttttgtttgcttcttgcaaaatgcccagcaccttgggatataaaggggggtgtagttataaccagggtcatctttgatctcatttggaaaacttcatttcaagatggagttgcaggtggtccttggggactgattctgcaagccccttttgtctgtcagtcattccaggcttcatccctcatttctggacctcacactacttaaccataccaaatgttcatagaggagaaggtagaggctcattaaggcttgtttgctcagagtgtggccttcttatcatttagcaatttattgtatcttattctatttattttatttattttttatagacagacggggactcactctgttgcccaggctggagtgcagtgacacaatcacagctcaatacagcctcaatctctcaggctcaaacaatcctctctcctcagcctcctgagtagctgggacttatagacactttccaccacactcagctaatttttttattttttgtagaagtgggtctctcttttttattcgtttttgtttttgttttttgagatggagtctcgttctgtcacctgggctggagtgcagtggcgcgatctcgactcactgcaacctacacctccggggttcaagtaattctccttcctcagcctcccaagtagctgggattacaggtgcctgccaccacacccaggtaatttttgtatttttaatagagatggggtttcaccatgttggccaggctagtctccaactcctgacctcgggtgatcctcccaccttggcctcccaaagtgctaggattacaggtgtaagtcaccacacccggccttttttattctttatttccaaatacccaagtaacctggtctctgttgccagggctggtctcaaactcctggcctcccaaagtgctgggattaccgatgtgagccaccatacccggccactttgtaactttttaatgtgggagcgtttcattgctgtggctaacaagctgttacgtctgcattcacactggcttcaggtgtattatggctatccaggtggaaggatggtcccctgcccttggctgaatcgtgaaatacccagctctttcctggcgtgttaggaatgatgggttccaagccttctctgctgcctgttgctgttcccagtcagccaacagagtatcagttgcctctttgagaagacagctgctatggtctgtctctaatgtgggtggtccaatgtgtgcccctctttgacgtgaagcccacggggccgtgggctgtccatgaccttgtacaaccaggagattccccttggctgcagcccctatcgcggacaggtccacgttccttttgaatgtgcatgcgtatcatggtcatggctcttagctggttcccaccagacagccaggaacacgtgtccagggctcgtgagctttgaactctgcagtaagattctaaagcagtgtccttgataagcagtcagtcggctctcccacattcatggctaacagtcagtgtcgggggcatgtggatagcatgttcatagggacaggagaggctgattgcacccctgggcattccacagcactgtctaaagcaggcaggggccaggcgcggtggctcacacctgtaatcccagccctttgggaggccgaggtgggtggatcacttgaggtcagaagtttgagaccagcctggccaacatggtgaaactcggtctctactaaaaatataaaaataagtcaggcatggtggcttgcacctgtgatccctgctactcaggaggctgaggcaagagtatcacttgaacccaggaggtggaggctgcagtgagcaatgatagcatcactgcactgcagcctgggtgacaaagcgagaccctctccgcccgcaaaaaaagaatacctcttcaattggagacattaaagaatcagcttttcggctgggcgcagtggctcacacctgtaatcccagcactttgagaggccgaggcaggtgcatcacctgacgtcaggagttcgagaccagcctggccaacatggggaaaccccgtctctagtaaaaatacaaaaattagccaggcgtggtggtgcacacctgtaatccagctccttgggaggctgaggcaggagaattgcttgaacccgagagacccaggttgcagtgggccgagattgcactattgcactccagcagggtgacaagagtgaaactccatctaaaaaaaaaaaaaaaaaaaaaaaaactcaacctgatctcggctgagctaagatgcaaagggactggctgtgccactgtgaacccttccagaggcaggtgaggcaggccgcgcgggagcagcacgggaagtcccggctgatgagatgaggctggggggccgccccaagagccacaggaggaagggcacatgcgcttctcaaaagttccttgatgtgtgatgtatagggatcactcagggaccttgccggaaagcccctttgtcactgtgcgtgacctgcttgttcagttccccaagcgcctccagatgcttgtgggattcaagatgggggctggccacatgttgctggaaccagcaccctgtgacatttatgcaggagaacatgggtatttgaagggtcttttgttcctaggacagccctgcctgggggaccctgcacacacagatcctgcacagatgtcaggggcagccagtgctgagtaccacagcccactttaggttttgtttcaaagcaacaaacgtcgctgtcatcaagtgagcaaggcagcctacgcaggctgccagcaccgccccagcaccctgcagtcccaccttccagcaccactcgtcacacacccttggggaaggctgctttgccagaactcggccccccaaagtctctgttcctagagcagaatttgtccctgtgcctcacccaaagagagggaagtcatagcccagagtcaccgatttatttgacttttttgtttttattatgatttgcaggattttttccaagaagtaaaatgcaccatagttacaaaatgcaagcattcaaacttacagtctttttaagaaatcggtcaccatccctccctcatcttcctgtcacacaccacccccacccccacaccccaccccaccaccatccccagtttgtcatgtgtccttcaggacagtcatgcacctaaatatttattccacgcagatggggggcgtgcaggcctcaaaaaggccgtgtgccttgcttttctcacttagtaacacaccgtggagaccttcctccatcagcacatggagaattttccctttttgtgtgtacatgtgtgagagggagtctcgctctgtcacccaggctggagtgcagtggcacaatctcggctcactgcagcctccgccttccgagttcaagcagttctcctgcctcagcctccaagtagctgggatcacaggtgtgcaccaccacacctgactaattttttgtatttagtagagacggggtttcaccatgttgctcaggctggcctcgaactcctgacctctggtgatccacccatcttggcctcccaaagtgctggggttacaggtgtgcaccaccacacccagccagatgtctgcttttaaaacagaatctagtcgcatcttcccacctcctttggtggagattgtcccttgcagatggtgcagggtactcctggtgccgcagtcctgtgagaggtgatctatatgtgcctttccaaagtctcgacttctacaaaatgctattccatccttggaagttgcctgttcattgaccaattccttaaagtggacacaaaaccttgagcttccagagtaagactatagggcctaggtcattgcttaggccatttggggccaagctagtatggaaccaggccaactaggctagacacagccggcgaggctgagggctcacataactctcgttcttcccgtcgctttccctggaccctccatcctggtgctccctggtttccccttctgaaaaggcccgacaggcccagtccagcttgtagacacatcccgttctctccccttcaggctttccatagaaaacagaatttacagcacattgggcattcagtacaagaggcaaaagtaggtcataggagcaaatgaggacttcagttttcagtggttgaattctagggaaggaatgaagaagcttaaatgcctagaaaccctcaggtgattgcagaaaggggggtgggaataaaacaagggagtccacatgctggtgtggtctctgtgccactcacagagctgatgtccgtaatccttaatcagtaagtgaggccgggctcagtggctcacacctgtaatcccagcactttgggaggccaaggcgggtggatcacctgaggtcaggagttcaagaccggcctggccaacatggcaaaaccctgtttctactaaaaatacaaaaaaattagctgggtgtggtggcggatgcctgtattcccagctactcgggaggctgaggcaggagaattaactcgaacccagaggtggttgcactgaggcgagatcacgccactgcactccagcctgggcaacaagagcaaaacttcatctcaaaaataataataataataataagtggaaatggttcccttctcttacggatggagtaaaccaaggctcagagataaaaggtgatttgccccaatcaagaagaaggtggtggccaggcgtggtggctgacgcctgtaatcccaacactttgggaggctaagactcaaggatcgcttgagtccaggaatttgagaccagcctgagcaacatagcaagaccccatctctacagaaaatttaaaatttagccgagcatggtggtgtgcgcctgtagtcccagctactcaggaggctgaggcaggaggattgcctgagcccaggagttgaatcagcaaatcagtgacagcatggaagccacatttactaggtttggctgttggaaaatgtgtaatccacctggcctaggctgcatggagtgtccatgctcctttgaaacctcttctggtctaaattcagtgaacgtatacacactggcttgaggtcctctgcctgctacagggcagccctgcctttcagctgtcacggccccccggagccatgccgacacccaggccccagccccatgcggactggcccgagggacctgccccgctcccggtgaggataaggaggggagtttcttaatggcattgccctggatagattgggagccaggcaggaggcttccatcggggcctcctctagattttgcgtttacttcttccctttggaaccggattcctaaatatagcccgagtctgaattggcagatgttgggtctgtcctttccttgacggccaaaattagtctgtcatttggcacctaaataaagcagccaaactacctttataccagctttgcaattaggcggtagttggaacattctatttgataaggaaacttttatggatgccttagcagcacctctgaacccaggaggctgaggagagaggacacccgggccccagagggacactccttcctcgccatcaggccttctcattccagagttaaggtcaattttgttccatgtggcttaaaaacacctcgtgaatgtggaaaagacagtcaatgctccccagaaatagcattctaagagcatggcaatggttactccaactttttttttttttttttttttttttttttgcaagcaaagaaaaatctgtccagagtgcctggagctgggttagtgcagggactccccaggggcagcagaaagatgttataatcaattatcacatcataacactgatgtatgataattactgagtgtttctcctgagatagtgcagcatttggctgggatgccgctctttcacggtccactgcctgattaatatgcaaataataggctgattgcatgatgaatgcagaaatgagttcgctgataacgtgagcaccgaagcgggaagatgataaattacttttactgactgtcctacattaagtaccctttctcaacaatttcatcacaaattaagtaaagcagtatggagagattaggaggacgtgtaaaataatgtaccttaatggtttttctaataccatcgtggaagacgaaaatctcaacttggttctgcccgggtctttgtagggccaagtgagttcactcacctgggcattgagtggaagacaggaggcaccccaccacaccggcgtgttccacgggccatgatcagccatggattctctgaggaatatcccattgcagcccagacattacccgcacactgggccaacaggcagcatcatggagggaggaggacaggctgctctcggggcagacgcagcatcctccacacagatgggcacccccaagcctgctgtccaccatgtgcctgcaggaaaggagcatttctgggctgcaggcctggaagactcggaaagaaaacaacatttaagacctcctgcctgggcacagtggctcacgcctataatcccagcactttgggaggccgcagcgggaggatcacttgaggccgggagtttgagaccagcctggacaacatggggaaaccccatctctacaaaaaatacaaaaattagccaggcgtagtggtgtgcatctataatctatagtctatagtcccagctactttggaggctgaggcggaaggatcattggaccctaggaggtggaggttgcagtgagctgagatcacgccactgcactccagcctgggcagcagagcaacaccccatctcaaaatttaacaaacaaaaaaagacctccttgacctctttttagctcttccaagtctcagaaatctggaaaaattaatttcactattagaatggcagtgggcacaccggccagagagcatgacttggtaagggatgggtaggtttgtccaaagccagaattgaacccttgagaaaaagagggcgtgcgtgtgtgcgcgcacacacacactctcccccccacacacacacacccacacacgcacacacactcccacacacacactctcccacacacacactcccacacacacacacacactccccacacacacacccccacacacgcacacacacacactctcccacacacactcacacacacacactcccccacacacactcccacacgcactctccacacacacatgcacacagagtcccacacacacttctgcacacacacactcttccacacacactctcccacacacacactctcccacacacacccccacacacactctcccaccacacacacacacacattctctctccctcacacacacattctctcacacacacattatctcacacacacacacacacacacatttgcagtgattaatctttgattacagcaaagcaatttaactagaggctttgttttttcccgtcttagtaatatatatttagactgtttgtatgacatacattttgtcttaatgcacagggacgcattgataagtgttcgtacacacagctggcttggtaataaggttattgaaggtaatttgaaagcatcatttctaaatcagtatggatctgcagaaaagccggaacaaggcgagcctgtgcccctgaagcagggccatctgtgtcacccagtgtcccttcagcaatctggccagactgagttcactaccaaaatcgaattgtaatttaagcagggtttttaatttttaatatcttcaagctctgcttttgatatgcttatttccttaagagcttataaaagatacacaagccaactgagcccagagggaaagtgactttccactccgaatccccggcaggtcccctccccgcccgcgggtgagctctggttctgcgcaggttcccgccaaccacagggcctcatcacctctgcagcttcctcctcgtgcatttcaggccaacacagaatttctaagatcatttctccccaccgtaccttcccatgtcggggagatgaaagaggagagtcgaaaaccatccccagagggagggaggctccagatggatgccatggtgtctagagggagggaggctctggatggatgcgatggtgtctagagggagggaggctctggatggaagcaatggtgtctagagggagggaggctctggatggacacgatggtgtctagagggagggaggatctggatggacgtgatggtgtctagagggagggaggctctggatggatgtgatggtgtctagagggagggaggctctggatggacacgatggtgtctagagggagggaggatctggatggacgtgatggtgtctagagggagggaggctctggatggatgcgatggtgtctagagggagggaggatctggatggacacgatggtgtctagagagagggaggctccggatggatgcgatggtgtctagagggagaaaggctctggatggacacgatggtgtctcctctagttagaggagctcatggttgacttctcagagcaacttctcactcgcttggcagcagggacctgtcacacccctgtgctgtggccaggaccatgttgcctgcactgctgcacctccagaccctgccctgacactgctctccccagaaacaccctcgtcccagactctttgtttgagtgacctgcttagtgacttcggcctcccgctttggttacaagatgtgggggcgcagggtctgccttgctcacggctgtacccccacacctggcacatggagggtttccccattgtggaaagctcaggtcccatcttcaagtaacttagaagtcaggtttggggaggtaaaatacaaatcacacaagttaaacaaccttgctctaattgaaacaggttttctttggggccagatatggtggctcatgcctgtaatcccagcactttgggaggccgaggcaggagaatcacttgagcccaggagttcaagaccagcctgggcaacatagtgagaccctatctcgacaaataataattatagtaaattagctggaatggtggtatgtgcttgtagtcccagctgctcaggaggctggggcagagggattgcttgagcccaggaggtcgatgctgcagtgagccgtgattacgccactgcactccagcctgggcaacagggtgagaccatgtctcaagaaaaaaatcaagagagaaagaattttggctcccatgtcattataagagtttctcgggcaaacctaaaaacatatattgttggccaggcacggtggctcaggcccataattctagcactttgggagtctgaggcgggaagatcactagagtccaggagttcaagaccagcttgggcaacatagtgaggccccccatctccacaaaaaattaaaaataaccaggcatggtggtgcacgcctgtcgttccagctactcaggaggcaggggtgggaagatcacttgagcccaggaggcagaggctgcagtgagccaagattgcaccattacactccaacctggacaacagatcaagaccctgcctcaaaacacacacacacacacacacacacacacacacacacacactatggctatatagttgtcacacagacacaccccagcacctactaggtaccagagactttgagttcatcttatcctattctttctttagtccctgcagagggtgtgtgtgtgtgtgagagagagagagaaagaaaatcattgctgttccattttatagaagaaactggcacccattggtgggggtgggggggacattgatctttcctggagtggggcagagctaccacccatcccctctagttcctctgaggcatcttccctcccactccaacccttctccacctcctcccccacaccccctacagaatctttctcaggttctttctgctgttgaaaaacagtgatttgataggtttggggctggcaagggatgtgcccaaagcttgatgctgccacttgtaagggcacagaccttcccagggggcagaaggccaacccaggaccctcgggaattggaccttcgcgtcggccccccgctggcgtcaggcatagctgctcaccttcttggaaagaaagccattttgtagtttggccacgctgggtacgtctctgatattccttaggatgttgttgggctacttttgtttctttcatggtaaggaaacgtccagtggcccaggaaggaggtgcagaaagctcatgagtgtctctgtgacatctgctaaagtcgctgcatattttgtttcaagctcttgctaatcagtcaagatgccagtcttactcaaaagaagaatactgtaggtttttatatgggcgatgtctaatggagatggaggactgttccgatggagattcagcagggctgtgagcttctgctgctggattcagaagcaaggcttgggaactgaggagcccagcgtcgctgccatggttgaggaaagccttggtgttcagaaatttcggagctggtcatgcaagggtgtctcatgtttgtgatatgagcctgtatgaccaaaatacaggaggccagggccgggcacagggccgggcacagtgggatcacacctgtaatcccagcactttgggaggctgaggcaggcagatcacttgaggtcaggagttcgagaccagcctggccaacatggcgaaatcccatctctactaaaaatacaaaaattagctgggcctggtggcacacacctgtaatcccagctactcaggaggctgaggcaggagaactgcttgaaaccgggaggcggaggttgcagttagccgagattgcaccactacactccagcctgggcagcagagtgagactccatctgaaaacaaaaaacaaacaggaggccaaatgagcattgctgttcccctttgatgctgagaaactcactccaggcgtaaaccaccagggggtgtggtctgtttagagcacagggtcagttccggagcaggtctggtgcccacatcacgatctgtccctctaaacctagctaggaagtatccaggctggtggccaccctgttgtgtcttctgaagctgtcagcaccggtcgctggaaaggcccgcaggctgggaagagtctttctgagcctctagggctcctgccagccccggcatgcccacaccgggcacctcagagcctgccgtgcatccttgtatcttgcaccagtccccgccacctccaggcccatccctccctcgggctctcctttcctctcctccagggctcccttgatgttttttatttgtgtttttttattttgtattttattttatttacttatttatttttttgagatggagtagctgggactacagacatatgccaccacacctggctaatttttgtatttttagtagagacagggttttgccgtgttagcagggctggcctcaaactcctgacctcaagcgatctgcccacctcggcctcccaaatgttgggattacaggcgtgagccaccgtgcccggctcccctgctcattcacacttaatgtgccaggccacgaccacctcccctctcccctctcccctaacctcctccctccttccacccgcccttccatacgtgtctgtctgtatagtcattggaatttcctggcttggcatgggctcaaagccgaaaccatggacagaatgaaaagtggcgcatcagaccagccgccagttaaataatgtttgggttcttgtcagaatgtcacggagtaccctgtcattttgtttcagcaacttgtccttctgaatgcacagttcgccttatggcatgccagcagtaaaaatgtcacttacaataattactttttggtgaaaatgcttgctgacttcccaccttcaagctgttttttacacagtggggagataataagaaacgactttatcctgactgctcaaatgaacactaaatggaatttgggttcttattactgcagatagagggccgggtatggaaatttcaacagtagatcggaagaactgcagagagatgtatctccgagaattacggcgggtgcgggttttcaattggctcccattgaaaacttaaggcagctgttgtttgcctgctgtttttggaatataatatttttcataatccttttatagttcgtgaatgccttgtgtatctcagagggccttgagtcactatctctgctttctgtagcttgctcaccaagctcctcttatgccagattcagtgccttgtaaaaaaaaaaaaaaaaaaaaaaaattaattcacatagatgactttttaaatgtaacaccttactattgctgtcaaaactggatggatggtactgtgcagtggggcttttaaaatatgcaaattacccattttcaattgtcctggtcctgcaggctgcagggtccttggaagcgaggtttttgtctgatttctcccttatccccaagacacagagtaggtgctttaaaaatatgtgagtaggctggatgcggtgactcatgcctgtaatcccagcactttgggaggcagaggtgggtggttcgctggagcccaggagttcgagaccagtctgggcaacatagcaagaccccatctctctacaaaatatacaaaaattagccaggcgtggtggcacacacctgtggtcccagctactttgggtcatacattggcaaggaggctaaagtgggagggtctctgaagcccaggaggtcgagactgcagtgaaccatgatcacaccactgcattccagctggagcaacagagcaagacctcgtctcaaaaaaaattaaaatgagagtgaaatgacgcaggaatgacggtaggctgcaattcagaatcacgtggtgttggcagatagcaggatgggtaggaaggtcgaggttttcccctcctgatccttgcaccatctgtgtgactttaaccaagtcacgttgcctgtctgagcctctgttttctcacctgggatgtagggtgtaaatttccaccccagggaccattgggagaattgaatgaagccacatgcagacgccctcagctcgctgctccattcacgcctggtatgaaatgtgttttggttcccttccacaatcctatgagtggatcagctttttgtgactcatcgttaagtcttcgagattcacgcatgtcgatatgtgggttgtagaaaaactgtgcctgggaaggcaggcacagtcactctgtcactaacgcacacttgggcgcagggtgcaggcgccaccagctgtacaggggctgtttagaatatggcccatccacctagctcctggctgtgtgtctcggggcaccgtatcttttttttttttttttttttttttttgagacagagtctcactctgttgcccaggctggaatgcaatgacacgatgtcagctcactgcaaccgccacctcccaggttcaagcaattcccctgtctcagcttcccgagtagctgggcacgcgcctggctaatttttgtatttttagtagagatggggtttcaccatgttggccaggctggtctcgaactcctgacttaaggtgatctgcccacctcagcctcccaaagtgctgggattacaggcatgagccactgcgcctggccagggcaccatattttacctgtgtaaaatgtgggaagtggccgggcacagtggctcacacctgtaattcagcacttttggaggccagggtgagaagatcactcgaggccaagagtttaaggaccaacctgggtaacatagcaaaaccctgtctctattttttaaagtttaaaaaaagtttaatgttttaaaaaagataaatgcatcatacaggatgtggccttttgagtctgtcgccagcgtccctgtcatgtgtcaggcattgtgggagaaatagcactcagtcataagatttatgttgactgtaggtctttatagaaacaaatacatttgaccaggtgcagtggctcaccctgtcagggtggcgagggtgaggggaccctctgtgcagcggggagagttggcttcctgtaggattcactgtctgtcctaacagaacaaaaatatggtcaatagaaaagaaacattacttctcctttcaaacattagcagatggagccctgtgattaaaacgatactttctgaaacaacaaggctttgctctgttccatgcaattaaaaataataataaaaaaagaaaaaaagggtcaggcgcggtggctcacacctgtaatcccagcactttgggaggccaaggtgggcgggtcatctaaggtcaggagttggagaccagcctggccaacattgtgaaaccccatctctactaaaaatacaaaaattacctgggcttggtggcacgaacctgtaatcccagctactcgggaggcagaggcaggagaatcgtttgaacccgggaggcggaagttgcagtgagatcgtgccactgcactccagcctgggcaacagagggagactctgtctcaaaaaagagaaaaagaaaagaatgactttctccccaacatgatgttctgagctcgtggattcacggtgtctccaacgcgtctgtttgctgtggcatctctccatgcctgtgcaaaaaacatgtactcaatcctgtttctttgacctgagaccatagccacaactgtgcatgcagatgtctgttggcgagtaaactatctcccaggaagagcatgcagcttccagctgtcttctacattttatttatttatttatttatttagagacagagtctcactctgtccccaaggctggagtgccatggcacgatctcagctcactgcaacctccgcctcccccattcaagccattctcctgcctctgcctccccagtagctgggattacaggcacccgccaccatgcctggctggtttttgtatttttagtagggagggggtttcaccacgttggccaggctggtctcaaactcctgtcttccaagtgatctgcccgcctcagcctcccaaaggtcttctgcattttagactcagattgagagtggagagacagatacaagccacctccagcaaccagccgccacatgtcactttcacatgcctggacctctcagggctcggacagggctttgatctcagggggcctgcctttgtctgtagtcacagcctggagcacagagggacacctgtaacagtagtgagcgcccctgtttagttctcctgggggttcatgatggcacaaatccacgccactggcttgcaaggcgcactggaagaaagaactgtacagcctctgagtttcgtggtggctctgcctccgccagcacccagaacaaaacagggagatgccacagcagccggcaccacactcggtttattagccagacagccatgatgttgaccttgctgtgggttaaaggacacaaaacctgaagagaaatctgtttatcatttgggaaattcatgccatccttgacagtatctggtgagcaagatggatgatctgccaggccggcccctcgcatgggtgaatcacgccatccttacggtacggttcctctgccggcttcagacacaaaaataacatttgtggggttttatatccagttctctggtgacccggggggtgagcagagagaagaaatctgatttgtaagattcacattgccctaaagatttatacggaccatttctgcctcttacgcttgtctcttctacatctttcaaaaaccggtttggcatgtgtttttctctttgtaacctgatttcccaggtcaaggacacagccttatgcgatggcggaagtttgtgccggttcaggacgataaacgggttgatcgcttaagttgcaaatgttttatttgaggttttgctctttctaggtatgaatacaaaatattccttgtagttggaatgtatttatggcaggttagtgtatcctggatacagtatgtccagaaaaggactcttaagataaatggtaaattgaagttaagttgctgctctatgctacattttcttttcagccaggtaacaagtattttgggctatctactatggtgctgatgttgactgagtgacctgctagggcccaagggagaagcagcaagagtaagacccttggccaggcacagtggctcctgcctgtaaacccagcactttgggaggccaagaagggaggatcacttgaggccaggagttcagcctaggcaacatagcaagacctcatctctacaaaataaaaaattagacaggtgtagtggtgcaagtctgcagtcccagctacttgcaaggctgaggtgggaggattgcttgagcacaggattttgaatcagccagggcaacctagcaagaccccatctccacaaaaaaaaattttacaagaccctgggagcagagagcatggcctgggccctcttacctggcactgtggggtcttactctgtgtcaccctcagtgggcatcaggggagagattgtgccaagacactgagctgggccaggggcagattctgccttgcaggcaggacctcagcccgaagccacatcttcctccaggacagtttctatctgcagaaattaggaaatggtctaagtctttatcccagacatcccagaactggaatccagcctcttttatcaggttttatgggctgttatcagaggccagagggatcactcaccaacagagcccagctggcatttcccactgggcacccacggcgaccccaacaaggcagaggagagtgtagactctggcttgtccacaccagcccagtcacttctgctgttggttacagcatggcttataccagcaaagagctcggttttcagaagcaggcagaaccagcaagtcccaaggttggaggtagaactctaaaatggaagagctggggaaacagggtgctcctcctctccttgcctctctccatcttcccctagagttgggtgctgtggagttctctgctcttcacaacaaaaaaacagctgggcatggtggtgtgcacctgtggtccaggaggagccgtgattgcaccactgcactccagcctgggccaccgagcaagaccccatctctaaaaacataaaagtaaaaataaaccaacctaggtcctgagacccagtgctggaggaccagaagctatagccttatgtttccgcagttgttgttttttttcttttttgagatggagtctcactctcactctgtcacccaggctggagtgcagtggcacaatcttggctcactgcaacctccacctcctgggtgcaagtgattctcctgcctcagcctcctgagtagctgggattacaggcgtgagccaccatgcctggctgatttttgtatttttagtagagatggagtttcaccacgttggccaggctggtctcgaactcctgaccttagatgatccactcgcccagccacatttcctcctaagggtcttcctaactgtggtgactacgtattgtgggcagccctcatttaaaacaatctgtctatgctttttgttctggaaaatatggacaacataactacacaagttatgatctagccaaagtgcttctgaattaccaaattatggggtttcattagaagaaatgacagcgataacatgattaataggagtttttttagcagaatgccctcatgttaagccttccgaagcctttcttttaaacccctagtttttctcgcaatgatgttatttttgttttttaatatggaagactagaggttactctcagtcaaaaaaatatgaaacagttcactaagacccacagaaaaccctaccgtctgcttctcctacagagcgtttaattagtatttcctagataaggaacgtagatggtcgtggtaaaagacagctattttcaggcacggtttctcgtgtgctttaattacagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggtaggttctcctctcggctgctgagtcaggaggtggcagggagtttgcaggaggagcaggtgaagggcgggccctaggccaagccaaccacagagtctcaacttgtgtaggcaccctttgagaacatgaaacatcctatagttgtgaacagtaaggagcgtgccgtctgcaggtcagtccccacctcctccccaccctgcacccccacggggaccagttagaagatgagcatggagtcagagtggactcgggaggatccacacagactgtctcttttttttctttttttttttttttttttgagacagtcttgctctgtcacccaggctggagtgcagtggcacaatctcagctcactgcaacctctgcctccccggttcaagtgactgtcgtgccccagcctcctgagtagctgggattacaggtacctgccaccactcctggctaatttttgtattttcagtagaggtggggtttcaccatgttggccaggctggtctcgaactcttggcctcaagcaatctgcccacctcagcctccaaaattcttgggatcacaggatcccaagccaggcatgagccatcgtgcctggcttagatgtatctcaatagagacagtctgagtaagtccagatttcttgaggccacagtctgagaccagcctgggccacatagcaagaccccatctctacaaagaattttaaaattagctggacatgttgatgtgcacctgtagtcccagctactcaggagcctaaggtgggaggatcacttgagcccaagagttcgagaccagcctaggcaacatagcaagaccccttctctataacagatttaaaaattaggccgggcatagtggctcatgcctgtaatcccagcacattgggaggccacagcaggaggatcgcttgagtccagccaggagttcgagaccaacctgggcagcatggcaaaaccctatctctacaaaaaatgtaaaaattagccgggtatggtggtgcacgcctgtagttcagctactcgggaggctgaagcaggagaatcgtttgaaccctgtagttttaggctgcagtgagctatgaccatgccactgtacttcagcctggacaacacagtgagattctgtctcaaaaaaagaaagaggtagacacccattagagcctggcatcctcggggctccagagctgggcagcgtccacccggcagtgccaggatggcttagtggaaggtctaacggaccccggttctcactctgctcactgagtccgtgatgctggccaggctgcctgcattctcagatccccctccacgaaactggagtaaccacgcctgcctgggagcagtgagtagcagcattttctagcaccaggcccgactggtaataatagtcattgttattttatcattgctgttcccgctgccttgcgaagccatctccatttcacagcccacagctggggcgggcagcccctggggaactcactccgtcaccctggcatcccaccgtgcctcagacctggcctcggcctggcacatgctctagccccctgggtgctcggcctgggttggttgtctgtgctctgtgtcactggtcatcagctgctgtggctgtaagaatgttacggtgtttcatcttttttttttttttttttgagatggagcctcactctgtcgcccaggctggagtgcagtggcgcaacctcagcttactacagcctctcggctcactgaatgccgggttcacgcgattctcctgcctcagtctcccgagtagctgggattacaggcatccgccaccgtgcccagctaatttttgtatttttagtagagacagggtttcaccacgttggccaggatggtctcgaactcctgacctcaagtgatccacccacctcggcctcccaaaacacagggattacaggcatgagccaccgtgtctggccttttttttttttttttttttttttgagacagagtctcaccgtctcactcaggctggagtgcagtggcacaatcgcggctcactataatcactgcctcctgggttcaggcgattctcctgcctcagcctcccaagtagctgggattacaggtgcccaccaccacgcctggctaatttttgtattttcagtagagacagagtttcaccatgctgccaaggctggtctcgaattggcctctggcctcaggtgatccacccaccttggcctccaaaaatgctgggattacaggcatgagccaccacaccagccaagcctattttgtcattttaaaccaccgtgctcctccagtgtggtgttaaccaggcagggttccctggtttaggcacgcggagattggaaacccaccctttctatctttatttcccaagggtgaaagtcagttaaaggggcagtgttctctgcagagcatgtaagcacaaccctaccgagtggttgcagtttgtctgctgctcatggaaaggccttgtgtgtcttttctttctcccatgggatgagaagagaagggaggccgagcatggtggctcacttgagaatgacaggtggcctgtaaccctagcactttgggaggctgaggcaggtggatcacctgaggccaggagttcgagaccagcctgggcaacacagtgagaccccgtctctacaaaaaaaaaattttttaaaaattattatccaggcatggtggcacccgctgtaatccctgctgcttgggaggctgaggtgggaggatcacttgagtccaggaggttgaggcagcagtgagccacggtggcatcactgcactccagcctgggcaacagagcaagacactatctcaaaaaaaaaaaattaaaaaaaaaaaaaagaacagagtagctgagttccactaaagtttgctcagtgatctaacagcctggaggttaggccagcttgtccagtggaagcctcccatccccatgtctgtatgcaacagacaaaacagaatgagagaaaaagtcatatcaatgagaccttatataattaagtcaattcataaaaataaaaatgtagctgttgatttgaaaaaatggctaattcccatatgttcatcagttattgaatcatgcagggattcctagacttgagtcatctcccacttcatagctcgtcacacatccaaggaagcagaccagttgcatcactcctgcccacctccttataggaagtggcatttcgtgtaaatgttgaaaatcagatagggtctagctctgttgcccaggccggagtgcagtggcacgatcatagcttactgcagccttgaactcctgggctcaagcaatcctcccacctcagcctactgagtagctgggactacaggcacacaccccaagcccggctattttttttttttttttttttttgagatggagtctcgctctgttgcccagggtggagtgcagtggcgcgatctcggcttactgcaatctccgcctcccaggttcacgccattctcctgcctcagcctcccaagtagctgggactacaggcgcccaccaccatgcccggctaatttttttgtatttttagtagagacggggtttcactgtgttagccaggatggtctcaatctcctgacctcgtgatctgcccgcctcaacctcccaaagtgctgggattacaggcgtgagccactgcgcccagcctttttttttttttaaatagagatggggtttcaccatattgcccaggctggtctcaaaactcctaggctgaagttatcatccatgccaccatcattgctggagttttccttgatgttggttttactgggtgaaggtttgtagctttcttcaggctctcaaatgggtctgtagccccaaaacaattaaaagtcatggctaggaaacatctaggagtcatacagataattttccaggaataatcatctgatttttttttccccattcagctgggaggcctaagcaaagagcaactagctattcatatatattgctttcccgaacatagcaagctccttgaaatgaaaatagattcttttaccatgttagcattaagtaaaattttctctttttttttttttttttgagatggagtctcgctctgtcacccaggctggagtgcagtggcacgatctcggctcactgcaagctccgcctcccgggttcacgccattctcctgcctcagcctcctgagtagctgggactacaggggcccaccaccacgcccagctaattttttgtatttttagtagagacggggttttactgtgtgagccaggatggtctcgatctcctgacctcatgatctgcccaccttggccttgcaaagtgctgggattacaggcgtgagccaccgcacctggccaaaattttcttataacaactaaaaaaaaaaaaatcataaggacttgggacatttataggctaaagagtttgaaaagcagagaaacacaggtttacaaaatcagtaaatttatctttaagttttttgttttgttttgttttgttttttctttttctttttctttttatcttaagtttaaaatgactaagccaggcgtggtggtgcacacctgtaatcccagctactcgggatgctgaggtagaacaattgcttgagcccaggagctcgagtccagcctgggcaatatagcgagaccctgtttctttagggaaaaaaattaaaaagactgataagaaattaatgtctcagcttcagtgctttctaggcagtaaacttttacttggaggcccccttcttagaagccagtgtgtggtgtttctatttcacatagaggatgtaagccacagagagaacaagccagccctctgtcgtctccctgccccggatggggagaggtgccttctgttctgtacactttatggggtcaaacgctggcccctctgatcccagtctccacttccacctaataagtcctgttcattcaagtactcccgtcaggccttccaggttatcactgatcctaatttgtatctttacaagcggtggccctctaaaccagcagcggaatggccctcagagaagtgagcctttctttctaagctcctgacaagcattgccaactcaatgcggctgtgctctccatagcgaaatgccctctgatcagcctgtgaagcgggctgcctgcccctgcctgggagaagaaaaggtatcaggaaaggggttttgatccacttccagttactttatttagcaaaggcagcctagactgcaaaagcagactttggaattggaatcggccggcctctcagaaaagcagagctgggcagctccctctcctctgtcctgctgtgattgtgggttgcctgccccgttttctcagcgagacctgataaccttgctaattgtggaaggagacgcaggttgccctctgatttgaggttgtacaagagaggtctcctgtttgctgtttggcctcctgagctctggcttagagatttcactgcctctgagaaacaccacaggtgttagcgtgacctcagcacatacaaagcctgaaggcttttttttttcctttttttttttttttttgagacaacggtctctctctctgttgcccaggctggagtgcagtggtgcaatcatagctcactgcagtctcaacctcctgggctcaggcaatcctcccatctcagcctcctaagtagctggaactataggtacatgccaccacgcctagctaattttttgtgtgtgtatttttgtagagactgagtctcactgtgttgcccaggctggtctcaaacccctgggctcaaatgatcttcccgcttcagcctcccaaagggcccttccggccaccgcaccaggctgaaggcttaagagaaacgtcactggccagatgcggtgactcatgcctataatcccagcactttgggaggctgatgggggtggatcacctgaggtcaggagttcaagaccagcctggccaacatggcgaaaacccgtctctactaaaaatacaaaaattagccaggcgtggtggcgagcacctgtagtcccaggtactctggaggctgagacaggagaattgcttgaacctgggaggcggaggttgcagtgagccaagattacactactgcgctccagcctgggtgacagagcaagactccatctcaaaaaaataataataataaagagaaatgtcattggttgtgtgtacggagaatgcaagagcaatgccaactccctggccaatggagagtattataagtctggttgaagatatatttctaccacatgtttgctgtaagctaggatgtcaccagcccaaccctgagcctttaaactcctgtgtctgattttaaccttgacacgtacttgtcccttcagatccctggctctcggtgacaatacctgtcttgcttctgttttctctctaggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaaggtaagtctccctgccccgcccgggccggctgcgtccgcattcatagacaggctgtttctttcaaatctttcacacacagctgatgagggacattgacccatgaccaagggaccagaggacagggcaaaaatatttttggatggtcatcagctaatgagtacctaagagggctggaaagttgtgtaactttttctctccagcagcctgaatctaaagatttttttagcactgggagcacttttaaccaaggagagcgaaacagctctgggggcgctgcatttggtttttgtgttgtgtgggtggctgatcgggctatcacagcatttactgagcatgtaccaggtggctagaggccttcctttgttatcagagagagaaataagaaatgcattttgtaggcagggcacggcggctcacgcctgtaatctcagcactttgggaggctgaggcaggcggatcacttgaggtcaggagttcaagaccagcctggccaacatggcaaaaccccctcactactaaaaaaaaaaaaaaaaaaaaaatatagccaagcttggtggcgtgcgcctctataatcccaactacttgggaggctgaggcacaagaatcgcttgaaccctgcaggcggtgaacagagattgagccaccgcactccagcctgggtgacagaccatgaccctatctcaaaaaaaaaaaatgcattttgtagatcaggaaacagaggttcagagaggttcggtgcctccaccaaggtcacccggcctggaaagtgacaaagcaaactcctgccacaacagatctctctcttgctgttatttcccagcctctggggatttggcctccctagaggaataaccccacgtgcacccacatgtcatctcgaatgtggattcatgttcttcttgcagcctgtaggctacagcataggaaaaatgcctaaagccaggtgtgctgtgcctcttggtttgcagtttctaagcgctggtcctcgccagtgagtccgcccctcgagcaccctcagtcctcaggtcacctatggtgctgggagctcactgggcggctgaactgcatcccttaggggcagagactgggaaccagctgctgccggtctgaccgtaagaagcggcagcctccctgatcagctaacgcagaggaccttaactaagagtgggcatcccaggggccgggcacagtggctcatgtctgtaatcccagcactttgggagtccgaggcaggtggatcacttgaggttcagagttcaagaccagcctcagcaacatagtgaaaccccatctctactgaaaaatacaaaaatcagccaggcatggtggcgcacgcccgtaatcccagctacttgggaggctgaggcaggagaatcgcttgaacctgggaggaggaggttgcagtgagcagagatgacaccactgcactccagcctgggcggcacagcgagaccccatctcaaaaaaaaaaaaaaaaagaatgggcatcccaggcccttgagtggctctgccccagcccaccccacccccgtccccgccacacacacacacacacacacgcgcacacaacatctgagccaggggtgggtatggaacccaggcctgtcagttcttaattcacccagaaattccagccaagcatcgccgttctcacccaacccgggaaaggactgctgaaggagagagagtgtctggtgcctcctccaggaaccctatgggggttcctttataataatagaggcttctattttctgagaactgccctgtttgccaggcactgcgctaagactgctgttcatccacacgactctgcttagatgtccttatccaggaaatacgaacctcggtgcttcatgcagcctagcagatttcaatagctcctatcagtagggaacgggaattcatactcagggctgtcagatttcaaagcagatgctcttaaatatacatccgctgcctctgtgctgcgagctgcccccctgggatgacccaggggcactgctgctgcccactgatgacctgcccaggtggtggcctctgccccattcagggcccctctagcgagctctggcctgcccttgggcctgtagtctaagggtctgaggtaggccatgcctcttgggcagccccaggcagcgctgtaagctgcagaggcctggtgccacattgcccccctaaaagttttcaacttatttttcgttttgttttttgttttttgttttttaaagtctcgctatattgcccaggctgatcttgaactcctggcctcaagcagtcctcccatctcggcctcccaaagcgctgggattacaggcatgagccactgcgcccggccttttcaatgtcttattatgggaaatctccaacataaacaaaagtagagaaaatgctgtcatgaacccaatagatctgtgcagagtttcccgtgatcccctcacccgagcagcgtgaagcttcctgcactagccaggaggcagccctcagcccttaggagggaggaggccctgacaacccaactccctgctgtgtttctcaccctggggcccttaggaaaggaccttagtccccgcaaatacatctccagggcttcccaggcctcccatctttccctcggcacaggctcggggcgccctcttgtgttacaaatgaattactgtttctgcggggcccagacctttccaaaggtgccctagtatccaaagccgctgtggtccgatggccttctcttcactcctgggggtgccggccacaaaggctgctccctagagaggccttctccagccccctgccagcccctggtcagtcgtctgtcccctaggagggaactggagggagtccccacggttggacaatccaactcctttctctggatccagcagctttgactccgctgtttgggttttctatggggaagatttaccttctcaattgcttctgagttctcatgacaaaatggcaagttaattaaggaaatcccttgcctaagctgtttattttatttttttagagacagggtctctgttgcccaggctggagggcagtgatgcaatcatagctcactgctgcagcctcggtgttctgggctcaagtgatcctcccgtcccagctactcgggtgcacgcagcctcggtgttctgggctcaagtgatcctcccatcccagctacccgagtagctgggactacaggtgcacgccaccacactggctaatttttaaattttttttgagacagggtctctctatgttctccaggctggtctcaaactcctaggctcgagcaatcctcccatctcagcttcccaaagtgcagagattataggcgagagccaccacgcccggcgatgtccttcaggattcagtttaaacatcatctcttctaggcaacttccccttctgcctccccaggtgtagggaccagccccacagggtctgtgggtctctccccgtgtgtggagacgagagagtatagaaataaagacacaagacaaagagataaaaggcagctgggcccggggaaccactaccaccaagttgtggagactggtagtggccccaaatgccaggctgcactgatatttattggatacaagacaaaggggcaggataaggagagtgaaccatctccaatcataggtaaggccacgtgggtcacatgtccactggacagggggcccttccctgcctggcagccgaggcagagagagagaggagacaaagagagaaacaacctacaccattattagagacttttagtactttcactaatttgctactgctatctagaaggcagagccaggtgtacaggatggaacatgaaggcagactaggagcgtgaccactgaagcacagcatcacagggagatggttaggcctccagataactgcgggcaagcctgacaatgtcaggccctccacaagaggtggaggagcagagtcttctctaaactcccccggggaaagggatactccctttcccgggatactccctttcccggtctgctaagtagcctgtgtttttccttgacactgaggctaccgctagaccacggtccgcctggcaacgggcgtcttcccagacgctggcgttacctctagaccaaggagtcctctggtggccctgtctgggcataacagaaggctcgcactcttgtcttctggtcactcctcactgtgtcccctcatctcctatctctgtatggcctggtttttcctaggttatggttatagagcaaggattattataatattggaataaagagtaattgctacaaactaatgattaatgatattcatatataatcatatctaagatctatatctggtgtaactattcttgttttatattttattatactagaacagcttgtgtcctcggtctcttgcctcggtacctgggtggcttgccgcccacacccaggcctggccgaggaactcttctcagtatccccatggtctcttgcacttacttacccccaccccacttttcactctgctgggaacatctctctggatacttctctgcctcccctactaaactgttaagttgtgcagggacaggtgaggacctgacattccgtcagagcaggtccttggtgagcatgtgctggtaacagaatggctctcatcttagcgttgtttcttttgttttgttttgttttgttttgtttgagacggaatcttgctctgttactcaggctggagtgcagtggcaccatctcatctcactgcaacctccacctcccaggttcatgcaattctgcctcagcctccctagtagctgggattacaggtgcgtaccaccacgcccagctgatttttgtacttttagtagagacggggtttcaccatattggccaggctggtcttgaactcctgacatcaagtgatctgcctgcctcggcctcccaaagtgcttggattacaggcatgagccaccatgcccagcctcatcttagtgttttgagatgctctatgcaaagtcctgcaagccggcactgtgccgtcccgctagcgggactggggatttgggctgctgtcccagctgggcctgaccttagtctgccatctcttcctccgcagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtacgacggctggctcacagggagcgccggtcggcccaggggaaggggctgatctgtccggaggccgccatggcgcacaggggtgaggctggggccggaggtggggcgctgggagctcggtgattggtccgttccttggtcccttagggttttttttttcttttcttttcttttcttttgagatggagtttcaatcttgttgcccaggctagagtgcattggcgcaatctcggctcactgcaacctccgcctcctgggtttaagcagttctcctgcgtcagcctcccaagtagctgggattacaggcatgcaccaccaagcccggctaatttttgtatttttagtagagacggggtttcactatgttggtcaggcttgtctcaaacatcctgacctcaggtgatctgcccacctcggccccgcaaagtgctgggattacaggcgtgagccaccacgcctggcagttccttaggtgttattggaggttttaactgcagagatgtaaggccacgtcccttcccgtcactgtcacatagttagaaacaggtggtatctgccatgacccagaaagaaaatcacctctcgattacatcatttaataagggagagtgtaggcattcatggttcaaaaggagtgaaacttttgtggtttagtttatatatatctatatttatagttatattcatatttatttatttttagagacaagggcttgctctgtcacccaggctaaagtgcagtggtgcaatcatagcttactgcaggctggaactcctgggctcaggcagtcctcccacctcagcctcctgagtagctaggatgccaatgcaccaccatgcctgctgattttttatagagacaggggtctcgctctgttgcccaagctggtctcaaactcctggcctcaagcagtcctaccacctcaacctcccaaagccttgtgattatagacatgagccaccacacctggcctgaacttttatttcttagtgattttgcagtgctttctcggggtcttctgccatgttatcttccaaattagtttgattagttctgtaattaaataaatgaagtcatttaagacctttgcatttgggaaagttcatgagttaatgaagacagattgagcatcttctagatctcagattctgagctaagtatttcaccgagttatatcacttaatcctcacagctcacaaatgtatatgagataccttattcttgtcattccttttttgttgttgttgttgtttgagacggagccttgctctgtcgcccaggttggagtgcagtggcacgatctcggctcactgcagcctccttctcccaggttcaagcgactctcctgcctcagcctcctgagtggctgagactacaggtgtgcaccaccacgcctggctaatttttgtatttttagtagagacgggtttcatcatattggccaggctggtctcgaactcctgacctcaagtgatccgcctgcctcggcctcccaaagtgctgggattacaggcatgagccaccgcacccagccagttctcttcattctacagatgaaaaatatagaactcagaggggctaaggaggtcaggccccagtgctgtcttggtagaacaaagtgcactgggatgaagtgtttggagtagatggaggaaacccactgaaggatcctgagttgctgatcatagctataaccatactctctgctgctagaaaccaagaattccagggccctgatggagatccctaagctagtgccttgccattgaccatctcaggtgctgcttcccattgtccctagggcacgataacattggggtaggtgctcctggttcaaccaaggtcaccctacgtaggtctagccgatggcagtggggccctcccagctgtgcacatgacacagtcatgggcagcacaaagtcacagtcaggctggaggggaagttgtgtctctcaccgggccctccctcccccataaggtccactggagttcctaaaggggcccagtaaaccacccaggctctgaacaaattgggaaactaaaatattaggtcagagtccaaatcacacctttattgcccatagaggcaaagtcacaagatgctgctcattgtgagaactgagcgcacctgctacgtggaccctagactcaggcaaacttccccacaatggcagccctggccccgcacaggcctccccgtgttccagctacctcccgcaaggacaaaatccaggattagccaggcgtggtaacacgcacctacagccccagctactcaggaggctgaggtgggaggatcacttgaggccagaaggcggaggttgcagtgagccgagatcacaccactgcactccagtctgggtgatagagccagaccctgtctcaaaaaaagaaagtccaggagctgcacagccagtttcttcattccaaatttagcaatcagatcaaaacagaggcagagggaggccagcagttagaacagtggaggtccctctacttggaaggaaacttcaacagtaatgaagcagaatgaaggaaatgaacggaaacgtggacaggggtttcctgaagcttctctttgccaggtgccatgctatcccatttccactttctttctttcttttttttttttttttttttttctgagacagagccttgctctgtcacccaggctggagtacagcagcacgatctcggctcactgcaacctctgcctcctaggttcaagcttctcctgcctcagcctcctgagtagctgaaattataggcacccaccaccatgcccggctaattttttgtatttctagtagagactgggtttcaccatgttggccagactggtctcaaactcttgacctcaagtgatccacccacctcggcctcccaaagttctgggattacaggcgtgagccaccacgcctagatgccatctctactttctagccacagagatgcgtgcactttgaagtctcctgcaattcacatccattttagggcatgtgtgataacgctttctataatatagacacatgcaaagccctaggttaccatctgggcatagatgctaccaattatacaaaacagttccaaaagtatgttccctggccctgctggagccacgtttgtttcccaagtcccccaacaggcctcagctgcatggcagtcactgccccctggccagggtacacaccctcgggtttctcagtttgctgcttgtcttgctggtcttctgacagtcatacccgtcacactgtagtctgcggtcattgtggggatgcctcttttgtgcattttagcactagcaaattcagtggtacacctgtggcaaagatagagaaggggagagaagaagaataccagtaggacctcaaaacttagtaagtaaaatttagtaatcacaggtctgggctgggtgtggtagcttatgcccgtaatcctagcactttgggaggccaaggcgggtggatcacttgaggccaggagttcgagaccagcctggccaacatgatgaaaccccgtctctactaaaaatacaaaaattagccaggtgtggtggggtgcgcctgtaatcccagctgctcaggaggctgaggcaagagaatcgcctgaacctgtgaggtggaggttgcagtgagccatgatcataccactgcactccagtctgggtgacacagcgagactctgtctcaaaaaaataaatgaatcccaggtctgaatccagagtagacactcaacaaatgcttcctttcaaaaataactccacaacaaagcaggctgggctgagtcaaatatgggatccaagagatgagtttgagctgcagagatctggaaaaatatcatggaagaggtatgaaatgagcaggctcttgaaaggaggattggagtagagaagaattttataagcaacgaaacaggtggaaggagaaacgaggggccgagcacagtggctcatgcctggaactccaccacattgggaggctgaagcaggaggatggtttgaggccaggagtttgagaccagcctcagtgagaccctgtctctacagaaaataataataataataataataataataataataataataataataaaataaatgaaggagaagtgagcattcaaaattagcatgaagtcgcttgtctaagatcacccagcaggggcgggcttggtggttcacgcctataatcccagcactttggaaggccaaggcgggcagatcatctgaggtcaggagttcgagaccagcctggccaacatggtgaaaccctgcctctactaaaaatacaaaattagcccggtgtggtggcacatgcctgtaatcccagctactctagaggctgaggcaggagaatctcttgaactccggaggcggaggttgcagtgagccgagatcacgccattgcactccagcctgggcaacagagcaaaactccgtctcaaaaaaataaaaataaaaataaaaaaagaccactcacccagcaggccaagggcagagggcagagcagagatgcagactgagtttcttctccaacactttggttctttcactaaatgctttgtacagaccaacctgccgttatacccgacagagcttcccgacactggatgtgttaaatccctaaccaagaacgtagttttttacgttcttttctcaggggttaaacaggaaaagtagattttcttttctcctgtcccactggaaccctcagggagtaacacttggtgtcaatttttgccccctcaaaaaaaaaaccgagctttatttcctcttatcctttcactttaagggaattagaaatatctctggctaaaggcaattaaaaatatctcaggctgggccgggcacggcctgtaatcccagcatttggggaggccaaggtgggaggattgcttgagcccaggagtttgagaccagactgggcaacatagtgagaccacgtctacaaaaaatagaaaaacaggcgggcgtggtggtgcatgcctgtgatcccagctactcaggaggctgaggtgggagaatcacttgaggaggttgaggctgcagtgagctgtgatcatgccattgcactccagcctggggaacagagcaagaccctgtcccccagcaaaaaaaaacatatctcaggctgaccatttacccaggattgatgacgagattgccagaacaacatgccacaggacactgctctcccctggaaaaacaggtccacccagttaggaactcagattctgaaccctcgcagccacggcattctgcgagccttgtgtgacttccctaaaaaccacaactgctcctggaagctcatctttctaggccagaagacagtattccttagaaatatggagacaaatctaggctaaaaaggatgatgtctcacatctgtggagcacaaagcatgtgccaggcactgagccaaaaaggtttttgtttgtttgtttgttttctgattttggttttggttttggttttttgagaaagggtctcgctctgtcgccgaggctggagtgcagtggcaaaatctcagctcaccgcagccttgaactcccaggctcagccaatccttccatctgagcctcaggagtagctggggcttcaggtgcatgccaccacacctggctaattttttgtatttttctgtagagatggggttttgctattttgcccaggctggtctctaactcctgagctcaagtgatctcccacccaggcctcccaaagccctgggattataggcatgagtccctgcacccggcctgagcagacagttttatagatatatcatcttattagtccctccatcagcacccaagtgcagtgctgctggccccattttacaggcaaagtctgcacacaggggccaagctcatgagcatggaaacacaagccccatgcctaacggtgtccgctccccaccccagccttagggcttatcacagcacacaaacagcggctggatagggggaagggtgacccctttttgaatggctactttgggtcctacatcatacatttaataccttatttaatcttaataacttctctgcaaggaagataccattctccacatttttcagacaagaaataagaaaactgaagttgtagccaggcgtggtggctcacccctgtaatcccagcactttgggaggccaaggcaggtggatcacctgaggtcaggagttcaagaccagcctggccaacatggtgaaaccccgtctctattaaaatacaaaaaattagccagttgtcgtggcacgtacctgtagtcccagctatttgggaggctgaggcaggagaatcatttgaacccaagaggcagaggttgcagtgagctgagatcgcaccactgcactccagcctgggcgtcagagtgagactcccttctcaaaaaaaaaaaaaaatgaaaaatgaaattttcttatttctcacagaatgctatggctatgaggttaaataacttctccaagttgcacagctagtaagcaccttagccagatatccaacccaagtgtgcctgcttccaaaaagcctgtactctggttttgggtcgggctgggaccaaaccttcactacccatatagcctcccgcctccccaaccagaataggtggggtggagagtttcaccccaactagcagtctcactgccaaggaacttgaaagccatagcgcccaggaacctgttcacagaagccaccatttcctgggctcccaaggtagccccagggaagggggaaagacttacacaccttggaacttctggggggcttctcagaacctttcctttctgaaccagagctcacaaatctttcaggacaaggttcagagctcactgcacgcaggaatcaaataactccatagcagattcacaaccccctgcaccccaccagagttcaataccctgggctaagctacagtaggatcttccccaggggagtccccacagtcagcacaggacccggcgcagagtaggagcccagaaaacctttgttttttttttcccttgagacaggatcttgctctgtcgcccaggctggagtgcagtggcagtcttggctcactgtaacctccacctcccaggttcaagagattctcctgcctcagcctcctgagttgctgggattacaggtacctgccaccacgcctggctaatttttgtatttttagtagagacaaggttccaccatgttggccgggctggtctcgaacgccgggcctcaagccatctgcccgcctcagcctcccaaagtgctgggattgcaggcgtgagctaccatgcccagcctcagaaagccttattggccgggcttggtggcttatacctgtagtatcaacactttgggaggccaaggcagcagaatcacttcagcccaggaggtcaagtttgcagtaaactatgatcttgcccctgcactccagcctaagcaacatcatgagatcctgtctctacaatattttaaaaatttaggcatggtggtatacacctgtggtcctagctactcaggaggctgaggcaggaggatcacctgagcctgggaggtggaggttgcagggagctatgatcacaccactgcatttcagcctgagtgacagagcaagacactgcctctaagtaaaataaggaaaggaaaaaaaaaaaaagaaagaaaaaatacagaatttggtggaattccaccctaccctggaccacaagcccccaacctgaccttctgtggctcagagattaaaattgtcactttggccactatccaataattggtcctctctcctgaagtcctgatggatgcagcggttatcaggcagtttcactgatgaactcacccagccttcgttactgcacaccaggcgccagtgcaaggcctgggtgtacaaagaataaataggaccttgcctttctcagtctagttggagcgggatgggatgggatggaggaaacgtgtcactcgataagaaccctggccagaagtggtggctcatgcctgtaatcccagcacttggggaggcccaggcaggaagattgcttgagcccaggagctcaagactagcctgggcaacatggcaagactccatctctttaaaaaatttaaaaattagcaagcatagtgacacagttgtggtcctagctactcaggaggctcagatgggaggatcactcaagcccagtagttggaggctgcagtgagctgtgatggcaccactgcactccagtctgggtgacagaacaaggccttgtttccaaaaggtttttgaaaaataaaataagtggccggacgcagtggctcacacctgtaatcccagcacttttggaggccaaggcagatagctcatgtgaggtccggagtttgagaccagcctggccaacatggtgaaaccccatctcttctaaaaatgcaaaaattagctggatgtggtagtgggtgactgtaatcccaggtactctggaggctgaggcaggagaatcgcttgaacccaggaggcagaggttgcagtctgcggagattgagccactgcactccacctgggcagcaacagggaaattctgtctcaaaaaataaaaattaaaataagtgcccgcggcaatttgttgcagtggagaataggggagtggtgtcccagccctgggatggctcctggccaggcccggaggggtgggtggtgactctggagaggggctgccccgtggcccgagggtcgctggaggggcacggaggggcctccaggctggacggagcaggagccccagagagaggggtctggctggggtagcaccagaggccctttccccagcagcacccccctcacgtccccgccgcttgttgtcttgtaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctgaggggccgcggccctggggcgggcagccaggctgggccgcaagggcctggacggggtcggacggggcaggcgctgcggacaccgtggcctgggcttggcccgcggcctgcaccgaccccgggccggacctgagcccgcagcccagaccccctccacggtccgcggcctgcaccgacccgaggcccagatccaaggccgcggcccagacccactctgcggcccgggccgaccctgcggcctccaccaaccccgcggcccagacccagcccgcggcctggacccctggaccgctttgcgcacttaccgccctgcgggccacagggcaaaatcgccataggccaaggtgcatatagaaaacaaaggagcattaagcccaatctatgtcgtgttttcaaggaagaaaacggaaatgtgtggtcgagcttttttgtaccctgaagtgttttttttattgccctaagtgatttccacaggttctggaataactcttacagctttgccttgtgtcctcctgttccgtgtgggctttaaaagaaaaaaaatcaaacccacatattaaaagggggctttttatctgccatctaatggcttcagagcgataatacactattatcttcttaaaccaggaaaaaataaaagggggggtgggatttttcagaaaaattaaaaaagaaagtttttgtagctgttcagttgccactaagagattgcacagtcaaaacgactctaaacacactagtttggattcctaaatattttcaagaaaagaatcttctcgtttgaaactttgaattaaaataaaacacatttactccacatattttttaacaaaaagaaaacgtcacatcaggaaactctgattttgtggtagctgacatagtgttttcttgtacgtgaatagaatcctgacatgtagtgcacattgatgtatagctttaactgaccctgggttttgcagaccagggtttgtttaatacactccattctaggccaaatcaggacaaaaaaaagaaaaaaaaagaaaaaaaaaaaagaaaagatccgaatctaggtattttataatctgctttttaacctctaaccgcagagcacgctgatcagacctcatatcttggaggtttaggagacaagttagaactgtagcatgtacctgttaattttgtttaatttatggtgtctcaatctgtctgtgcgtctgcacgtgtgcaagcattgaaagaaaggagagagtagtccgggcgagcacagcaggcagttccagggccagacgggcccatccccaagtagatagcagtctacggatctctctctggcacagaaggcacctcacctcacaccactctcctggatacctgatgaactgagccctcccaggggaagacactccccaggcctgggcagggcttacacgcgcactctctctcttctttccctttttcttcccaccgcaagcactgatgaccctgttgaactcgtgggaaacttcctttctctgcaggagagagaacgtggcattctgggctccccactcccatccctgtagaaatggcccaaactcacaccaaaacgtggatgctcttcaacttccaaacctaccatttgcccttctttcatttcgcctcttagttctttttatgcacagttttagggcagtctaagtacaaactgaaagtctaacttgtctctgattcctcccttgtctatgtgtatatgcgtgagaatagaggcgggtgagagtgtgcgtgcgtgtgcgtgtgtgcaattttatacgtctgtgtattttcttaagtacctgtgcacacgtagagtgcattactgccacctttttcaataagctgttttatcagttacggcttctacaagtttgctaatttagacttctttattgccatatctttaaactaacaatagatgatttcggtatatatatatatttttttttgcttatttataggtgctgtattttattatctgattgttaggaagggatgaaaggggcaaatattctttagagggatagactgccggcagtattgggtataatttacaagatgtagttgtcatactgtatattactgattgaaaactttttgaccgtattgtgtatcattgaaacctttgtcttaggtcaacatctttggatgacattttaatggtgcattcattatttcttaagtttaattaatattacttttttttttatttggggggtgggagggagttataattttaaaggtatgctctggctgttccacctccgtgtgcttgttaattaacttgtaggactttgactgtaagatgtgaaaccacgtttcttgcatgatgttttagagattatttcatttacagtcttttaacctgcagctgcagcacttagttcacgttttcacaaatttcaagagtcactacactaaagacaatgccttttcatgaataagaagttttcagaaggctctagggggctgggaggcaggctgttcgtttgtcttttgttgggggtatcatttctgaacttgaaatccagttcagggagaagagaattcaaaattagaggagcttaaggggacacgggtcaacatctagctcgattcaggtgcattgagaagagtgagttcacatcggtgacccttaggacagtgagtggcagagccctgacgactgtggtgtcctctccacaaaaccctcaagggacttttgtcatcatgtgtgatgaatctttaaatatcgtctaattttcataagaatgaaaagaagttaacaggaaatagtaggctagggtttagttttaaaggcatgactgttatttacaaaggtgttaaatctgaggaaattgacaaatacagatttgtccattctagtggccaaacagtaacagtctaaaatgcagtcattttgaccctcccaagcaatttagtcatatgtgttgttttctcttttctgtttttacttcttagatttttaactaggttactgttggttcccattctgtcttttttgccagacttacatctggtgccagatacaatcagttggttaaattttgcttgcagttctgtgtattttttttcctctattatttatttttttaaaaaaaatagagatcctaaccttagatctttgatgtgaagctagcactgtctgtaatacttctaagagctgccactaaaataatacagcaatccgtggccaggggagcaccccctcctggttgggcccctcagttggagtctaagggttaatctctcatcttgctaagcagtattcaagtgccttgaacagtgtcccctcggcatggctccccttcagcaggctggcattccaagcagtggcccccgcaggcagccgacccccttcctcttcacgctctatgagtttaaaaagctgatttgtacctctcccctgggggaaacggttccatataaaacactaacacttaattacaagctccattatgccattttaaatggcttctttttgttaattggaggcattgttcataacttaaggcttttgccattaacttagctggctaagcagaggctcggggtaaaatcagtgtttgcatttagcctcttgacccggagttccggcccaagctcccttgtgatagccgagatggcaggtgtgtgagttctgtcctagacctgtgcccaactcacttccaccccagaggagtcttctgtcctcctccccaacccccgagctccctggtaacctcctcttgaacttctgtatcagtgaagacatctgtggtttctgctcaccagacctctctttagaaagggttatcagagccatggagcttagctcaattggattcttctagacgatcttaggaggcatcttggcatgaggcagcttctaagcgtctcctgggacaggattggggtgacagcccagggatgcatgcatgggagaactctctgagaaatgccaggatcgtggctcacagggacccaccatcaaaacctgctactttgtgcaagtaattgaggcaaaagataccagtcgacagcctccctggggtagatcccttgtacctccaaagtacaaatacctccctgctcagtttccttcctgtcgccatctttgttttcttcccattgaaaaaccatcctgtctgatgtggacgttcaggtctgctggttggcggtccgggcccagagtgcagcagagctctgggttaaatattcctttctggccaccgcccaagcccaggtggccagctctcataccccatctccctccttggccagggccagcatcaggcgtgcagctcatgaccagtttacacaggctgcaaagagatcgctgtgggcctcggctgactactttaagattatgccacagccaggccctaaaaagagaggggaacaggagtccccaggtgagctctctgacgggcaggtgccttcccgactaaggttggactggatgactttgttcctcctgcatgcatgtcctttgatgcaagggtgatcaatgaactctgttgacattctatgcaatgtttttcattcctctgattttagcaaagcaaatcttactgaaaaatagcagagccaggggaacagacgcatgtccttctgggagtcacacaaaagcagagagattttgaactgaggggcgacagcctttgccttaaatgcagtatgacaggcgcttcttggcagaccagtaaaaacaaaagcccatagaccttactcatcccaaggccgacaagccagctgtacagggcgagatgtagcaacacggggcatgagcggtgggcgtgctgggctatttgctgtggtactttaggctggaggtttggctcctgtgctgccggtggggggccctgtccctccccagatgtcctccctcttcttcacactcctcattgtcccttctacctcactaacctgtcttctccatctgatgtcacccagaaccacaccccacagaactgtgaggcacgtgggctggagagagcagaaaagctgccagcgcagcagacacgaacatccctctgcctggtgggccggctttgtgtgtctctccttttgtgagcgcaacacggacaaacagctgtgctctgcaaggcacacggatgtttcccttccacctgttcccaaagctccagcagctgtttcttttgcaggcagggcgtggtctcggggctccgagggtcttgtctttggtccgccttcctttctgtccagtcctgctcagctgttaagatccatcatggccattatccttgtcccggactgccccaaagttcccagctggctttggggaacactgtagctcttgggtgtctcttgtctctggcatggttttagcgtcactgcgaacactcctttgcaaacatcaaacatctcaaagacggaaaaggatagatggcttcctccagcctacacgccccgtccacagtggcatcaccctcttatcccaaaagaatatgccagttcccatccagcaccgaagaaaatcagctcctggggctggtggttggaggtgggtctgtccactgtgggggccaaagtgttcccctgctggagacagtttgcaagtaagaacctaaggatggggacagcatcctgtgcttgggcattgaccagccaaagctcacatttagaaagccctcagtgcttctgtggtttcacctgggcatcgacgacattagggaagcctttgtgaccacaagggcagggcttgtgccctgagtggcgaggtggtgacctgaggccagtgtgatgtggttggatctcagcgtgtactgaatgccagtctggccggcacactcgaacgctaagagaatggtccaatttgatgatcttatttctatttcgatcaggttttgactttttgtagatgaaaactaccagggaaaaggggaagcaggtacccaataaagtttagaaagatccagtctgtgaaacccttagagatgggctgaaagttaagtccaccaacccttgggcttaatcaggacggaagaggagggggtgtggggggcagagcgtaaaacaagccccagccctactcccggccccccagcccagtcttcccaatcccagaggccccggcggcctgtgctcctcaccaccctggtcaggggaatagaaggaaatgcaatttccgcctgtctgcccgacttccaaaaactgcctcctcctgcccaggcctctcccaccaccaccttccctccaaagataaccgtgtccatgccatccgtggcatcatctcgagttttcatttttggatgaagtgacatttagctttaacaagacatttccaaagcgcctagtctcctccaaaatgctaactttaaaagttgggcattgtaggcgaaaaatcccaaaaaaaaaaaaagacaaaaaaaaaaggctggcgagagaaagacatttggctatgcataaatgtgcacttcccccatgcccccgttcttaaactcttaagatgcctttgagttgcttttcatgaatccttttagtttacccgataatgttaagaaagcattagtctacgttactgtaatttctgtagtgtttacgctttaatttctaccacaaaatatgctatatgctatgtatcaagctttctgtaatcagaaagaaaaggtgccttatatcccaatgtcacggctacatccctatggaaattaatcagaagcacagtgtgtacggaagcattgggacttctgctggtgaaacaagagaccattcagcaagacacattgaagtggcacggagctgcttttgttttataattcttttttccccccttttccttcttcttttttattattttattattttttttgtactttgctttaaacggaaagcacttaaatagatgactatgtgtaaaagctctgtgcaattgaaatcatttttcttcattttaaaaaaataacgtattgcacaccaaatgaactcaaagtaagctttagaccaggacgattcaggttatgaatgagtttgttcactgtagttccgtttgttcatgaaccgaagggaaaacaggcctccccgactccctccagtctcccagcctgcctcttggtgaccactgtgctgggcgtgcagggcccgcgggctctggccggagccgctggcctgacgaggcaggatagggagtatccgtgattcagaagctgagacccttccccagtgtctgaggccacagccatcccttccagcacttaatcttgtcttgttgaaatggactgactgctactgacctgccggcgtgcgtgagggtgattataaaaggatgtttccttgagaaaaaaaaaattatttctatcctcttctatttattattaggttaatcatttaagtacttatcaggagtgtattgttattttgtgttttgttgtcataaatgctttttgctgtcactctagtggttactatcctctgccttcctctcctcccctactcccccagagaaccaaggcgtctgggggattgactggggggcagagggggtttccccagcaaaatcaaacacctgtctccagagtagccactcaaaaactggtggtctctatgtgtctaactttttaaatgagagtgtttatgaacaaaaaaatttaccaacgtgtgagggagttgctgagttgaagaatgctcgcttgaggagcttcagaggaatcttagcaaagccaagttcagttccccaaagcctcctagagcctctggtaagacttctgggttcatgaagtttcggcgagccgtggtcagagagggcgcggtggcctggccaagactttacctccaagcgagagagtgatttcttgcaaggcccgcatgggttgatacgttttggttggttttttgttgttgtttttcttgcgtacaaagttggtcaaaaccatctttcaaagcaacagtgttttgtagtaccaggctgtggcttgagggctcacctaggagatcataggcagagggcccctttcccctataggtggttcaacgtggaggaaggttgggtgtggagattgcttgctgtggccccaagctcagccagcaggacacccagttgttgccaatcaggtgtgaaggtgaggcgccctgccttgatcccatgggcccagcagaaggaaacttaccccaggccaaggcaagggccctgctcaccccaaggtaggctgggaagagcatctctttccatatcatcacctccccttctccaagattgccgggggccctgattttgttctctctttgaaagaaaccctccaccgaaacaatggtccccatctccccagaagcctttttttttttcatttttctctaattagtctatgcatttctctctctcaaaccatcttctgcctcttcccttgagaaaacgggcatctcacgtacccccatctgagacctcttggaaaaaaaaaatcccgtgtattctggagatgtgagaattcacccaaaattcttaaaacattggagaatagcttgttataaaataaaagtgggggtaaaaagaaggtggttttccccacatccctttgcattgaataagagacctagttctttgcgtttgtgcaataactctttgctgcttgccttgagagcgggtagcaccacgctcctgtccagactactaacagcacaagacgcactcacagggtggcggaatcttccggaaaactctctataagctcagctccccccaccccacccccactctagcgttttgtcacgtcttacattttagcagtattttatattttctgtaacgcaccaagtcttagatctttctagagcttgtttgttcatcctcacaatcacagatttttttctccaatcctcacagagacccaattgaccaaaaaagaaaaaaggaaaaaaaaaaagtcgtcttttttttttttttttgtacaaatcgctttgagatgcctctggtgtgttgctgtgtgacatctctctggtaacattttatttcttgctatttgtttttctacattaagagtcaaagttgacctggctggcgtgggggtgggggaggcacccgtcggccccttggtgttgtccctctgtctttggttagccatacgatgtttgttctcagcactgtacaacggtccctatataatacggagaagcaatatcactgtatgagactcacaccatgtattattattcactagcaccctaggtgtgataattgaagtaaatatcttttatacaaacacaagaatgtgtgggttgtttttatttaaagtgctctggcctgaggacgagcagcaaacactgtcattcgaggtccaaagggcacctcaagaatcgccgttcccgaggtcgtcccctttgcacctgtccgcaggtcctcgggcgtgtggcttccgggcacacagaaaaccgtgtggttctaggatacatggggatctcgggcactgctctgtcaatctgcatctggttcacaggaagggcttcgccagggcctgcgttcctacttgctgttgtcaccagcactgtttgcctacccttgaaccaagcccttaccctccctggcgtccgcttccttttctgtaaaatggagacaccatctcctgtcatataggcttgctgtggggaaccaggaatggtggccagtgctggtgcggcactgggctggtggtggcagccccaatcgatggcacttgggcgaccaggactacggccagtctcctctgccgtgtggcctgcagctggtcagtggcgtggcctcagccttctgtgtgggggtctcactgtgcccctgactcctgatgtaacagaaagacaagtgaaaggcaccagttaatgcttgcgagtgggacagtggcttgcgggtctctggaatgacggggctactgagaagagtctctttccagatggcgctcgggctggaggtggggggagagctctgcagaggtggctgttaggcttctccgcgcagttgtgactcagaggctgttgctcgtcttgggttggaaaagagctgtctgccaggccgacgtgtgtctggtggaagtgggggatgacttggtcgcatattaatttggagatttcagattgtgaaatgtccacatgtgatacagaatcgtaagcccctctcccaattcaactggattcaatcctccctccagtgggagaacccagagtatgggatggagacaccccccagtgccaggtgccctcggcagccccgtgtctgatgcagtcacttagggccgggggtgtctctagagttgcccaaaatgctggtcccctcagataggagaggcctgcataaaaccctaagagctggcccagcgcagtggctcacgcctgtaatcccagcactttgggaggccgaggccggtggatcacttgaggtcaggagttcaagaccagcctggccaacatggtgaaaccccgtctctactaaaaatacaaaaattaaccaggcatggtggcgggtgcctgtaatcccagctacttgggaggctgaggcaggagaattgcttgaacctgggaggcagaggttacggtgagccgagattgtgccactgcactccggcctgggcgatagagcgaaactcagtctcaataaaacaaacaaacaaaaaaataaccctaagaactctgccagtttggtatttgacagactgaagtctaacgtggttaatttttctgtttgctagtttaggtatgcccctatgtatttcatgatctgctaactaaattaaaataagaaatgttaaaaaaaaaaaaaaaagaaagaaaagagaaaggaaggaaggaaaggaaggaagaaagaacagttgggcacagtggctcattcctgtaactcctataggcccagcactttgggaggaggtcaaggcaggaggatggcttgagcccaggagtttgagaccagcctgggcaacatagtgagaccccatctctacaaaaaataaaaaattagttgggcatggtggcatgtgcctgtagtcctagctactctggaggctgaggtgggaggatcacttctgcccaggagttcaacgctgcagtgagctatgatggcaccactgcactccagcctgggcaacacagcaagaccctaaatcttggggggaaaaaaaaaaaaaggaacacttagctcaaagtctttttcctcagaaagttgagacaggatctcagtctgtcaccacctcctcctcccaggcttaagcaaccctcccatctcagcctcccaagtagctgggaccacaggtgtgcaccaccacgcctggctaattttttgcagagaaggggtttcaccatgttgcccaggctggtctcgaactcctgagctcagaagatccacccacctggttctcccaaagtgctgggattacaggcgtgagccaccgcgcccggccccttatttgttatttgtttcgtttcgttttgtttttaagatggagtctggctctgtcacccaggctggagtgcaatggtacaatctcggctcgctgcaacctccaccgcctgggttcaggcgattctcctgcctccgcctcccaagtagctgggattataggtgcccgccaccacacctggctttttttttttttttttttttttttgtatttttagtagagatggggtttcaccatgttggccaggctgatctcgaactcctgacttcaagtgatctgcctgcctcagcctcccaaagtgctgggattacaggcgtgagccaccatacccagccgcgttccttatttgatgctctgaagaaacacaattgcaggtagacagggtggcgcgacgtgatgatgagatatattagagcacttgaattgtctgcaatggtcctgtgtgcttctgttacaaagcccctctgagtggctgcctgggggcatgctgctcctctccacggtcttaacatgccagctttgggggcacacagcttgctggtgtctacttcagctcatcactgattcctgtgaggtggcagaggcctgggcctgcatgtacggacccaaccagggaactgggagggctccacagagctaccgtgatgttgcccaggctcccggccagtgggccgttgcttagcaaccgactcatgcagtgtggagtgaccggcctccacagacaggggagacacagcctgggcccagccttaggcaggcattgctgaagttcctgtcttttccaagaagttcagactcttagaataccaacaggaagggccctggtcgagcatggtgggtcacgcctataatcccagcactttgggaggctgaggtggacagatcacctgaggtcaggagtttgagaccagcctggccaacatgatgaaaccccatctctactaaaaatacaaaaattagccaggcatgatggcacatgtctgtaatcccagctactcaggaggctgaggcaggagaatcacttgaacccaggaggcggaggttgcagtgagccaagattgcgccactgcactccagcctgggcaacagagtgagactctggctcaaaaaaataaaaaataaataataccaatacgaagagcccttttttttttttaagcagaatcaagtatggataagtaatagcagagcttcccatttggggcagtggtgtggcctccagggagcgggatttgaggacaaccctcccattgttcagggaggcgtcagtgtctctgtggtcaggagacactggctgtatcaggatcccagcagcgtctcttagtggctgatgaccgtgagcaagtcttaagtcgatgctcaggaaatctttgaaagaataaatgagtttaacttcctagtgcttctgtttctgtctctgtaaaggggatataaaaagccaaactcggtcgggcacgatggctcacacctgtaatcccaaggctttgggaagccaaggcaggaggatcacttgaggccgggagttcaagacccaccctgggacacatagcaagaccccatctctacgaaaatgtttaaaattcgccggatgtgctggcacatgcctgtagtcccagctacttgggaggctgaaggatcgcttcagcccaggagctcaaggctgcagtgagctataattgcaccactgcactccggcctgggtgacagagtgagaccctgtctccagttgaaaaaataagaggtaggtggctcatgcctgtaatcccagcactttgggagccgaggcgggtggatcacgagttcaagagattgagaccatcctggctaacatggtgaaaccctgtctctactaaaaagacaaaaaaattagccaggcgtggtggcaggcacctgtagccactcaggaggctgaggcaggagaatcgcttgaacccaggaggcagaggttgtagtgagccgtgatacctccactgcactccagcctgggcgacaaagcaagactccatcatggatggatggatggatggatggatggatggataactcacagggttactgagaggacccagtgagaagacctggaaaccactcacccagcacccagtggcagggcagagcctggaaggatccaagtgaggcctatgcagttactggcagtggaagcagcagaggactggctggccctgccagggtcttgctgcccgtggccaggccccatctcctggggtctttagtctcctctaacacacatggcctctgggtttggctgtgatggggtgggactgagccgtggtagatgcttacatcagacggattgcaaagagggccagctgtgccccagcctgggagaccctgcagctgtgggaatcccggtgcaactttccaactgaggaaacagatgcttgccgcggggtagtatccactcgcccgtgagctaatacataccgaaggctgaccgtgggccgctgccttacacgctggggttattacagggcaaaccaggagctcaccttcttgtgggagggacagacagtagacgtaataaataagtgaatgagatagttgcttcgaaggtgatcaatgttataaggaggatgggaagagcaagtgaaaagggttaaactttttttttttttttttttggagatgaagtcttactctgttgctcaggctggagtgcagtggcgtgatctcggctcactgcaacctccacctcccaggttcaggcgattctcctgcctcagcctcccaagtagctgggattacaggtgcatgccaccacgtccagctaatttttgtatttttagtagagacaggggtttcaccacattggccaggctggtctcaaactgctgatctcaagtgatccacccgccttggcatcccaaagtactgggattacaggtacgagccaccacacctagcctttttttttttttttttttgagatggagtctcactgttgcccaggctagagtgcagtgacacaatttcagctcactgcaacctcctcctcccaggttcaagcagttctcctgcctcagcctcccaagtagctgggactacaggtgcacactgccatgcccagctaatttttgttatttttagtagagacaggagtttcatcatgttgtccattctggtctcgaactcctgacctcaggtgatctgcccgcttcagcctcccatagtgctgggattacagatgtgagccactgcgcccagccgaaaggggttaaagttttaaatcgggtggtcagggtaggcctccctaagaagttcacttctctgtttaatttattatctttttctctttttttttgagacagggtctcactctgtcacccaggctggagtgcagtggtgcgatctcagctcactgcaacctccacctccggggttcaagcgattctcctgccccagccttccgagtagctggaattacaggcgtgcatcaccatgcccggctaatttttgtatttttagtagagacggggttcaccatattggccgggctggtctcgaactcctggcctcaagcgatctgcctgcctcggcctcccaaagtgctgggattacaggcatgagccactattcccagacagaagttaacttctttttttttttttttttttgagacggagtcttgctctgtcacccaggctagagtgcagtggcgtgatgtcagctcactgcaacctccgcctcccaggttcaagtgattctcctgcctcagcctcccaagtagctgggattacaggcgcccaccaccgcgcccggctaatttttgtatttttagtagagacggggtttcaccgtcttggccaggctggtctcgaactcctgacctcaggtgatccacccgcctcggcctcccaaagtgctgggattacaggcatgagccatcgcgcccagcccagaagttaacttctaaacagtactggcagagctgagggaacgagccctgcagatgtgagaaggaaggacgttctaggcagtgagaactgccagttcaaaggtctcgtggtgcaaatgtctctggaaaccagcatggccgcagcaccgtgaccaggaggaagagtgggaggcgatgaggtcagagagaccaaggagaggcggagcatgggggccttgtcggctattgctgaggctttgttttttactctgagtcaactgggaggcattggacggtttgaacagagggtcctggctctggtggggaaacaggaagtaggattcattggtaggagtgagtaaggaggggtcagcacaggggaagccctcagaagctcacccaggaggccacaactggggctgcgtttaacccccacagccatgccagatgagctgcttctcagccaccacgtgggatcgatttcttccacattgaacttggtcaaggcccgctgctttgtgctgtggatcttctggcagccagggaacttagacttggccctgcatatggcctcaatcacaccctcatggttctgctcttagtacggatagacacaatgacctggccaacataaaccctggctgtcacaccctggggctttccaagggcaccccgaatacttgcctggtgcctagaccacagacagcacgaggtcagagacacaaatgtccagtggaaagaattgtctccaacgttccttagggcaacccatgtaagaaacagactgtgtggccgggggtggtggctcacgcctataatcccagcactttgggaggccaaggtgggtggatcacctgaggtcaggagttcaagaccagcctggccaacatgaagaaaccctgtctctactaaaaatacaaaaattagccgggcatggtagcgggcgcctgtaatcccagctacttgggaggctgaggcaggagaattgcttgaaccccggaggcagaggttgcagtgagccgagattacaccactatactccagcctgggcaacaagagcaaaaatctgtctcaaaaaaaaaaaaagagaaagaaagaaacagactgtgtactttactgaggaggctgctgtttgcaaccactgcaccctacaaggtcactattttttttaagagacagggtctcactctgttgcccaggctagacggcagtggcataatcatcgctcactgcagccttgacctcctgggctcaagcaatcctcctgcctcagcctcccaagtagcagggacaggcgtgcaccaccacacacggctaatattttaattttttgtagcgacagtctggctatgttgcccaggctggtctcaaactcctggactcaagcaatcttcctgcctcagcctcccaaagtcctgggattacaggcatgagacagttgcacccgaccaactttttaaaaggctctctctggctgctgcttggtgcccagatcataggttgcagagggaggccaatgaggaggctgatgccatcatcacaatgagaggtggtcatgactcggactaggtggcagcagtggtaaaaagagactggattctggagatattttgaaagtagagccaaaaatgagacttaaggcaggggcagtggctcacgcctgtaatcccagcactttgggaggccgaggtgggtgggtcacttcaagccaggagtttaagaccagcctgaccaacatggtgaaaccctgtctctactaaaaatacaaaaattagccaggcgtggtggttcatgcttgtagtcccagctgctcgggaggctgaggcaggagaatctcttgaacccaagaggtggaggttgcagtgagttgagatcatgccactgcactctagcctgggtgacagagtgagactccgtttcaaaaaaaaaaaaaaaaagagagagagagagacttaagacagattcagcatcaggagtgatggagaggagtgaggctacctcccggggtttggtctgagccaccgaagggtcgcagagagctgggtcaggccgggaagggggtctctgcctatccctgcagatgtcacctcccgaggctggactacaggggtccacacttgggcttggggagtacagacttggggaggaagggatcaggctgaaattcagacctgtgaaggttgaaatgccagtagaagatcaagtagaagataaatccaaggagaggcgtggactggagtcccacactggggaggcatcggcttgtcaatggcatcccgcatggccagagcggatgagggggcagagtgaggcatctgcggatggtccctgtgcagcagcggcaagaagcttagcagggagggcaaggaccagtcaaggaaacagggcagagcagccagccggggaaggaggcccaggagggtcggtgacctggaaactagctgctaacacagcagctcagatgagagccgaaaaacaaggacgtggcaatgtgcggaggtcattagggaccttggcaaggacagtcagcgtgaggggtggcagagtctgatgggaagggcttgaggaattggaggagcggaattagacgcttgagaagagacagcttcttcaaggagttttgccagagtggggtcaagggaaggggcgtgtgtgcatgtgtacatgcctgctaggagaacatgcttgcatgcatgtagaaggcaagagccggtgctgcaggagagggtggcattgctggagaccccattgcataggggtgggggccagcacctgcaggcatggggagccggctgggggggctcagtggtcacctgaggctacctgcaggatctacaggtgcagaggcagggaggggtggatgaggcagcagcttggccccctcagtgtcctcctagcagagataccatgtgcaccgagcgtctccaccattcctacctggcctgcaagtgatttaataagacaggggcagccgggcatgtggctcatgcctgtaatcccagcactttgggaggctgaggtgggtggatcacctcaggtcaggagttcgagaccagcctggccaacgtgacgaaactctgtctccactaaaaatacaaaaattagccaggcatggtggtgcatgcctgtaatcccagctgcttgagaggctgaggcaggagaatcacttgaacctgggagagagaggttgcagagagccgagatcataccattgcactctagcctgggtgacgagtgaaactccgtctcaaaagaaataaaaaataaaaagacaggggcccctcgcgccttcaggaaaaccgtaggtacaacaccgctggcctcgctatgataagtctctgcatttaatccttctgcagtcagaaatcatgcctagactttttttgggcgtggtgcagagagggacagggtcttgctctgtcacccagcctggagtgcagtggtgcaatcgtagctctctgcagcctggaactcctggactcaagcgatcctcccgccttagcctcctgagtagctgggaccacaggtgcacaccaccatgcccggctaagttttgtatttttctgtagagatgacgttttgccatgttgcccgtgctggtctcaaacacctgagctccagcgatgctaccacctctgcctcccaaagtgctgtattccagccgtgagccactgcaccgggccctcctgaagtcttgaccttaaagatgctttgattccctcctcccctctgtgaggtgccccctctaggatgtctttgtgggttctcccagaggatgaggtcccagtctttcctgaggggaaggggaccgtcttgggcccttgcaccacagactccttttctgagcccctttccctgtcttatgctcacttatccacccgtcgcctgtcatccctctctcccctaaacaaaatctgtccctctctcctgggtttctgggttgcagatggtccattccacacactctatgcttctcaagatcccctctcgggcacacgttactgctcttccaccagttctgcccatcgggctgtgccttgcagccctgcatgcccccaccacctcgacgacaacaccttcgcctcgctcagcctctctgtagcttctgaccccctgaccctccatattcattgaccctcctgcctcatcttggtgccttcacatgcatcctcctgctgtctcccctgcctcctgctgcctcttctcagggtctttgcgggaccccctttgtggatcaccccctgaagctctggccacctcacagcagcactgtctcaggacctgtccaccacccctgattttctgtattagctgttcttgcattgctatagagaaatacctgaggctgtgtaatttatcaagaaaaggggtttctttggctcatggttctgcaggctgtaccagaagcgtggcgctggtgtcggtttggcttctggggaggcgttggaggctttactcatggtggaaggcgaagtgggagcaggtgtgagacatggcgaggccaggaggaagagagagagaatgggggtgggggaggtgccacgctccttaaacaaccagatccctatctcagagacagcaccgcgccacaagggacccgccctgtcccccaaacacctcccaccaggccccacttccaacactggggattaattacttttttttttttttgagacagggtcttactctgtcacccaagcaagagtgcagtggtgtgatcacagctcactgcaacctctgcctcctgggctcaggtgatcctcccatctcagcctccctagtagctgggactacagctacaccaccacacccagctaattttttgtgtgggtttttttgtttgtttgtttgtttgtttgtttgtttgtgtagagacagggtttttccatgttacccaggctggtctcgaattcctgggctccagtgatcctccctcctcagcctcccaaagtgctggaattataggcaagagccactgcacctggcttgattacatttcaacatgagatgtggacagggatgaatatccaaactatataattccacccctgccccctcacgcaaatctcatgtccttctcacattgcaaaatacaatcatgcctttccaacagtaccccaaagtctttttttttttagatggagtttcactcttgttgcccaggctggagtacaatggtgccatctcagctcactgtaacctccgcctcccaggttcaagccattctcctgcctcagcctcccaaatagctgggattacaggcgtccgccaccatgcccggctaattttttttttttttttttttgtatttttagtagagacgagttttcgccatgttggccaggctggtctcaaactcctgacctcaggtgatctgcccgcctcggcctctcaaagtgctgggattacaggcgtgagccaccacgcccacccccacagtcttaactcattacagcattttggtcacaaccatcgaacaagtctctaagaagttccaaactttccctcatcttactgtcttcttccatgccccccaaacgcttccaagctctgaccgttggggccctagatctcctcaaccagcatatccagcctcaggtccacaggtccaaaccccaccacacacatgcccttagctgttcacaagcaccttcgtgcttaccagaaccgagccagccagctgcccaccccttcccccacagggggccaggcccgggcctccccacctgggttctgtacagcgatggggtccacagctctctctccagctccttctgtgtcctcgccccagagccctgtactccagaggttgaagaacttgccgaagatcgtgaaattcataaaaggcagggccagaatgcaagcccggttctggacttgacatcaagtggccaccagagatgtcaccccagcttccccacctgcgtgttccagcctccagcagagaaggcagggtgaggcagccggtgggggataggggaccctcccgtggccggtgaggccctgtccttctctaagtacatctaactgaggcccctctctggtggaagcccgcacagccagtctcctggccttcgcttcctcccagcgtggagtgacagtttcaaagcacagctctggttgctgctgggatccagctgggctctgggacagtgtccagatcctgtcccctgcagcctccagttctctgtccacccccctctacccacagccttccctccagtctcaccgtctgccagcctctgctgccctgtcttacccagcctgttctctctgcctcaccagcagccatcccccaattctgctgcccgtgcaactggcctgtgctcctatcaccccaagccacctcttcagggatggcctcccccaaccactcagccctgcaccctcagatcccctcaggagctaacccagtgcccagagcatctgcagcagcgccaatggccaggcctccaggccagcttaacacatgggccttttccaggatagcgggccaccagcttggaactggggcagcctaggatagagggtttgcagccaggatgctcacacctgcacagaatgtcacctacatacacggcaggactgtgtgcccacccctgcagtagcagacacaggaacaagtgcacggggaccaggcccacgcaccccatcatctccctggtgcccacggatggtgctgggagctgcaagttgctgccaccccagggacctgaccaagaccacactggggtggtcacagactgggggcagataaaacaggcagtgcaaggaatcatctcagcagctttttatccacccctcttgccaggcgcacacctccagggaaaagggctcactctggccaggcaaaagtcacctctgcaaaggttctccatctcagccctgtctctctgtcccccaggccctcatccctgaggtggaatgtggcttccctgagccttgttggagcttaacgccctctttttatcccaggagtctgtccccatggtcccagcacggttcttggatgtgctcctgtttgtggccaaactgaagcatcccctcccttggtccaggaccttcacctctattaatgtgacccaaggccccattagctttctggtggtttcctctccctacatctcacaaccgctgtccacctcccatcctaagcatgagtggccggctctgccatcccatcccacaggccaggacccaaggactctgtactcaggccaggagggcatggtatttatcgtctctctggacctctcccctttggggtctccttaaagtccctgcaggtggcccagggccagccccaaccctgcccccgacagtcctccctccaaggccgggtcctgccttcaggtcctgcctcttccctcatcccctcctcacttccgcagataccaccttcctgccagggacccaggggctcagtgaatgtctgaaggaagaaatccatttaggggcccagtgcggtggctcacgcctgtaatcccagcacattgggaggttgaggcggacagatcacttgaggttgagaccaacctggacaacattgctaaaccccgtctctactaaaaatacaaaaattaactgggcacggtggcaggcgcctgtaatcccagctactcaggaggttgaggcaggaaaattgcttgaaccttggaggcggaggttgcagtgagccgagatggagccactgcactccagcctgggtgactgagtgagactctgtctcaataaaataaaataaaataaatccattcggggcctgaacgaggcgagactctggtgtgagcaagggcttagacagagctgggggtggatgccttgggtttggtcccaggtcgggaagcctccgttctttgactgtaaaatgtgaatcgtcttttctgactcatctataaggacttggtgtgcagtgggaacccaggagcatgtggaggtgaggctgggctgccccatcctggcccaggacactgagcccagccagggcaggtatgacagccggtcagcaggccgcgcagtcagggatgagtccacggaggaggccgcacataccatttccctggcactgcccacagcctgcagcctttgtgcatttctgaggccacagtgccccctggcggctgtgcagcctaccccaaaggacagcgtcctgggtctcaggcctcagtctccctctctgcggccccaacagctcaccctaaacaaggtttattgttaccatgttacatgtcaccatttgggaccagaaagggggatccagtggccctgagccgcacagtcaaccagaaacagggccaaacctcaccctcagggctgcctggctcctgggtcactgaagtcctgcctggcaatgcgtgcttgggtctgggtcccttccccgacatctctcaccctcctgcagggcaggaaagtcacagtttggatgctttgttataaagatgaccctggcacctggaggagggagagacagacagggctgtgggtcgggggactccttggggaccacgccaccccaaccactgcagctggagcctctgttgggggcgggaccaagcacctctgttgtcagcccagaggtggcacccctacgcgctccactgcacccccgcggctttctctgcctctcctacccccaggcttcccactggacattatcccagaacatcagctaggaagcaacctgagcctccttgcccctgcctgacaagcaaagtgaggcccagagagggaaaggggctggccagggccccccaaacagccgtgggcagagccacgttgcaccggtttctcctaatccctgacctgagctccttctcctacccaggggatttcatcaatccagagagtgcttggggccaggagtgcctctgacagtcagggagggcttcctggaggaggccctaggtctaatggggtcttctaggcagtggtgagttgggagggaatagccagcactctcacagcatccaggcagccctgcttccagaccgtgggttggagaggcagaaccaggggagggcaccaagggtcccaccaggctccctctgacggccatgtcttcctttggccacaggacgctgtgcagagctgcaagtccgtatcactgaggctgtggccacagccactgagcagagagagctgatcgcccgcctggagcaggacctgagcatcattcagtccatccagcggcccgatgccgaggtgagcccacccccctgccccatgcccatctcgctacctgcccaactgacttagcctctgcaaacactgacttcccagattagcctgtgtatcaggcagctggtgacaacccagaagggctgtcacctaaaaccattgggttctccctgcttactccatgaataccaccctgcctccgatttggggtgacaggccatggggcagaggccacagggcttcctagcggtagcacagaggcccgtctttccaggcactgccctgagagcagaggcagaggcaaggccaggaccatgcacccatctcccagctaaaggacctggagcccagagatcacagcaggctgggacataaacagcccagggagagcatctcctcgcccacctcccattctgtagagtccacagtgggactccgggagagaagtctgggctgtcccaggtcacgtggcaggctggttgcagggccagggaggcccaggtgtctgatgcatgtcaaagctgagtggctgcgaggagagctgcactgctgctgaactctggcctcaggagtgacttagggcccagccatctcttctttggtagctcatgtcacgtgtccaggtccgggccctcctgcagccagcctgcaccccggatggccccacccactccttgccacacccaccctgccatttgccttggccatgctgaaagggaatattccgtgcccattgtgcggaggcacctcctcatcgcttcctgtcacctgcagggtgccgctgagcaccgcctggagaagatcccagagcccatcaaagaggccactgccctattctacggtaaggagaggcctgacccatgggaggagggaggaggagggaagaggagacaggtgataccgcctaagaacacagatccccaaagagtagtcccttcctctaagaaggtcaggcccccacgcctgcaatgcagcagcaaccttcaaagggtcgggtaaggctaggtgtggtggcgcacacctatagtcccagctactttggaggccgaggtgggaggatcgcctgagcccaggaattggaggctgcagtgagctatgatggtgccactgcactccagcctgggcgacagaccgagaccctgtctctaaaaaacaaaaaggtgaatgagccctcaacctgcctttctggatcttagactgacaccccccaccttggggccctgacccttcagccctgccggtggcctgtgaaaggctggtgagtggtggtcagccaggcctcactgccaaagtgcagccggaggtccgtgcagtgaggggaaggcagcctccttgggtattgaggacagaaactgaggctgctggactgggatactgggggtgtgcccatgcctccccagttcccctcctgcccctttgcttccccaggggatataggcctagtctgacagctgcaagggtctcagattcaaggacagagtgactgggaggggagttctgggcctggccctctgacagcgcagacgggggtgctgggcccttccccagcgtgcgtattgtcaggtcagcccctgccatccattctcacgctccccggttcccctggctgtcccctccccttccccgacctgcccagcaccagggagtcagacaccatgtggcttctaccccatggcatttggcagaaatcccccagggctgggggacccaccccaaagggccgcctgctgggttccacctcctgccaccccccaagccaccctcctctacctgctaggacctgcagcaccagccagcggtgccctcccagagggccaggtggattcactgctttccatcatctccagccagagggagcgcttccgtgcccggaaccaggagcttgaggccgtgagtcacatccttctctccctgatgctccttgggcccaaggacacagttggggaacacacaggctttcaggagagagatgtggcacagaccgtaaacctcagggggaagagatttgttctgtgcagtcagggagggcttcctggaggaggtcatgccacactgggctttgaaagaagactcagatgctcacagtagaggagacacgggggccagtgagccagaagggagcatagatcattccaggtgaaacaagtcgccaggcaagtgccctcttgccaggctgggaggcatggccttcaatctgcagggaggggcaccaaggaaggatttaagccaggcagtggcactgcaagaatgcagggtgagccaggtgcggtggctcacacctgtaatcccaacactttgggaggctgaggcaagtggatcacttgaggttgggagtttgagaccagcctggccaacatggtgaaaccccgtctctactaaaaatacaaaaattagccgggcatggtggcgggcacctgtagtcccagctacttgggaggctgaggcaggaggatcgcttgaacctgggaggtagaggttgcagtgagctgatgagatcgtgccactgcactccagcctgtgtgacagagcaagactccatctcaaaaaaaaaaaaaaatccttcctttttaaggctgtataatattttattgtgcatatagaccacattttgtttatccattcacctattcatttacattgcctccaccttttggctgtggcgaataattctgctgtgaacatgggtgtataaatatctctccaagtctctgccttcaattcttttgggtatctacccagaagtggaattactagatcctatggtaattctatgtttaacgtttttagaggaagcgtcatactgccatatacttttttgtactgctcaagttttggttgtgtttgttttttgagacggagtcccgctctcttgcccaggctggagtgcagtggcacaatcctggctcactgcaacctccacctcctgggttcaagcgattcttctgcctcagcctcccggatagctgagattacaggcgtctgccatcacacccagctaatttttgtatttttagtagagacaggatttctccatattggccaggctggtctcgaactcctgacctcaggtgatctgcccacctcagcctcctaaagtgctgggattacaggcgtgagccaccgcgctggccactgcttgaattttgaatagtgtgaaagaaacacttattcaagcatttgaataaattgaaaactgagattccatttcacgttgcctttagattggcaaatattaaaaccacagcgtgtgattccatgaatacgaacattcggtataggcaaatccatagagacaaaaaagagactgccggttaccaggcagtaggggaggagggaatggggagtgactgctggcaggtttggggtttcttattggggtgattttaaatgttctggaattaggtagtggggatggttgcataacattgtgaatacaaatgaccgaactgtacactttgaaatgctgatgtttatgttatgggtattatatctcaataatagtttttaaaaggctaataccaatgacaaaaaaaagtatgaagaaatctgaccaggcatcgtggctcatgcctgtaatcccagcacattgggaggccgaagtgggaagattgcttgagcccaggagtttgagaccagcctgggcaacgcagtgagaccccgactctgcaaaaataaaaaagtagctgggcatggtggtgtgagcctatagtcccagctacctgggaggcagagatgggaggatcgcttgagtcgggaggctgaggctgcagtgagctctggtcatgccactttattctagcctgggtgatagagcaagaccctgtctctaaaatatatagacaggggccaggcgcagcagctcacgcctataatcccaacactttgggaggcagagatgggtggatcacctgagatcaggagttcgagaccagcctgaacaaaatggtaaaaccctgtctttactaaatacaaaaaaactagccaggcatggtggcacatgcctgtaatcccagctacttgggaggctgaggcaggagaatcgcttgaacccgggaggcagaggttgcagtgagccgagattgattgcgtcgttgcactccagcctgggcaacaagagcgaaactccatatcaaaaaaataataaaaataaaaataaaaaataaaataaaatatatagacagggtcttgctctgtcatatattaaggttgatgcaaatgtaatcatggtgtttgccattacttttaagggcaaaaaccacgattacatttgcaccaacgtgatacatatgaagaaacctgacccaagatccctgacttctgcctgtggtggggccacagtgggggaaggggcagctttacagagtcaggcaggtcaaggagaaggctgtgggcacagaaggggctccaggtagacggagcagcacctgtgccagcacggaggcctctcccccacccctttccttgcccctccccccccaggagaaccgcctggcccagcacaccctccaggccctgcagagtgagctggacagcctgcgcgccgacaacatcaagctctttgagaagatcaagttcctgcagagctaccctggccgggtgagggccctcccctggcctcagctccaggtggaccaggcagggagagaggccgatcagggctctggagatgggagggtcggggaccaagacctgctgggcagcactgggccccagagacccctgaggccttccgacatctccccacccacccacctgcctgctagctgccctccctaagccggcagaagctcacagagtggagcccctgtccagattcattcataaaaactggccagaaggaccaggcacggtggctcatgcctgtcatcccaccactgtgggaggccgaggcaggagaattgcctgagctcagaagttcgagaccagcctggccaatatggtgaaaccccgtctctactaaaaatacaaaaaaagtatccgggcatggtggtgcacacctgtagtcccagctactcaggaggctgaggcaggagaatcgctggaacccaggaggcggaggtttcagtgagccaagatcacaccactgcactccagcctgggcaacaagagcgaaactccgtctcaaaaataaaataaaataaaaataaataaaataaaattaaaataaaataaaataaaataaaataaaataaaataaaaaaataaaatataaaataaaataaaatataaaataaaataaataaaataaaataataaaatagtaaagtaaaataaaataataataaataaaataaaataaaatagaaaagaaaatactagccagaagggccaggcacagtggctcatgcctgtaatcccagcaccgtgagaggccgaggcgggtggagtttgagaccagcctggccgacatagtgaaaccctatctctactgaaaatacaaaaattagccaggcatcgtggcacgtgcctgtagtcccagctactcaggaggctgaggtgggaggatcacttgagcccaggaggtacaggctgcagtgagctgagatccagccactacactccagcccaggtgacagagcaagaccctgcctccaaaaaataaaaataaataggctgggcatggtggctcaggcctgtaatcccagcggtttgggaggctgaggcgggcggatcatttgaggtcaggagttccagaccagcctggccaacatagtgaaaccccgtctctactaaaaatataaaaattggctgggcgtggtatcatgcacctgtaatcccagctactcaggcggctaaggcaggagaatcgcttgaacctgagaggtggaggttgcagtgagccgaggtcacaccattgcgctccagcctgggcgacagagcgaaactctgtctcaaataaataaataagcaataataaaaaatgtaaacagaatttggtccacactccaaaaagcaaccaagagagtggatcagaaactcacttgccgagtttttctgggctagggaggcctgtgcgtggcttctctcagcccccaggcctcccaggggccaccccgtgccaggaaaccctttctatgagtgagagaagagcgtggggcatagtggggcagggattcacctctccctcttcctttggggcccagcagcccccagccctgtccccacccatcagagccgctccttggccaccagagggcactcagactctgcaaaccagcctggctctgggtggccagctggggggcgtctcctctcccagctgcctgcctgctcgcatgaccaccccacactcccagcaaacccaccttcctgcagctgcgcccggccctgcctgggcctcagttccccatctgtgcccggaggcactgtggccctgaccccatgggtaactccatgcccctgtggcaggaggcaccagccacattcacattgtcaccccagcaccctctcctcccgcctctgagatctagggctccctcccccacttcccttttttgcagatgaggaaactgaggctcccctgggctcctgcccttcccgctgggccccaaggcactgactggttctcttcccctcctgtctgtgcagggcagcggcagtgatgacacggagctgcggtactcgtcccagtacgaggagcgcctggaccccttctcctccttcagcaagcgggttcgtgagcccagcctgggcaggggaggggaggggcatcagcccagggaagcccaggggtccccccatcacttggcccccatccctgagcactcggccttccctggctcccctccacctgccctcgtctgggtgctctcggccagccttgccacgccagccctgcacaccctggcccctcaggccaggagcccccccaagacagcctccccaccgcttcagtgcaatgtaggcccagggcccattcaggaacacctgccgaggactacccgagggtgtgtggcagtgaccgggttaacctggagtgcatttgcgggacaggcagacaaggaaaaaccagttacagctcccagaatcgggcgatccattgtggggaccccaccccacaactcccctcccccacccagactgcagaagttctgcccgtggagtactttcccatgggcagaatggacggctgcagaggcggggaggggctctcacagatgtcaggggagtccagaatgtcacactgagtagactgtgcacccagggaagcccctggcagcaccctggcagccccctgggggtctgcaagaacagcgggcagggtgtcctgtggctggccaggccctgctctctgccacaagccagggcctgtgaggtcctttggggtcctttcctgactgtccctccctgtgcaggagcggcagaggaagtacctgagcttgagtccctgggacaaggccaccctcagcatggtgagtccctgcccctacccaccccctccctggacaggcctgagcctctgtctccaggcacctcttcacctgccctgcagcccaggctggaggagccgccagccctgccaagagtggctgtgtgatctgggacagggtctctccccttcccgggcagatcctctgagagcatggttcacagcatggttctgaactgggctgtagagggggcattcctcagaattcctgcagcctagagtcagacatggtggctcacacctgtcatcccagcactttgggaggtgggaggattgcttgagcccaggagttcgagaccagcctgggcaacacagtaagatcctgtctctacaaaaaataaaattagccaggcgcagtggtgtgcacctgtagtcccagctactcaggaggctgacggaggaggatcacttgagcctaggaagtcaatgctacagtgagctgtgaccactacattccagcctgggcaaccttgtctaaaaaaacgtttttaaagaattccggtggccgggcacagcagctcacgcctgtaatctcagcactttgggaggccaagttgggcggatcacctgaggtctggagttcgagaccagcctggccaacatagtgaaaccctatctctagtaaaaatacaaaaattagctgggcgtggtgacgcacacctgtaatcccagctactcaggaggctgaggcaggagaatcacttgaacccaggaggtggaggttgcagtgagccaagatcacaccactgcactccagcctgggcgacagagggagactctgtctcaaaaaaaaaagaattccagcagcccatgtccctggcccataatgatggaataggggccccagcttcctgtcccttccctccccttgccaccctagggccctttctgtgaagcccaggcagccctgcaggggtgggtgaggccggccccatccccactcaccccctccttgctcccaggggcgtctggttctctccaacaagatggcgcgcaccatcggcttcttctacacactgttcctgcactgcctggtcttcctggtgagtgtgcacacgggcgggccagaggcacattcaccatccccagccctgacctccagggcagcaggggcctgttacggtggcctggcccctgggcctaccccaagctgcatctctagcttgcgaccatgcctctccccttcgagagccttggcccaccccagggacgagaaggacccaccccattgggacctctggccagggcaccagccgggccgctccgtgaaagaggcctggctgatcacatctgggactggtcctggacgggcttcataggaagaagggatggagtgggaagggagcaggtctaatgaactccaccaagggacagtcacgaagactgcacagagaaggggcgtcttgaactaacctccccagctgtggaggtggcgttctagttagcggataagggcctccatgtctgccaagttgggggagaagaggggtggaaggctgtgtctctggaaggatccagccttggggtctcctgtccccagcacagtcaagatggcccctacagagctaacctgggctcaagttctgaccccagggtccagcggctcctggcccttccaagggttggcccacagtattagaggaggtgcctccgtgtctgggcccatctgatcatctgcagaagcagtgggtgcaggaacatgtctaagacccacccgccccggagtctggggctcgagaacctttatgttccaggccaggcccaggggccatgggtgggctgcaggggtggccttgaggcgaacgggcagctcaccgtgtctccacctggccaggtgctctacaagctggcatggagcgagagcatggagagggactgtgccaccttctgcgccaagaagtgaggacccccacttgggccccccctcagccccacagcgagctcccagcacccccgcaacacccccgagttcctgcctcatgtcccccactccttagccctccatcacagccccccattctggccctccccctacccctactcccggtatccactacctcctagccccaccccatcacatggtacacaccccccttccccaacacacacactcggcctcagcaaagcttcccgtgtcccccaggttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggttgcagcca

SEQ ID NO: 2393 - DNA, 468068 bp, Homo sapiens; identical to SEQ ID NO: 2392

SEQ ID NO: 2394 - DNA, 468068 bp, Homo sapiens; identical to SEQ ID NO: 2392

SEQ ID NO: 2395 - DNA, 467964 bp, Homo sapiens
cactccgtctcaatatgtctcaagatggcggccaatgtgggatcgatgtttcaatattggaagcgctttgatttacagcagctgcaggtcaggctcctccgcgctcggcctcgcgcccgggggtgggggctgcgggcggtcgcggcctccgccgggggccccgggctggcccagccgccggggggcccgcggcggcggggaggaggggggtgccgggcaccgcggggccgagtcggggccgagtccctcccgctccccggcccccattgatcactcgcttgatcggaaattgatcctctttgttcaattcatcgatcagcccaagatggcgccgggagccgccgccgccaccactgcccccggtgtctgcccccaccccgggcgcccccccgggccccgcgccgccgccgccgccagcgccgccgccgccgttgccgccgcgggaccggggagggggcggccccggcggcccgcggggtgcgcgcgcgagcggggagcggggagcgggcggcggggggcgggcggcggcgggcgccgggagggggccgcggcccggcggtggcgcccgcccgcccgctcgccccgcgcccccggcccgccgtattcccggggaaagtttgtggggagttgctgcggggggtgaagcgcctgcctctccaggaggagccgccgccactgccgccggcgcggcggagctggggctggtggcgctgtggtgccgccggctcgggggagggtcagagcggccaccggcggcggcggcggcggcgcggcccggctccggccaggcgggcgggtggccgggcaggcgcccgcgctcgctacccccggccggccccggccgccgcccccggctgtcaccggcccgggccgcgccgccgctccggcaccccgcgtgtggctcccggcgcggacccccgggtttgtttacgtcccggggagcgccccggggccacccgcgcacctcgcggccgccgcgctcttttgtgtgcctgtgtcggtgacgcggacctgttcctccgtggcggacccccgcgggggctctttggggaaacttggcgaggggcggcgggggtgccccgcgcgcagtgtcgctgggtcccggtgtcccggaccgccgggtgcgggcgcgggaggaggaggctgcaactttcccctaggcaggccccaagctgttcccccgggtgcccgggcagtgtacgctgcctccccgccgccggtccgagccgcgatcgccgcgcgcctgggggctccggcggcccccggtgacctgcggcgccgggtcccttccttgcgtcccctcggggcttctgccctctctgcagggcccgccatggagcgcgcggcgggtgcgctcggagatgccttctcgggccgggttctcgaaagcagagccccgggggcccgttgggaccgtggcatgccgggcggtggtccgcgcgcggagtccccggcgccgcggggggaccgtgccggggctccccggcccgcgcccgagtcgccgccgtgcccaaggggcgagtgcctgcctgccaccccccgcccggaggagcggcgcacccttagggtccgccccgcacgtgccagctcggcgcccgcggcgccgggacagccccgggactctgccaggtggatgttgtgcgtagccggagccaggttgaaggtgagcggcgtgtgggccagaagtcccgaggttgcaggcgcggagggaaccggggatgtcggggggtgcccgggtcccgcggcttagaatgctctagggcggcctggtgctctgggaggggataggagggttcctcagggcccctggggaactgcagctactcccaactgctaaggtgtgcgtgaagataaacttggctgaactttcctaacctggaggactggtgacagtgacctaccgcaatacctttgggagcaaagctcgagatgcaggcttgtatcaaacgaagcgggttggattaaaacatatttaaatggaatctgacaactttaattgtatatgcttgttttctgctcttgcctactaagaacgataaagccgagtcatagtcgttatgaaatttcctgaaatttctcgcttaactaggaagaagactatgcgaaatatgtatttccgataagattaaaacttaaaggagtttaagtatttattgactaaaatagattactccaaagtgtctattgtgtaaattagattcctggatgtaatgaacacagccgaatggcatttttgataaattggtctaccctgttttagtaaaaatagctcccttttaccataatttaattcctgtgcttactgtaaaacccgttgtggagttttaaggacaaacattattattatttttctctcttgtcttcctaaatgtgacatcctagcttaatatcaatgaagtgtcttttttaaagcatcctggcaaaattgcctggaaaatggatttggtttctagagttactagattttaagaactctaaaccttcctgtcccccatattagctacttcttcaggggatcagggctccagggttccatcgaaagtttccatgtcagtttacttgcactttatgtggatattaagaagaaatcaaaaccaaaccccaaaacaaagtcccttatttgaacttcattcctctttactcctttgcttttggtggttgctaacgatttggccttagatgatttcctatgggtttgcaaactttagtcgaatacggaatgtcaaagttcaagtctcaggccaatctggttctttctctgggcggtgaggaggcctttggagttggtgtctggttaattcccaccgatagtcagtgagtcaatagaacgagtttgggagagaattcattagttccagatttttctcatttttccagacctctttatactgagattgggttgccacctgggggtaaagaggctgatcggtctttgcagagagaaatccaggttggagacgtcagcgggtccaggtgaggttgggccgttccgcagttctgcaaccctggctcactgggttcttgtccctcggcttcctgggtcttgaagctgctgccttggcacaggagtgtgtgctcaggaagagaatttctgaagattgtgttttattccgtttcctttttagtcccaaaggcttgtggtatggaagtttcagtgctttggtattgctaagactagttggacaagttttttatcctatctcagacttgtaaaaaccaggttttcttttctttttaaataagaaaagcactgttgtataaatttgtcttttaaatacatatttgaaaggaggacactttctaagacaaagctcatggcactctgtatgttagtggagctttgaactctttgggacggggcccgccaatgactgccttccctttgggacattattcccacatggtgaccagccttcccctttaagcagcttctgcaaaagtaaacttgaaaagttgccttctttttcagaatcaaaaaacaatttcagttttgctgaaagtccattttctgatggctttttttccccctgttgtggaagtgtgtatgttactggctgtccagtactgtttgccataataagtatattattttaattaaaatgtcccatctagtaccctttataaaagagcagttcaagaaattacaccactgctgctcctgcttttgttttcttggttcttttaatatgggtgtctttgaggttggatgtgggaaggggtcattggcagttgatttaagttttttcctatgtgaaactctttttttccttaaaggtgcaagtggtgagttaatgcaacaactcctggtacagttgagtccacagagagccctttgactacatcctcggcttcgtgtatcttctgtcggtagttagccaacctaagaaagctgaaagggccaaatagtccaataccttcaggaatgattctctcctaaatccactgagctaaccttaaaaatgcagtctggtgaactgtgctgagcctgaaacctttaatggctatttaaaaagtctcctgtttttgtacaattaagacaaacccatcagggtttatatgggagctgtgaaggaacagtagtttgtgctctctgattcccttctgggtctacctgtagcagtaaacaatcaaaaccactcctgaggctgtactcactttctgtgtcttaggagagaacacaagactagaagtagaaaatccacatttgtttcagctcctctgtaatgccccaggaacgtctgtttttagtgaaatgaaggaaggacacgtttgttaggggaaaactcatacatttcgtaagcagagaaattcatcatatgaagaatcctacagaggtaggttaaattcctacccgtgcttccatttcaaatagtttacacatttgtcacatgtaaatttcacagacaggtatatctgacgaattgtaacacaaatggtatgtaaaaggcaactctaaccattattcaaatatacaggatccaggatcgtgagttattgtagaaattacttaagacctatttaaaattattgaatacataactttaaaaaatgtaattgctctatgaaaagtgacttttattataattgtcaaagacagaaatttgtctgtcttgtccttttgttttgtctgaagccccgcgttatcgctgcagagagagagttttggtttccaccgaaatttccctgcctccgattgtttaaaccagacccttaatcttattttaacatatttaaaatgttcacaaaacccggaagaattgttttgtgtaagtagcaagcgagtgtagcttaaacactcaagcaattctggtatctaattggaaacaggtggaattcttggaatcccatgtttgagtctttttatagcaaagcccagggacacttttcacttatagccattcgttttgtcgaagctatttgaagaggggccccacagcctctccttatgtcccactgttgcttacctggacaaagcagtcgtgctgggcgctttaggaactggatacctgtgaatgcctggatgccgagagaagtgtgtgtgtgtgccgataatggagtgaaaaaggaatctaatggtatagttagacaagcaatttaatatctgcattgttatatgactttagagcaaagaatttgtgaattcatttgtgatttctgacttgatgaaccttgactgaccagagcatgtaggtacattttattataccccaataatgatatagaattcagagagaagatactcccccccgcccccaaaaaaattctacatttagagaatataagctccaccagcaaccataaaagtattaacttggtgagggggatattttctttctttttttttttttttgagacagagtctcgctctttcgcccaggccggagtgcagaggcactatctcagctcactgcaaactccgcctcccgggttcacaccattctcctgcctcagcctcccgagtagctgggactacaggcgctggccaccaggcctggctaattttttgtatttttagtagagacggggtttcaccgtgttagcccggatggtctcgatctcctcacttagtgatccgcccgccttggcctcccgaagtgctgggattacaggcgtgagccaccgtgcccggcccctattttcttttcttttctttttttcttttttcttttttttttttttttttttttttttgagacgtggttctgtcgcccaggctggagtgcagtggtgcgatctcggctcactgcaagctccgcctccagggttcaggccattctccttccttagtctcccgagtagctgggacgataggcgcccgccaccatgcctggctagtttttttgtttttttgtttttttttttttttgagatgtagtctggttctgtggcccaggctggagtgcagtggcgcgatctcggctcactgcaagctgagcctcccgggttcacgccattctcctgcctcagcctccggagtagctgggactacaggcgcccgccaccacgcccggctaattttttctatttttagttgagacgaggtttcactgtgttagccaggatggtctcgatctcctgacctcgtgatctgcccgcctcggcctcccaaagtgctgggattacaggcgtgagccaccgtgcccggccgatgttttcttaaatattaatggcagggccctctggattgactgtgttatttgacccattccagttttcaaggcgtggtcttgaaaagctgtcgatcaccctggttttgggatgtgtttcagaaccaagtttcgatggtgtgtcagtgttggattttcctgctgaggacagctaaggtttggtatggagcagttttggatttgctgagctgtaatcagtccagcttctctgctgtcttctgagaaggttgatggaggagagtggtctttggcggggatggaggtttccctgcaggaaatgaaccaggactgaggggaacctgtgccgttcccctcatttgtcctgcgcctgaaacagctttgaagcacctggcttgtgacttaaaagatttttaaaaagcatttgtgctgccctattcgggtattacacagtgagggtgaaccattcttttcgaaagacgtctaaggccgggcacggtggctcatgcctgtaatcccagcactttgggaggccaaggcaggcagatcacttgaggtcagaagttcgagaccagcctggccaacatggcaaaacctcatctctactaaaaatacaaaaattagcctggcgtggtggcgcatatccataatcccagatactcggcaggctgaggcatgagaattgcttgagcccaggaggtggaggttgcagtgagctgagatcgtgtgactgctctgcatgcagcctgggtgacagagcgagactctgtctcagaaaaaaaaaaaaaaaagacatctaatttgttgtaaaacctgtcaagaaccttccctttaaaaagctaatgcctctctaataaaaataattttaattttgttgtaattaaattcagagaggatgatgttagtgcacaaaataaagattgtcaatttctttattttaatccaacggcatttcctaactgcaggaggcccaggaccgttggcagaaattttgtgttgattagagcctcgggccatgggaagtgcaggtactgtggccacaaagttcgtcgcccaatccctggctgaccccacaagcaggactggtacagatcccaccctcaggggtcttcctacacagagaaacataatcacacaggtgactggaacggagccaaggatggtggtgttcctcctagggatttactaacactgccagcaactcaagaactagccagccgggagtttcctagtaagtgaaactgacttggttctgcttcctttcatgaaaacctttgtgaaaatgagcccaataaggggtccgaacctttataaagcacacgaccccccagagtggaccgggccctggccgactccatcagccgaagcttgagatcttggatggtctggatggtcttgaccgtgtgtgattgatgcagttaacaaagcaggaaattaacagagcttactctgagacaccagggaagtggcttgttctttcttggggttactttgagtggatgctggcacactgcttgttttcttatagatacctttctattgggctgtgtttattcaataaggaaatgcagttaacatttttttaacaagtaaaccatgggttatgaggtgttccgagtttggttaagggaaaaacaaattgacaaattagctctttcttaagtgagtattgcgaaacagtgagaaatagaatgcctgtcgtaccgtcattaaaaatttatctgggtgttgacagctttttgttaaatgtaagacattcagatcctgtccacccagcatatgaaaaaaccaaaccaaaccaaaccgaaaaacaaaatgcaacacaaaagcttctttccatttccccccaaaagcaagacaatttttcttaaactggggctttctccctaatgaattgccatgattttgttttctctaacatagtttaatatctttaagacagaacgaatatcaactctttttattttattttttgagacggagtctcactctgtcgcccagcctggagtgcagtggcacaaactccgctcaccgcaacctccacctcccaggttcaagtgattctcgtgcctcagcccccccgagtagctgtgattacaggtgtgcaccaccacgcccagctaatttttgtgtttttagtagagacagggtttcaccatgttggccaggctggtttcaaactcctgacctcaagcaatccacccccttcggcctcccaaagtggtgggattacaggtgtgagccgccgtgcctggcctccactctttttagacacctttgttgagttgttgttttgggcctgtaagtttctctggcttattaccactttcccctcctgtttctagggaagaaatgattatttagataaaaaataatttgataaaaggtagcagatgataccaaaggtaaatctttgtcttgaagagcctgaagctgtgagcattggtaaagccgtgggctgcagtgagggaagggccggcttggagccgccctcagcctagcctccgggtgttacctggagcccttgctgtcaggacggcctgtcacttctcgcccttctcctgccctgccaagcctgtcccttcctgtgttgtgacaacttttttttttaaacaagtatttctacagctccattattttgagattcttggaagaaagatactatgtaaatgaaaattaaaaataaaattctcgctggagggaatcgtatacatgtaacgtttttgatgaggtttggaaaagactttcgttctccctctggaactgggaacattctgtggctcccgtcaccatttctgtgtcactctgaaaggtgtggcagataatggtgaaacatattattttctgtttttcaccaagtagttgacccagaacttgaacccatgcagtcctgggtccagtgaattatttctgctgcatacagttctgctgtgtcctcgccgagagcgtagtcagcaaccgcccggagaataccaacctttcaaaagaaaaagggctggagtccccaacatacagagattacagctaaaattacgaccagagctgttaatcaaatcccatcttcccttcctattcacacagtagagatgttataagtcatacaggtttgagacagaaaattgagagcagaggagcatgtgtttaaaccagcatagaaacattcatttaccagaattgctttatttcagccgtatctcaactcgttgcttacacagtaacgcatgctgtctcgtcactcagccaagtgggagacaagttcaggtttctgctccatgggatccaggagcctgcagtcaccgatgagcctggaggaccacaaggtggccagggcccttggagagctgtgctgcggaatcgtaaagctaccatccggagctggccgtcccagagggaaggcttggtcatctcttcccctccacctggtcctcagccctggtcccgcagtttgtcatcccgcagtttgtcagcatcgatgtgggactgggagaggaaggatattgccagttatggttgaatgtcattgtcaggggagtaagaagtagtttgtgattgttttacgtggctctgtgttggtatataattatgctgtcatcttaaaacgccctgataccttaatgaaatctgtgtgtgtgtgtgtgtgtgtgtgtgtgtgtgtgtgtgtgtgtgtgcgcgcgcgcgcgcagttagtcttcggggctgcttattgtgtgtgagagccaagtctttctaacacacgagctgagtgcgtcgtcttttacttgtttcaaaactgcccattcgaaacaggtcgcaatccattataaatgcagctgccagattaatcttcccgaaccattgatttcatcatgccattcctctccttaaacatccatggtggcccacttaggcacagagtggagaccacatttcttagggtagcagacagagttcctgatagtcctttctgccccacctaaaccttttccatcccagctagaatgactccagaatcttgcttatttgggggagctccctcctcctccctctgtacatctgagcttcaagcctacttcagaatttttttgtttttttttgtttttgattttttgaggcagggtcttgctctgttgccggctggagtgcagtggtgagatcatagttcactgaagccttgacctcccgggctcaagcaatccttccacctcagcctcccgggtagctgggactataggcatgcaccaccacgcctggctgatttttccatttttttttttagagacagggttttgccctgttccccaggctggtcttgagctcctgggctccagtaatcctccctccttggtctcctaaagtactgggattatagaggtgaaccactgcgcccggccttcaagcctatttcatgcattcctttttcttttgcccctgtgtgcccggcagtagtgatggagacttaaaatagcagtggcttcccgcctagagggcggacaggactggcaggacgaggctgggatggatggagcagtgtgtctgagcctctgggaaggctgcaggaagggcttggaaggcgggtcggggagtgggcagggggcgcccactgagttctgtgtgcttggggaggtgtgggagacagggctttccagcagaacagtcgtggggtggccggggatctctagggctcccctctgagcttgggttccctccctctgccctgattatcccttgggtacccaccacaccatcgccacacaggcccccactctctgccttgtgtgtccgatttaggactcattcagctggttaagaatgcaaaattaattcttttttttaatatagtgaaagcaggtagattatattaaaatggctgtgttttgaaagctactgataggtacacctatggaatagatgtttctttttcagtcccattaattatctttctgtgcaaagtaacataagtgttactttttcagtcccattaattatctttctttgcaaagtaacataagtgttggttaaaatacagttgacccttgaacaacatggggattaggggctgatcccttctgctgttccccctaccccacctgcacagtcaaaaatccacgtataactttttttctcccctcccctccttctcttctcttctcttctcttctcttctcttctcttctcttctcttcttttcttttcttttcctttcccttccttttcagacggggtctcattctgtcacccaggttagagtgcagtgacataatcatagctgactgcagcctggacatccggggctcaagcagtcctcccacatcagcctcccagtagctggaactacagacactcaccagcatgcctggctaatttttaatttttttctttttttagagacagggtcttgctttgttgcccaggctggtcttgagctcctgggttcaagtaatcttcctgtcccagcctcctaaagagctgagattataggcatgagccaccaggcccacataaaacttttcattccccaaaaacttaattactaatagcctaccgctgatgggaagccttaccgataacataaacagttgcttaacatgtattttgtatgttaatatgtgtgatatactgtattcttagaatgaagtaagctaaagaaaatgttattaagaaagttgtaaggaagagagaatatatttactaatcagaatatagaatggatcatcataaaggtcctcattctctttgccttcatgttgaggagtctgaggaggaagaggaggcgttggtcttgttgtttcaaggtggtggagatggaagggctggagcaggtggagggggagtcgggagaagcaggcccaattggtataacttgttttttttttttttttttttgagatgggagttttaccctgtcacccaggctggagtgcggtggcggatctcgactcactgcaaccttcgcctcccaggttcaagtgattctcctgcctcagcctcctgagtagctgggactacaggcacccactactacacccagctaatttttatagtagagatgggtttcaccgtgttggccaggttggtctcagaattcctgacctcagatgatctgtccgcttcggcctcccaaagtgctgggatgacgggtgggagccaccatacccagccccactcaatgtcacttttattatggaaaaaaaaaaatctgcgtgtaagtggccccacacagttcaaacctgtgttgttcaagagtcagctatatgtataattgtacctgtggcacatagaacacaaaaagatccacatttttaaaaacagcattgggcagaacaattttttgacagaggtctgtttgactctgctgacagcctgagtgggaggaaacttccccatatgaacgaacggggaaagtgcatgttgtagttctcaaaacccaaaaaaatctaagagaaacccagcagcaagaaacacagaggtttgggtgtcagcatcggaggaatgtctcacgtctgccttgtcccccagaccccgtccctgtgtctgggcaaaggcacgccccgctccaggtcggccccatttcagagcagtggccctcataggctttgtgcctcttcatttagtctaagaaactacctaggatatttttgtagaggtgacatcactgtctggctgcagaagcatttgcttggatttggggaagtgagggctgggagaggagggcttagagaggcaggatgcccaggcccattgcgggtggctgatggggggtgggcttagcatctgcagggacagggtggagggagaggagccaccccaggcagggggaaggggtgtgccccctttgggatatggaggttttggggggctggtgggagggaattccaggggtcgagcccctggggaaaaggaggctttaaggtcagtggaaaagtgggtgccaaagtctggaagatgagttgaaacctggagtttgaagcccggggaggattttgttggagtgttggctggtgctggagagttttgcatcacttggggtggggtggggtgaagaattaacttgaactggcacagcacccctttgtcttgactttccctgttctggagtgaggacggcttgatgtttcagcaaaaggagtagtggagagggagaatatttgcttgtaggattgggttccacataccatatctacagttttacatccactggtgacaagacaggagcttttctatttttgttttgtatttttatgtttttgtgcactaacagtaatggtttcatgggaacagatggcggacggacacgggcttaggctcttggtttatttcatgttacttgcatgacagccctatggagctgcgtacctgccataggtgagaagccgggagttggggttacatcccggactttgctgagctccaggagtgtttttcctcccgacctgcgctgttccctagacaaccctcagccgaagcagtggggtcatcgggtgactcagaagggacctcttctcaggggccgcccaagatgagcttggctgggtctgggtcacttagcagtgagcagcaggggatggaaatggggccggggtgggtgggcttgaggggagcactttctcagggacgcctggctggagccttgccctggcaagacttcaaactcagccccgcagagaagggtcatctgatgatagaatcacggctgccccatcattcccattagcaaacttcatctgatagttggggtacggttgtggctcaggctgtaaggagcccccctgttgcattactcactatcctcagatgccccatccttgcctgaagcaagtttgttgggacagttttggggaactgttaggagagaggcctggtcatggggccggaggggcccagaggagcggcctgccctatctgtgggcggttcggtgagtgctagatggggtgtctctttacaagactttcctctgagatgctggggctatgcccctgggtgctggggagtgaattgcccgtagatactgatacctgtacttaaccctgtgacggtcaagaccagatccccactctccaagcccctgggaaactggttgatgtagcccctgcagtgataccgcactcaaatccatgcagatcccctgacatggtcggggcagcacccaccacgcaggcttctgttctgagctacatgggatgttgggcgtgtgttttctaagagactgatttcataagacatgtaccagtggccgactggcctgaaacagcctggtcacagcgacatccctgagatcttagcttcttttcctcggggaattatcattggactggaaaactgaggttttgggccactctggattcagatgcttttgttgttgttgttttgagacagggtcttgatctgttgtggactgcagtggtgggatcatagctctctgcaaccgcgaactcccaggctcaagtgatcctcctgcctcagcctcctttgtagctgggaccacaggtgtgccccaccatgcctggctaattttttttacatatttttatacaaacagggtcttagtatgttggccaggctggtctcaaactcctaggctcaagtgatcctcctgcctcagcctcccaaagtgccgggattatataagcgtgagccaccacgcctggcccagataactcttgcctgcctgatttttttataatgatgcactttgttttgttaaaaatttataaatttaaagacaaaatatgcaaaaatgtgccctggtctcagaaataacacagcacattcgagtgaagttgttggcagttccgtgtgttttggggtgattcatttttttcataggttgttggggccgtgcatccattcgtgttctgagcacactccatggtacctgatgactcgaatggatcctgttcaagcccctgggttacccaaagaaatatacttctggcctgctggttggtcagagaatgcaggacacattggggtatcgcgaggtgtccaatggcagcgggttgggtgtgtctgctgtgtgaacagggcaggggtttgggaagatggactctggctgtcttgctccaaagacttccttaggctgttgttgagcatttattgagtgtctcctgtgtgccgggcagcattctagcatagggattgagtgaccagacagtagggaatccttgcccttaaggaactgacattcttttttttttttcgagatggagtcttgctttgtcgtccaggctaaagtgcagtggtgcaatctcggctcactgcaacctctgcttcctgggttcaagtgattctcctgtctcagcctcctgaatggttgggattacaggtgtgcaccaccacgccgggctaattttctgtatttttagtagaggcggggttttgccatgttggcctggctggtctcgaactcctgacctcaggtgatccacccacgtcagcctcccaaagtgctgggattacagccgtgagccaccatgcctggccggaactgacattcttgcaagggggatggaagacaaaggcaaggaataagtgagtgcccagtggcctgggaacagacggagcaggactgatacacaaagccccacagagtcacttctgtcttctgaaggccctgagaaataactttattattattattattattatttagagacagagtctcgctctgtcgcccaggctccagtacagtggtgtgattatagctcactgcagctttgacctcccgggctcaagctatcctcccacctcaggttcccgagtagctggaattacaggcatgcgccaccatgccaggctaacttttttgtattttttgtagagatgggggggtctcactgtgttgcccaggctggtcttgaactcctggcctcaggcgatcctcctgccttagcctccgaaagtgctgggattccaggcctgagctgccatgcctagccccgatttttaaactgaagagggatggttcagttgttggggtgtgtcttagaggatccttctggaagccccacatggaaggcgggctagagtgaggagggaggggtgataatggaaccaggagggtgtggtggtcatggcccagtgagaggatgccaggctgtggccgtgccagactcagtgtgcctggccctggcatttcaggcagggaccactgaggggtgatgggagagatggggctgggtgagtggcatttccacaggcatccagaggggtgcgaaaaactgaggttggggaacagcaggggcagggaacagcctgtggagggtgtggtcatcagtgtcccccaccgacatggcacatccagcgagcccactgtgtccccagcacctgcggtgcagggggctggcaccttcaggggcgggcttcgtgcagacgtccacccagtcagtccccacaggtttatcaaacacaagtggggcgacaggacccacacttcggcgttggacgtgactcacgcggggagttggcttggagttcctttattcatccctatttgctttctgtctgtaatcctttgtaattccctggtttcatgatgtaattctaatggaaataaacccgaacctttcaaaattatgtaattaattgcattcagcttcaatgacaatgactaattatagtgatacctggtggcaaggcaggtacctactgctggggggctcctgtctgcttggtactaggactgccacttctgggcgcgtcggagcggctgcacagggggtcagctggctgtcctgtggcctgctccggtgcctctggtccccatcttaccaggagcagcgccatggccatgcagggaggggccggagagggaggtggtgtgcagggaggagctgcttaggggtgggagggcttggacttgtctgcaggttaaagagaagtcttgctgggaaagtaacttcggggctggttccctgagagcattcttatctgattcatgtattttcctgagaaaaagggaggagggtgcgttcgactgaacgtgaagcgttcaaggatcggaaaggcaagccaggtacagtggcttacacctgtaataccaacactttgggaggctgaggcaggaggatcacttgagagcccaggagttcaagaccagcctgggcagcacagtgagaccccatctctacagaaaaaaaaaaagaaaagaaaagaaattagcccagcatggtggctcacacctgtgataccaatactttaggaggtcaaggcggaaggattgcttgagcccagttgttcaagaccagcatgggcaacagtgagaccctgtctctacagaaaaaaaaaaaagaaagaaattagctgagcgtgatggtgcacacctgtgatcctggctgctcaggaggctgaggcaggaggatcgcttgagcccaggagttggaagctgcagtgacgtatgacagtgccattccactccagcctgggtgacagagcaagaggaagactctgtctcttaaaaaaaaaaaaaaaaaaaaaaaagaatccaaaagcaagcttatggagaagggagaaagtgcgacagtcacctcggggcgtgggagagcagaagatggatgtcaggttaaaaaccattactgtgctgtagtatttccaggaggccaagtccagggctctgggacctgtacactgcggcatcagaccctaaaacagagctctcaggttttcgccttcccaggaagtctgcatcctttttgcagactggttttattctgtgttaggaggaggcgattttgctaagaaatcttcactgcaattttcccccccaaatcagggcacttggcatctccttctaacggggggtgcagagtctgtcctagaatgggacgcacagtgttcacacgagtaccgagtaggtggggtgctgggccggcccctctgatcctgtcctaccctgtgcagccacgtgcctttccttatccccagacttctgttgtcacgattcttccagggaagaatctggaagtggaatccacagggcggtgcccagggatggcctttagtgcctagtgttctgtttcagagagaggcctcttatttatttgaaaagctgattgtttcttttttttttttttttttttttttttgagatggagtctccctctgttgcccaggctggagtgcagtggcactatctcagcccactgcaacctccgcctcctgggttcaagcgattctcccgcctcagcctcccgagtagctgggactacagacacccgccaccacgcccagctaatttttgtatttttagtagagatggggtttcgccatgttgcccaggctggtctggaactcctgacctcaggtgatctacctgccttggcctcccaaatgctgggattacaggcatgagccaccacgcccagccttattttctatttttaaagaaagagcaagactgaaaacatttgcatgcacagtgagttttaaaaagttcctttttttagagaggaccaagaaggtgcagagtactcttgaaaagaaattttttttctgttctaaacgtgccgcttgttgccctggtgcagagagcagttcttttgatacaatacctccgtcccgtaacttttttttaaagctaaaattcatataatgtaacatttacctttccaaagtttaaaattctggccaggcctgtaatcccagcactttgggatgctgaagcgggcagaccacttgaagccagaagtttgagatcagcctggccaacatggcaaaaccctgtccctactaaaaatacaaaaattagccaggtgtggtgagcgcttgtaatcccagctactcaggaggctgaggcaggagaatctcttgaacccgggaggcagaggttgcggtgagccaagatctcgccactgcactccagcctgggtgacagagcgagactctgtgtcataaataaataaataaataaataaataaataaataaagtttaaaatccataggtgtttggtatactcacaatgtcgtgcagccatcaccacgatctagttccaaaacgtttccaacaccccgacaagaaactcccatacctgtcagcagttaccatttgtcctccctcctgtacccccggcaccccgtaaccattcatctattctctgcatctattctctgcctccatgcgtctcgggaatcatggattacgtgaccttcgtgctgtggcttctctcacgtagcacagtgtttgcggggctcacccacattgactcatgcacctgtctgggccgcattcttttttatggctgaataatattccctggtatgggcataccaggttttgtgtatcctttcatcagctagtaaacattcgagctgtttccacttttttggccattgtgaataacgctgctgtgaacattcgtgtacaaatgtttgtatgaatgcagttttccattttcttaggtgcaattgccaggtcatatgtagtcactctgggctttgctttttgagtctgttgtattttatttatttatttttttatttttgtgggtgcgtatatttatggggtacatgagatgttttgatacaggcatgcaattcataataatcacattgtggagaatggggtatccatccatcacagatttattctttgtgttgccaacagtccaattatacacttttagttattttatttgtttgtttattttgagttggagtttcactgttgttgcccaggctggagtgcaatggcgcgatcttggctcactgcaatctccatctcccgggttcaagcgattctcctgcctcagcctcctgagtagctgggactacagctgccatgcctggctaatttttgtatttttagtagagacgaggtttcaccatgttggccaagctggtctcgaattcctgacctcaggtgacccacccacctggcctcccaaagtgctgggattacaggcgcgagccaccgcgcccagttgcttttagttactttaaaatgtacgattaaattatgatcgactatagtcaccctgttgtgctgtcaaatactaggccttattcattgattctatttttttgtagccattagccgtcgctacctccctgcattgttgcattttggcctcttatgtgtaagtcccgtttgttctccagaatgctgcttttaacacccagcccgttccatctctctctcttctgccttgggtgtcatgctgtctcttcctcagatttctcctggggtgcaggtgctcccctgcgaaccactgctgtgcacaaagtgattttgtgctcaggcaggtggatcgcttgagcccaggagtttgaaaccaccctgggcaatacagtgagaccccatctctacaaaaaaaatggctgttgtgcagtttgggatgagagttggttgcccccgcggtcctcccttcccccaaccccacctgccctccttgctcagcaacaagggacccccttcactggactatgaagcctgagggttgtctaaatcaatccttggccaggcgcagtggctcatgcctgtaatcccaacactttgggaggccaaggcgggtgcatcacctgaggtcaggagttcgagaccagcctggccaaggctctgagagcagcgagactccttctcaaaaaaaaaaaaaaaaaaaaaagaatcctggctgttccttccccacggccagtgggcattacactttgttttggctggagaaaccgggagtgcccgttgtctgcctggagacatgcctgtgggagaagaggctgcccccacctgctaccatcatcccagcatgggtgcggtggggggcaggggagacagagtaaaaatcgcagaggacatggggcagaaagatggaaggaacctgggccctcgatggctctgagtgagtcagtcctgcagtgccccgtccccatttttctgtggcctgggaaagtcaaatttcctcatcctttgtagttggccattgtgttatttggagatggaagagcattctgaaacaagccactataatgaaaatccaggtcgtagcaacttgccgtgcacggctttggcttggcatggacttacagtgacatctttgagatgcacttgtccggggtgcaggtatatttgagagtgtgaggaggacatatgtcctctaagctctgttttctaaaggcagcagaattccatttgccaagccagatgtccctcaatacgttagatcccaccaataaaacattaagcaattacaatggttaatattcactaaagtataattagaagctggcgtaaattgtgaatgaaattggcgggttccatacgttacagtgaaataccaaatctttttttagttgtgtatgtgtatctcagtgagtctgtcaactcagatgagtgaatcttacctcctctgtggatagaaacgagctcaatttcaactcagttcactataattttaaatgtttaagaacatcttgccagttgttctatcatgttaaagttactgaaatctggctgggtggagtggctcatgcctgtaatcccaggactttgggaggctgaggcgggtggattgcttgagcccaggagttcaagaccagcctgggcaacatagtgagaccctctctacaaaaaaaatccaaaagtagctgggcatcatggtgacgcacacctgtgttcccagctactcaggaggctgaggtgggaggatcacttgaagccgggaggtcgaaggtgcagggagccatgatcgtgacactgcattccagcctgggtgacagaacgagaccctgtcaaaaaaaaaaaaaaaaaaaaaaaaaaaaaaggataccaaaattctcaagtcaaattataagggttttaacattcccatttctacaccacgtgcaagaaaaacaaaatccttgttttctgcctgcctttatggtccgttctcattttcagccccctttcctcattctactctattaattatgcctttatatggatgcaaacttgtaaaatatgtggcctattttgtgtgtatacgtggttttaattcataagtgtggcactgtgccctaaatctttttctccttccttttcactcgtcacatttttttttttttttaaatgacacagagtctcgctctgtcgcccaggctggagtgcagtggcacaatctcggctcactgcaacctacgcctcctggatttaagtgattctcttgccccagcctcctgagtagctgggactacaggcgcctgccaccatgcccggctaatttttatatgtttagtagagacgggctttcaccatgttggctaggctggtcttgaactcctgatctcaggtgatcaacccacctcagcctcccaaagtgctgggattacaggcgtgagccacctcacctgggctcactcaccacaatttttgagatcttgttgtctatgtcattccctgtgaattttgtttgttatgacagccgtattgaaatccatcttcagggccaggcgcggtagctcacgcctgttatcccagcaccttgggaggccgaggtgggtggatcacctgagatcaggagttcaagaccagcctgaccaacatggtgaaacccccgtctctactaaaatacaaaaaattagcagggcttggtggcgcatgcctgtagtcctagttacttggaaggctgagacaggagaatcgcttgaacctgggaggtagaggttgcagtgagccgagattgtgccattgcactccagctttggcaacaaaagtaaaacgctgtctcaaaaaaaaaaaatccaccttcagaattgacctgtgttaatctgtccagactgccgtaacagaataccatagatggggtggcttcacatatttacacaacacatatttatctctcatagttctggaggctggaaagtccatgatccgggtacgggccaacgtggttcctggtgcgggcccttttcctggcttgcagatggcctcgtttttgctgtgttgccacatagcagagagtgtgcgcaggcaggcaagccagctctctggtatctcttgttttaagtacactaatcccatcatgagggctttaccctagtgacctcatctcatccttacgaccttccaaaggccacacctccaagtaccatcatattggaggctggggcttcaatgtatgaatttgaggggggtggacaacacagttcagtccgtagcagcaccctagctcacacgtccatttccctggggctggtcaccctcggtggtatctgacccccctcccccaagcccctccatgcacagcactgctaggaacgttcttacacacgtcccttaccagtatccaggaaaagccttgctggatccagccagatagtggtccttctttcacgaagcacctccagatcgcttcccagcgtggctgccccacttactcccccacccacagtcgtgagagtttctttcccccacaatctcatccgtgctttgtggagatattttttgccagtgagatggttttaaagtggtacttcagtgttgtgtcattttctctgatcaccagggaagtcgatctttgcgataagcctcattttatacttgtcagcttttcagatttcgccttttgtaaattgtctggtcatatattttgtcctctttttttttttctaaatggtttaccatctttttgttgatttgcaagagctccttgtatgtttcacatgcgaataatttgtcaattttctttcttttttttgttttttgagacagagtttgctcttgttgcccaggctggagtacaatggcgcggtcttggctcacttcagcctctgccacctgggttcaagcgattctcctggctcagcctccccagtagctgggattacaggcatgcgccaccacacctggctaatttttgtatttttagtacagatggggtttcaccatgttggtcaggctgatctcaaactcctgacctcaggtgatccgtctgcctcggcctctcaaagtgctgggattagaggcgtaagccaccacgctggccgttatagttttttaaattaaaaaaatttaaaattctaatagattattgtggtatagaggaaacaattggtttttgttgatttcgaagctgggaagcttgctgttaatatttttactaattaacttgattctgttgcattttctctggaaataatatatgcaaaataatgcaagtttttatttgttcctttccttctgattcttacagtggagtgacttgctggctagaatctgaagtactcaattacatggtggtggtgatagaggctgcccttttctttctctttctaccaaaggagatttttggtagaaggtttaaccaggtgaaggaactaccttaactcccctttccatagtttttagagaattttttttggtataaataggcgttatcctcttgcaaatacttttccttaaaacctattcatgtccatgcagtttttatcctttagtttatgaatgtggtaaattacattgattgactatatgatgttgaatcatttattgctttctgggataaactcttcttcctcttgtattttaaaaatattgttggatttgatatacagttttcaaatctgtgttattaagtgaaattggcctataattttcttattcagttggaattgaggtttactagtctcatgaaatgggtaaacattgtgttggaacaatttatataacatgaggattatctgtatcttaaaatttgatagctcacctttgaaaccatcagggcctgagactttagaatggtggctgggaggcatttaacatttcactttttttgtttttggtctattgaggttttctattctttattttattttattattattattatttttttttgagacggagtcttgctctatcgcccaggctggagtgcagtggcgcgatctcagctcactgcaacctctgcctcccgggttcacaccattttcctgccttagcctctcgagtagctgggactacaggtgcccgccaccacgcctggctaattttttgtatttttaatagagacggggtttcaccgtgttaggcaggatggtctcgatctcctgactttgtgatccgcccgcctcggcctcccaaagtgctgggattacaggcgtgagccaccacgcccggcaggttttctattcttatgccaattttggcattttataattttctaaaaatgttttcattttatcttggttttaaaacttaactgttctgtgatcatagtattttttttttgtaaatctgttttgaactctagctgtctcccatttctacattctgtatttctgaatttatttacaactcttctctttatttttagttgtacatagaggtttgtttatcttactgatcttgaaaaaacagcttttggtcttgttaatcttgccttttttttatgtggcttatttctcaccattattttactttctgagtgcattttttttctaacttatttttttgaatactcagctttttatttcattttatttatttatttatttatttatttttgagacagcctcactctgtcacccaggctggaaggcagtggtgtgatcttggctcactgcagcctctgcctcccgggttcaagtgatcctcccacctcagtctcctgagtagctgggagtataggcgtccctgccaccacgcccagctgagttttgtatttttagtagagacagggtttcaccttgttggacaggctggtcttgaactcctgaccttgcatgagccacccacctcagcctcccaaagtgctgggattacaggcatgagccaccactcctggccttgaatactcagctttttaaattggggttctttcttgttttggataaatctattcaaaactgtaacatttctgctaagtattattttagctgtgttccacaaattttgacatgtagtgctttcatttttattcattttgtaattttctattcattttgtaatttcccttataattttctctttaacctaagggttatttaatactgtatattttttagatttttgacacttttctttaatggcttttaaaaatgttgttgctgtcatttttatcacatatggtcagagaacatagttcacataatcctggttctttggaatctatgaggtcttctttttggtgtcttgcacatggtggatttttgtgaattttccatatgtgctcaaaaagaatgtgttttttgagtagaaaaaaacgttatatatgcagtatacaagtgacatataccatatagtcatacagtttgtttggtatatggaatacattcatgtcactgtttctttgataattttcttcccatagttttttttcttctttctttctttgagacagagtctcgctgcatcacccaggctggcacgcagtggcgtgatctctgctcactgcaacctctgcctcccaggatcaagcaattcttgtgcctcagcctcccaagaagcgagaattacaggagcacatcaccatgcccagctaattttcctagttttagtagactgggtttcattatgttgctcaggctggtctttaactcccggactcaagtgatcctcttgcctcagcctcccaaagtgttgggattacaggtgtgagccaccatgctgggccttcctacagtttttgacagttgttacattatattaggttaaggctgtactgttacattgcatgtatgatcatgatcatgatctttagattttcctgatgtattggttttttttttttgatgtctgtatagactcttattatgtttttcatgttaaattctattcgttttgacattaaaattattctattttttttttttttttttgagacagagtctctctctgtcgcccaggctggagtgcagtggcgcgatctcggctcactccacctcccgggttcacaccattctcctgcctcagcctcctgagtagctgggactacaggcgcccaccaccacacccagctaattttttgtattttttagtacagacggagtttcaccgtgttagccaggatggtctcgatctcctgacctcatgatccgcccatctcagcctcccaaagtgctgggattacaggcgtgagccaccgtgcctggcctattctcctattttttttgtttgtttttggtttccatttgtttgatgttgctttttctctttaattatttccaatccatatcattttgctttcattgcatttgttgcagatctgtgatgtaagatcttgtttttaaaacccaggttgagaatctttgataagtgaatttagctgagacacatttctggtagttgtgttatattaggatttctgccatcttattttgtgttttctgcttaccattacttatttttaaaaaagcttttcttgtaatgctttgtagggttgaactttcttctgctggattttaaagttgtgcaatctattttattcttctagagctcagaattgtgattattcttaaaattattaagagccacttatgtgattagtttttcctatccatttcttttttttttcttttagaatataattgatttttaaattcacttacttgtttcaactgcctggagtagggattcctgtcagtttctaaaggctattaatatctttgtctttctgtcaaacaagttaagtgatagggacctcgtttcctcccttcagcctgttgagatcgtttagattctaggataatggtgccatataggactgtggccctcgggtgtgcagaatcagcgtcaccaggtattagactttcagtattaatgttctctccttgctagaatatgtgaacaaatgtgaaccttttgaaagagccaatccttcaggatggatccagaatggctaaccaggcctaaatctaaaatagagccagacggccatttgcagattggaagtcacacacttagtctgagttccctgaaaacctgcacctttcttaagtttgggactttcagagctcacctgacccaactagtctgagttcaccagccctggccaatcagggctcagctgtgtcaaccaatcagccctaagcacgtttgaatcattcataaagaaatctgactgggaacctgggtgggcactgttgctattaacaaacaccgtccccctccccgcccccgcccccgcccccaaccccagcagcttctgtttacacggaaggctgcatctccctggtttgcacgttgtccacgggaataaagtctctttcctccagattccttttcagagcacttttgttaagtattttaaatgatagtgcatttaaagaagtctttctgtgataaacttcctgagactttaaagtctgagtctatacttattccaccctcatatttaagtgatacattagctggatgtaaaattgtaggtcaaaattctttttcttcaacacccagattattcccctgttttctttttgcacagagagtcacggttgagaaatatgaggacagtgtgattcttactgctttggagggaagtctggtttttctttttatccctgtcttcattcttttttctttttatccttgtcatcgttcttcttttttctttttgtttttccgagacagtctctctctctgtcgcccaggctggagtgcagcagcacgatcttggctcactgcaacctccgcctcccgggttcaagtgattcttgtgcctcagccttttgagtagctgggattacaggcgcctgcccccatgcccggctaatttttgtatttttagtagagacagggtttcaccacgttggccaggctggtctcgaactcctgacctcaagttatccacccactttggcctcccaaagtgctgggattacaggcgtgagccactgcgcctggcctgtctttattctttaatgtcaccaaaatgtatctaaataatgatttcttccacctacctatcttatttggcactttactgaccctttgattctgatgtcttatttttttcttttattctagggagttctcatacatttatctctccaaatattttctctcctctctttattttttcttctttctaggacacccactgtacaggtgtcaacccttcttctgttgtccatctctctctctctctctttttgaaatggagatggggtctcactatgttgcccactctggtctcaaactcctgggctcaagcagtcctcctgcctcagccttccataatgctggaattacatgtgcgagcccccatgcctgacctgttctctgtatctcttaacattagcctcattctcaaacatgaagagagtagccttggtgtagactggccacgaattggcgattgttgagatgggcgattggtagtgagggtacccatgaattggcgattgttgagacaggcgatgggtggtgaggtactgtttgtatgtatttgaaatactgtctgtgtatagctccagttgaattacctcctactgagacccactggccttagcctgtggtgtggggatgaaagtggggagggaatagaggaggaggctggctagataggcttggggctggctgccaggacagttaacatgacttacatggcacatcgtacatttctatggaacagtgctgttccgatttagccccttgctaggcaaagtgattcatgaaccagcaacagtggtatcacctgggagctcgttagaaatgcaggatctggccgagcacagaggcttatgcctataatccccgcactttgggaggctgaggccggaggaccacttgagttcaagaccagcctggccaacgtggtaaaaccccatctctactaaaaatacaaaattagccagatgcagtggcacatgcatgtaatcccagctacttgggaggctgaggcaggggaatcgcttgaccccaggagtcggagatttcagtgagccgagattgcaccactgcactccagcctgggtgacaaagggagactccatctaaaaaaaaaaaagaaaaaatgcaggctctcaggccccaccccaggcctcctgagacagaatctgcatttttatgagattgtcaggtgaatcatatgcacatgaatgtttgcacattaaatgagcactggtctggatcctttaaaaaggaatgattggttttatttaattcatattttaatagagtgactcctcccttatcttccaagttgagctctcccagcatagatggcccagctgccagggctgatgcccatagtctgtgcataaacaggggagttcccgagcccttttccaagccgcttttaaatgcaactcctttttttttttttgagataggctgttgctccattgcccaggcaggagtgcagtggtgcaatcctagctcactgcagcctcgacctcctgggatcaagcgatcctcccaccacagcctcccacctaagccccctgagtagctgggactacaggtgtgtgccaccacacccagctgattttattttttgtattttttgtaaaggcgatgttgttcaggctggtcttgaactctttggcctcagcgattctcccacctcagcttcccaaagtgctaggattgccagcgggagccaccctacccagccgaactcctttcttacacgtagttctgacagtatcgatcatccactcttcaaggtgctaatacattaaaacagcaaattggaagtaggccaaggaggtgctagtggcagccccacggacagtagcaattaagaccagttgctagcttgatagtgggagaccagaaagactaaaaataattgcaggctgtgttggtctggtatggatgctgacttcctgacatgtagctaggtggagtggctcatgctgtaatcccagcactttgggaatccaaagtgagacgataacttgaggccaggaattcaagagcagcctgggcaacatagcaagaccctgtctctacaaaaaaatttaaaaaattaaaaaaaattagctgacatggtggcacgcacctgtaagtctcagctactgaggaggccgagatgggaggatcgctggagcccaggagttcgcggctgcagcaagctgtcattctaccactgcactctaggttgggcaacagagcaaggtcctatccctaaagaaatgacaaaataaacagtcaaccacctggtggagaaggtagtattttcaccaacgctgtagcaaatgtcaaggccaagacaaacacttgtttggaaaatttagttttggggaaactcctctcctctagtgtgctggattcatgatatattgttacctggaaatggcagccctcagtggataagaacctggggttttggagatgacccatgtttggcggcacctgatccctatcagcagccatgcgtcccactgtctaggcagtggccaagggtgctctgtcttggacggcagacagcacatctgatttggaatttttgttccagcacttcttagctgtgtgactttgggcactgctgaacctgcttcctccgtgaaacagccagtgataaaactatttactgtgtagaggattctgtgagactcaacgtatggcagtgcctgatgtactattctaaatttatttttatttttattttagagatggggtcttgctgtgttgcccaggctggtcttgaacccctggcctcaggtgatcctctggcctcagcctcccaaagtgctttttcattttctcctcaaaatgagaaagtaaagtgttatggtgttggcagctcacccatagaaactgctttaaaggccaggcatggtggctcatgcctgtaatcccagcactttgggaggccaaggcaggcagatcacctgagatcaggagttcaagaccagcctggccaacgtggtgaaacccatctctacaaaaataagctgggcatgatggcgggtgcctgtaatcccagctactcaggaggctgaggcgggagaatcacttgaacccgggagccagaggttgcagtgagccaagatcacgccattgcactccagcctgggcaacagagcaagactcaaaaaaaaaaaaaaaaaaaaaaaagaaaagaaaaaataaactgctttatattaaaagaaaaataatggtcataatctggccttaggggctatagcatcaatggtgaggcctagatcgcccaggtcactgggtgtgtattgacgttgtttacatgttttatttcttttatgctttttcccagagattgatttttttttctcccttatgtgattcaaaatatctgcttacacgttaaacccagctcagttggcataatgtctttttaaggcacaagccagcttcctgggtgtgagcagcttccacatcaaatgttcagtgggcaaatgaaacatgtgagtcacacaacacttggcacctctgtggcttttaatatttggtggcaaacttcctaccgcgaggagaaaattttcaaagtggaagtcctttcagatccagatggcaaaagaatttgttgggcgagggatcttgattcttaatgttgaggggactaggaatgtttgaattttctcccccttgtattttcccagcctggtaggcctccatgggggccaaatttagttgcgaatttgcccacttttgtgcagagtgaggctccatctatggaatgtgcttaaccataaggatcagaaaaatttctagtagctttgttaagtgcacagcaaacagaagacaaagtgtggccgggtgcggtggtttatgcctgtagtgcaagcacttagggaggcagagatgggaggattgttgagcccaggatttcaagacccagcctgggcaacatagcaagacccccttctccaggaaacggaaaaaaaaaaagagtttgaaaaaagtgtgtagactaactgaacacttgcaaggcaattttttttttttttgactgtctggagagcttgggttccatgaacacaatacagctcttgttccacgtgacttacaagttgggccccgggttttgttttcttggccgagatcttgaagactgtctccaagtaggtgtttcttccttggcagcaggtttggccagttatgtagtcagccctgtccttctctgaagggtgggtagttgagttgggggtatgagaggggtgacagtggatcatcttagctttttttctatttcacgtcattgttcatggatacaagtgcaggtttgtgacataggtaaacttttgtcatgggggtttgttgtacagattacgtcatcacccaggtattaagcccagtatccattagtttttttttttttttagttatttctcctgatcctctccctctttccacccttcactctccaaaaggccccagtgtgtttttcccccctctctgtgtccatgtgttctcattgtttagctcccacttataagtgagaacatgcagtatttggttttctattcctgagttagtttgcaaaggataatggcctccagctccatccatgtccctgcaaaggacgtgacctctttcttttttctggctgcatagtattctgtggtgtgtatgcgccatgttttctttatccagtccattattgatgggcatttacattgattctatgtctttgctattgtgaatagtgctgcagtgaacatacatatgcatttatctttatgatagaatgattgatattcttctgggcctatactcagtcatgagattgctggatcgaatggtatttctgtcttcaggtctttgaggaatcatcacactgtcttctataatggctgaactaatttacactcccaccaaccgtgtatataagtgttcccttttctccacaaccttgccagcatctgttactttttgactttttaataatagctattctgaccggtatgagacagtatctcattgtctcatgcaattttttttttttttttttttttttttgacagggtctcactctgtcgcccaggctggagtgcagtggcgcgatctagatcttggctcactgcaacctccgcttctgggttcaagctattcttctgcctcagcatccctagtagctgggattataggaatgtgccaccatgcttgtctaatttttgtatttttagtagagatggggtttcaccatcttggccaggctggtctcaaactcctgacctcaggtgatccgcctgccttggcctcccaaagtgctgggattacaagtgtgagccaccatgcctggtttatttcattttaaaatgcaatttttctgaaggtagtcattgtttttgcatgttttcttttcttcaaaacatttttcatttgttaatcaacattttataaggcttaatattaaaaaagaaccaaccccaccccacttctccccactctcatttcctacacccaagagcagccctggttttctttttctttctttctttcttttttttttttttttttttgagacagggtctctctttgttgtccaggctggaattgccgtggtgcgatcatggctcgctgcagccttgaccaggtataggaaatgagagcactgtgcccggctaattgttgtattttttgtagagatggcatctcaccatgttacccaggtggtctcgaactcctgggctcaagcaatcctcccgcctccgcctcccaaaaagctgggattacaggcatgagccattgtgcccagccagcccctggttttctaagtagcaggcttataccacttgtctttgatatttcagtgttaggtgttgacttactgatgtgttttatgagacatggatgaggattctggcctcagaaaaggctgcctacgcctctctctttctcagaatagtcacatttcacctgtaattccagtgctttggaaggccgagacaaaaggatcaccggaggccaggagctcttgactagcctcggcaacattgcaaaactctgtctctaccaaaataattaaaaataaaaaaattatccaggtgtggtggtgtgcacctgtaagtcccagctacatgggtagctggggtgggaggattgcttaagctggggaggtcaaggatgcagtgagctatgaccacacccctgtactccagcctgggtgacagagcgagagtctgtctcttagaaaataacaaataaatacatttttaaaagcatagtcatacttctctttttggctcaatcaattttcaaatatacagtgtttccatagctatgactttgtaaatattagtattctttgtacactacttaatgtatgcctaaactctcctccagcaacatagatctcttaaaatatggaaggccatcagtgaggtagggtttcatctttcttggtgacagcccttcttggcccccctattctgcccagctgggtctcccattcctcatcatctcgggggcttcctcccatctctctccagctttggatctcctgactcgtgtacgccatggctttgttcttcctggttaacctctcatttgctgcggggatgttctccgattgcttcctgatagatggtgaccatatctgcgatccgacaagatcttctttattctgtcctcaaatcccaggttggaaaacacttcctgcagaatgggaaagatttggctccccgttttctagcatccgtcaagggcgttctgcatttttgtcctttgttctaacaccttgtagagttgtctttttcttcttcttctcagatttcatgaacacgcaccttggcgtggttcttatggcctggtctctgttttctgtcttccagagttgcgttagtcagatgttgcactttgtggcctgatctgctaatttttcttacttttcatttgtctttcttctctcttttttttttttcttttgagacagcgtctcactctgtcacccaggccagagtgtggtggcaccatcatggctctctgcaacctccactgcttgggctcaagggatcctcctgcctcagcctccccagtagctaggactacaggtgcacaccaccacgcctggctaattttttaagtattttatagagatagggtctcactatgttgcccggactggccttgaactcctggtctcaagcagtcctcccaccttggcctcccaaagtgctgtgattacaggcgtgagccaccgcacccagccttacctttcactttcatgcctctgtcttttttgatgtgttttctgcaggaatttctcaaccttccagtctttctaaacttttatgcatcttattttagatttccaagttttcttattctttgaacatttttatggtctgttctttcatggaagcatcatcttttatattcctggctacattcatcacagttttttaaaaagtttttggccaggcaaggtggctcatgcctgtaatcccagcactttgggaggccaaggtgggctgattgcttgagcccaggagtttgagaccaacctgggcaacatggcaaaaccctgtctctactaaaaagacaacaattagctgggcatcgtggcacacacctgtagtcccagctacttgggtagccgaggtgggaggatggcttgaacactgaaggtggaggttgcagtgagccgagatcacaccactgtactccagcctgggcgacagagcaagaacctgttgcaacaaataaaaaaattttaaaaaagttttcttctgttctctgcgttggaattttttttttttttttttttttttttgagatgaggtttcactcttgttgcccatgctggagtgcaatggagtgatcttggttcactgcaacctccacctcctgggttcaagcatttctcctgtctctgcctcccaagtagctgggattataggcacatgccaccatgcctggctagttttttgtatttttagtagggacagggtttcatcatgttgcccaggctggtcttgaactcctgacctcaggtgatccacctgcctcgtcctcccaaagtgctgggattacaggcatgagccactgtgcttggcctctgcattgaattcttactgtctttactttgtaaaatgttttttaaaaatatataaacagttgcataccatgcattttggttgcaaaatataatacagtgaacacccaggaaccctccacccaaccctaagaatcagagctttgccagtcaattgcatccacctgtatattcctcccacctcctattccctgccccctctctgggacaggtgacccatcctaagtagtgtatttattatgctcttgcctaaaataatgtattttctgcacccatgaatagatgcttaagtagtatatgattactcttccctgagtttgagctctataaaaatggtattattctgcaatagacttgcaggatttgccttttgaacttgagttactgcaacattatctgtgaggttgtctgttataactgtggtccatttattttctctgatgcttaaacccagttgtgcggctagacccaaatttctttagcctttgtcctgtcgctttgtctgttttcctcgtttccctctttgttttggtcccagttagaggtttcctcaaatgcctagtgacgtgttgttgtttgttcatatatcagagcatggcaatagaaagggtgtgtgtgtgtgtgtgtgtgtgtgtgtgtgtgtgtgtcggggtaaagagcagttttggtggcccccaccgtaagtaattaacccaggtgtctagttgcggggagcccccaggcatgggtatcagtggctcattctcttggactggtcagtttctctagcaaggagccctcagtgttcctgctgggtggtgcagttgggaactgttagtctgaccacctgtcttctaggcaccaggctggggcatgtgctgggatattcactcagccccctgcccatggtcatgagaaaccccagtcttctgcccacagtgcaggagggacctgaccgcagtggcattttgcacacctgcccggcctccaagtcctgcagctcgaatgagcttgcttgctgcaggcggcctgctccatcttgaggcttgtctggaaaggcggcttcggctttccagtgctttccagcgctttccagcttctgagattttgggggcttttcatttgttcttgctttcctgtcctctttgtcaggtgagtttatacctttctgttccaaagcaaacaggatcgtctgccatgttgaactggatgtcggacaattctgaaatgtgtgcatggggcaaggctgtgtgtgatgataccagtttcataggaaacacttcggttttggttttgtctttcaaagtcatcttttgtgagcgccttctagccgggctgccagcgggtaacatatgattaacacaagtttggagtctgtctgcagagcaactttatgaaatgctcagaaagccagtctcctaagcataggagcctgtttggtggtgatgggatgaggaagcagtgggggctttggcaccagaggcctgggctcaaatcctgcctccatcatttaggggttgggcatctccattcccttatctctgggtggcgagaacttcctaagttcttagtgtttggaagggaccccctccataaagtgaggtgcctcttggccactgctcagccagtgggggctgttcctaacagttgcctcctccgattgctggagtaagaaatgacaccctgtctcccatttctgtggcaccccattctcaacagtgatggttctgcctgtttttagtcacacacacctgcacacttcaaaggactaaaaatggactcagttttctttctttttttttctttttgagatgaagtctcactctatcacccaggctggagtgcagtggcatcatcttggctcactgcaacctccgcctcctgggttcaagcgattcttgtgcctcagcctcccaagtagctgggactacaggcatgtgccaccacacccagctaattttgtatttttagtagaggtggggtttcaccaggctggtctcaaactcctgacctcaagtgatcctcccacctcagcctcccgaagtgctgggatgacaggtgtgagccacctcgcccggcctggactcaatttggattgcaatgccccacaatggtgacctccctcttctctgttaatgcatcctcttccctcttgcttaaaaatttccccagtgccgtggcatcttacctcctgctgaagtgtgtgctgatgctttgctgggggctggaccccgtcccttggagcctggcccaggccctgcctcccagtgaaaccctggccgcctttccaacctcagaggctctatctcctcccaaaccctgtagcccttccagttgctggtcactgacttccattaattggcccggtggccttgcctgccagggggaccatgaggtgaggggccgtgtcctccgagtggtctctttctccagggtgctggggacccaagaaatgcctggtcgtttctcataggttgataaggaaaatgaggcctaggtagggacaggcaggatttcacctgaatttacaagatgatgcaatggaagagtcttcagtatattttcacgtattttagaattgagttacaacattcattttggtactttctctgtgttctccccatgtgttaaaaagcagcttaaggccgggcgcggtggctcatgcctgtaatcccagcactttgggaggtcaaggcgggtggatcacgaggtcaggaattccagaccagcctggccaacatggtgaaaccccgtctctactaaaaatacaaaaattagctgggcgcagtggcagacgcctgtaatcccagctactcgggaggctgaggcaggggaatcgcttgaacccgagaggcggaggttgcagtgagccaagattgtgccattgcactccagcctgggcggtagaaggagtttccagctcaaaaaaaaaaaaaaaaatgcagcttaagtgctggtttagcgcctgtaatcccagcacgttgggaggctgaggcgggaggatcacttgagcccaggagtttgtgactagcctgggcaacatagcaagaacccgtctgtacaaaaaataagaaaaattggccaggtgtggtggcgtgcatctgtagtctcagctccttgggggctgaggctgaaggatcgcttgagtccagcaggaggtcaaggctgcagtgagctatgatcaagccattgcactccagtctgggtgacagagtgagaccctgtctcaaaaaaaaaaaaaaaaaaaaaaaaggaaacaagaaagaaaaaagcagctaaattctgctggaagtgtgcagtaaagcacaagttttcagccatcaacgcagggagccgttaatcacgacccataataaccagaatgttattccacggttgcggtttgtttatttcatcagagttgcgtcttcacctatttccctccctactcttaattgtttatccaagttagtgttttccattctttcactgaaggctctaaaaatggtcccatcaagaagtctggtagataatggaagacgaagtggactttacagaaagatgaattttcttccctagagctggaaaacccttcagcgtgtcatgcgttccccagccaggacagacaaagccacgcaatctgtttcctgcaggcccagaggggaaggcttcctccttgtggttagtgacttcaaaagctgtcctcactagagcaagtccaactcttcctctagttctgatgacttcacggcagccaactgagctgctgaacgctgtttttttctacgcagaaaccctcccgactttcacgaggagttgacaggttttcctcttcactcgggctcccttgtcatcgttaaactgaaactgctttcttgtagccaaattctgtggtcccttttcggcctcggcctccttgacctctctgtgtccccaccttggctctcccacgcctgccagccgtaccacaggccccgggtgtgaaccctccctccgcggtcatgcagccacgcctctgctcaagctgtgcctcctcctgggcgcaccctccctctcccatccttcagcctctgaagtcctgcccagctccggttcctgtttctgttaggacgaggcccttcagatcctctccagcaggtggactctgtcctgccccgtaccacccgccgcgggccacttttgggcctgcgccatgttcctgcccttaccccgcccggtgttagcgtcacgtgggtcctgatgtcctccctctcccaggcctctgcttatctgattgggggctgtgcttgactctgaaacccgggcacctcctacagggcattttgcctgtcacaggcctagcattcaatacctatcatatttttgaaatatctgcagaaataaaaagaaataactattttcttcttcaggagttaagatgcgtggccaccaagtacttttcaatacataaaatatgttttcagcacagaaaggcctttcaccgctcttacttacatagtctgcttttggtatgatggggacggatgaaaaatgaggactgtaggcctccgaagtcagctgttttgaattaaagcagcgcacgctttgagtcaggtgaagcgaggatggggtttcacccgttgaggatgaatttgctgggttactttaaactggaactgttcttttcagaaatgagtgaagcaggaagggaaagacggagcttgtctggctgggtcggatgaccccctttgccaggccgtcacccctctaggttgagttagctcagaataacttagctgtgctatagctttgcataattgcaaggagctttgtttcgttttattttgcagggaatttttttccccccttagctcttcctcctggtgtatttgtagaaatcagcttcatcatggtcatttaacagtaagggctgggggtggtggctcacgcctgtaatcccagcactttgggaggccgaagtgggaggatcacttgaggtcaggagttcaagaccagcctggccaacatggtgaaaccccgtctctactaaaaatacaaaaattagccgaatgtggtggcacgcacctgtactcccagctcctcgggaggctgaggcaggagaatcacttgaacccaggaggcggaggttacagtgagccaagatggtgccactgcactccaacctgggcaacagagcgagactctgtctcaaaaaaagagaaaacagaacatactatttttgttgtttctgaggagtagggtttcttaccagggaacctgctttaaaaaaatgcagtatgtagattccttaagaataaagttaagcagcagctaaccaagcacatggctaaaaacccggccaagagcattgtagtatctggttttggggttggtggtggggatcccattttagaggccgactttggtttgtgatggttaggttttactttcttaggtctcagctcacatgtccccttctcagaggagccatcctcacccatcccttcttggtccctcccgccttccctgactttttcttcttcaatgacttatctgcacatgatcccctacttataaaacctgtgtcttccactcctctcacccgaaagaatgtttgaattctgaaaacaatgactttgttcttagcacccacaacagcaaatgctcagtgagccctatgttgagtgagttagttgtgagctgtggtggtttagtgagggtatactttggcccttagaatgcgaatgccttttttttttttttttttttttgagatggcgtcttgctctgtggcccaggctggagtgcagtggcacgatcttagctcactgcaacctccgcctcccaggttcgagagattctcctgcttcagcctcctgagtagctgggattacacacactcgctaccatgctcggctaatttttatatttttagtagagactaggtttcgccatgttggccaggctggactcaaactcctgacctcaggtgatccgcttccctcggtctcccagggaatggctgtttaatcacaagaaagtcttcccttcatgcgttgtgaaaaccagcagtattttaattgaagaaatccggtattgtttggctttctagatttggaagtaggtcaggtggctaatgattgaaaatggaccggcaaccagagggcctttggaaactctagctcgacttcaggctatagttttgtttatgcccttgtcactaaaggcactgcccatgagagctgggtttgcagtccctgctgagcctggggttgagagcagagccctagagtaactcagcaaaggcatccctccctgcacctgagctgggggagaggcggcttatgattaactcagcgatgtctcaaatgccatttctagaggctgaacacattaacttttaaaaaatgatttaaaaattaccaattgaccgtatccggggctgaacctgcgtgattcagcttcttttaaaaatatcttttctcaacaaattgcttccttaacattttaatttgttgatcatcaaggaagcttgccaaatattagctgttcttttccatttcctaccgcctcaagcttcccgtatttggcctatttcagtggagctgtaaggtcactccctatttttcttcccaaataactgtatttattactgtcaggtattggcgggtttgatccagctgtcatcagaacgtttggaaataccgttttttgccagaatgctgatttaatgatctcatactgacatggcttgttctctctgcagacttgataacttgttgaatatgttccctcttcttattgagcaatggtgctttttgaaaatttttcccagccagaaggcttcatgggtagtatctttaagatcctagcagaaggttgcttttctctctctctctctctcagtcctttctttttctcttttctttgcttctttccttctttcctttttctttcttttctttcttctctttctttctcttttcttggcttatttccttctttcctttgtctttctttgctccttccttccttccttttcttccttcccctttctttttccttccctccctccctccctaccttcctcccttccttccttcctctctctttctgtctctctgtctctgcctgctttttcctctctctctctgtctctccccccttctcccctctcctatcctcttcttccttttttctttttttggaaggcccagattagtagcagagactctccttgaaggggatagatgcattgtcgctgtttggtattttgaacagattcttaagaaaatgttttcctggtggaagatttcagacacacatgaggtgagaataatgaaccctgtgtgctgcccccagcatgatcagttccaaactattggcctgtctagtttcatctccgcccctgcctactcctggaattttgaaaaggacatcatattattttctccataaatatttcagtatgtatctctaaaagataatgtcacttcgaaaaaaatacctaataccacgatcacacctaaaacataaatgaacaatatgaaggatgagtttctgctgtgtggcatggcagaatgatgctctgtggggtcccaggggagaggtgagctaagttcagtgtgtcacctgctgtcacctgccatcacctgtcccagggcctggggctagccactgctcttttgtgagcctcagtttcttcatctataaaactagaggattgtactagtctgtctgtctttccttcctttcctccctttcctgtcctgtcctgtcctttcctttcctttatcctctctctcttttatctccccttcctcccttccttccttccttccttccttccttccttccttccttccttccttccctccttcccctctcttcttctctctttcctttttttaaagagacagagtcttgttgtgtcacccaggctggagtgcagtggtgcagccatagctcactgcagccttgacctggtagtctcaagtgatcctcccacctcagcctgtgaggttccgggaacacaggtgggcaacaccatgcctggctaatttttaaattttttgtagagacaggctagtcttgaactggcctcaagcgatcctcttgcctcaggcccccaaagtgccgggtttataggctgagccactgcacccggcctgcactagttttttttgtctctagaaatctgcatctctgaatgtgttaggtcctgacctgctttagaacggatctcagccaccctgctccttcgaacccacatttctgccccgtgtctgctggtcgcaggaattggcacattttcctttagctgcgcccaccagtccttgcacgcatactcctggtcacttttttaatgtctggcagatggtttcaagtgcaatggcgtctctgcgtaatagttgattctctaaagaacagagtctactaagtggaagctgcgtttccacatttagcagttagctgttaagagccagtaacaggtgcaaatttgcaacccgttttttccccaatcttttggaatggaaatggttcagtcatttgaatttaacaaactgcctgcccggcatgcactgcagatgctgggctgcaaagctggttttggtgctggttggccccctgggtgcccctgtctactgagggtgggacaggcggaggactgggggctcagtgctgcagaggcacatgtagggtggggtggggtggggtggagaagaagtcctgaccagtcctgatttggtggtgctggtgcttatgggctagtgagatttctgcatgcccaggctggctggtagccatgtgtcagtcactcataatcccagtaccagagttatcatcacccctaacttttttttttttttgagacggagcctcactctgtggcccaggctggagtgcggtggcacgatctcggcttactgcaacctccacctcccggagtctccctctgtggcccaggctggagtgcagtggcacaatctcggctcactacaacctccacctcccgggttcaagcgattctcctgcctcagcctcccacgtagctgggattacaggcgcctgccaccatgcccggcaaatttttatatttttaatagagatggggtttcaccatgttggccaggctggtctcaaactcctgacctcatatgattcgcccaccttggcctcccaaagtgttggggttacaggcatgagccactgtgcccggccacccctaatgttttgatttatttcctttgaatttttttttctctgaataaatggattgatgatatctattgacatagtcagaaactcaagaaacatctatggagcatctagccatggagcagacactcctgttggtctcgggggtgtgtggcgggaaggtcagagtccttctagtcctccaagagcttccagtctggtgggtccctagaatataatacattgtgtgttgtcgtaggcgggacttgcacgctgtgcagttggctttacggttgacaccaggccaccagtggcctcctccgcctgcccttccagcctgcggttgtccttcagctgctgcctgtgaaatgtgatcctttccataagtccccagcacagagactgggaaggcagtttctaagaaggcccttctgttgggctggctcagaacctgccccctttcctctgacttgcctataaaaaggtgggtttttcctcctgcctataaaaaggtgggatttcacactgacataatttacatcgagggacatattaaacctggtgtaatttgcaagtgtgccctgaacacgtttcatcatcaggctcgttgtggagaccacggtgtccctttccttcccatcgtaagtccccggtgtgtgtgtgtgtgtggaaagtttagagctcccaaagtttagagctcagagaggataaagacccgtattactaaacttatcaggaaaatgtggcttcagattattttttttcacagcaataattgcatttcatgtattttttttttttacttattacagaaaatttcaaatatatacccaaacagaagaagatcatgaatgcttttgtgtccatgactcagcttcaataataattatttacttgtcgctggccttgtcttatctgtaactttctcatcgctcacccgacttaaattttgaaacaaatcccagacatcatatcttttgccatccacagatacatcagtgtgtatctctaaaagagaaggactttgcaaaaagtacaaccacaataccattagcacaccctcgaaaaatgacaaagattcatcaatatcagctatccaatatcaaactgccactttcccacaaatgtcataattaaaaaaaaatttgtttcaatcagaacaagaaaatccaagtgagattcaagagtcccgctgggactggttcatgtgtctttgtcttttgagagttcttttttttttttttcttcttttttttttgagatggagtctccttctgtcgcccaggctggagtgcagtggcatgatcttggctcactgcaacctctgcctcttgagttaaagcgattctcctgcctcagcctcccgagtagctgggattataggcatgtgccaccatacccagctaatttttatatttttagtagagacgaggtttcgccatgttggccaggcttgtctcaaactcctggccttaagtgatccacccgcctcggcctcccacagtgtggggattacaggtgtgagccactgcgcccagccagggctctttttatattgcaaaactgaaactctgcacccattaaacaataacactccatttcttccccaccatgccctggcaaccatgattccactttgtctctatgcctttgaccactctaggtccctcgtctaagtggaatcatacagtattgtctttctgtgactggctcagttcacttagcacagtgtcaaagttcctccatgtcgtagcttgtgtcagaatttcctttctttctaaggctgaacaatattccgtggtgtgtgtataccccattttgtgtattcattcatcaatcagtggatgcttgcgttgcttctaccatttggctgtggtgacactgtgtgaactctggtgtgtatatatctcttcaagacccagttttcgtttcttttgagtttatacccaaaagtggaattctgtttgggttgcaccattttaaattcccaccaatggtgcacaagggttccaatttctccacagcctcgccagcatttgtcattttctggattgtttttttttttttggagacaggatctcactgtgttgcccaggctggagtgcagtggcacaatcatggctcactggatccttgacctcctaggctcaatcaatccatccacctcagcctcctgagtagctgggactataggtgtgcaccaccacaccccgctaatttttatatttttttgtagagatggcgtcttgctgtgttgcccaggttggtcttgaactcctgagctcaagcgatcctgctgccttggtctcccaaagtgctggggttataggggtgagccaccatgcctagcctggatttttttcttttttaatggtagacatcttagtgggtttaaggtggtatctcattgtggttttgatttgcatttccctaatagatagttatttttatttttatttaaagggagtctcgctctgtcgcccaggctggggtgcaggggtgctatcttggctcactgcaacctctgcctcctaggttcaagcaattctcctgtctcagcctcccgagtagctgggactacaggcgcacaccaccatgcccagctaatttttatatttttagtagagatgaggtttcaccatattggtcagactggtctcgaactcctgacctcaggtgatccacctgccttggcctcccaaagggctgggattacaggcatgagccactgtgcccagcctaatagatagttatttttaatacttatttaagcttcatgtttcaactgggggtgcttcatgatatattaatatttaatgagccaccttaattatttctaaaaaagtaaaaaagggaaatactatctcccacatggtattattcatgatgtatatcttttttttaaatgttttgtagaatcggaccaaaatcagaccaatcctctcagtttatcacaaagataccaaaacccagagagaatgaggctttgccttagcctcggccctgggagatagaagaggagcctggggcctgggttccccctgccgtggctgcccagtccttccgctgacaccatttcgaggtccccttgtggaacttctgtgggaggccaggtgcacaaagtccggtttgttgagctacagatgcccgccagcagttgctgttattatagactggttgttctgatttgtcaagaaacccagaacaactgtttttcttctttgcagtggatgtgtgtgcacatgaccttttgagaacatatttcctgatgtggtggaggcactgatgttcgtgcagactagctaagttaaatcttcatttctttcagctgaaattgcctggctgctcctttaagaagtgcactgtgtggagttatcatgtttctcatgctgttaaatgtttactggcaatcctgtctactttagcgtattgttgtcaaatgacaagggagtcccctgtcagagagcaatgacacagcctgtacttttgggggcagccagcgtccgagcgtttccacattcattcttacgcagttggtaggctcaggatgtttgtgaacgccgaagggtgtgcgtgcaccctggagtgtggagatactagcatgctatttaatgatggccaccacgggacgtgcgcactcattcattaagctaacgttttatggtttgttgagtgaaagcaggcacaatggtaggtagtgggtactggagcaaatgactgcaccggccctcatgggacttccatttcagtggattcaggggaaagcagcacgtgtttttgagagaccttggcaacgcaggcgaccttgacgtcgaccaaaagaagagagatttggaatgcttgttttacagcctccggtcaaaaaaaatcatatgggaccctttattgcagactggaacatttatttcaaggtctcaaattaaactagaggaggccaggcatggtggctcacacctgtaatcccagcatgttgggaggctgaggtgggaggattgcttgagcccaggaatttgagacctgtttgggcaacatagtgagaccccaatctctactaaaaaaataaaaattaggctgggcatggtggctcacgcctgtaattgctgcactttgggaggctgaggtgggtggatcacttgaggccaggggttcgagaccagcttggccaacatggcgacaccccatctctacttaaaaaaaaaacaaaacaaaaattagctgagtgtggtagtgcacgcctgtatttccagctacttgggaggctgaggaactagaatctcgaacctgggaggtaaaggttgcggtgagccgggattgcaccactgcactccagcctgggtgactgagtgagacgctgtctcaacaagaacaaaaactaaccagttgtggtagcacttgcctgtagtaccagctatttgggaggctgaggtgggaggatcacttgagcacaggagttggaggctgcagtgagtcatgatcataccgtggcattccagcctgggtgacagagcaagaccctgtctcttaaaaaaaagttaaactagagtagataaatgagcaggcatagttgtttgctgatcattcaccgttgagacaatgaacagctcgttaaataaattgttggtaacaatgaaatcaggagaatttcaatcctgagtcagtgtacacaatacaaggcacaaaacgttgagttaaaggtggttctactttgccctctaagcattttattgacttcaaaacctacaaaggcggcgccatggcatataggaatataggaataaggcatataggaataagaagtttcaaaaagtttcataaaagttgtatttggggctgggcatggtggctcacgcctgtaatccctgcgctttgggaggccaaggtgggtggatcacttgaggtcaggagttcgagaccagcctggccaacatggcgaaacgccatctctactaaaaatacaaaaactagccgggcgtggtggtgcctgtaatcccacctacccgggaggctgaggcaggagaatggcttgaacctcggaggcggaggctgcagtgagctgagattgtgccactgcactccagcctgggagacagagcaagactctgtcttgaaaaaatagaagtaaaaaaagagagagagaaaagcaaattacctgaaatccagaaagatcagagaagggaaggaatggctggagtaagtgttgatcagcggacacactcaagggtttcgtaatgtgctcgccctgccccaggcatcaagggaggtgctcactctgtgcactctgaatcccaccaggggcccacctgccaccctgttctcacctgtgaccactcacggcagccacaagaggcacaggtgttaggtctgccccagccacaacacctcagcacgtggtgtgtggcttcaaccaggtcaccgtgggcacactgggaggggagggcttctgtgcggccacgcttaataaacagtctgcctgggaaactgagcatccaaagtgccctctgaaggagcgggatgctgctgcccgtggtggctccgtcacacgcattctggaaggtacctcccggtaagcaacctgatgtttcatctgtcactgttgatgcatctccatgttagagaattaagcatatggaagcaaaacacctcaggaatacagaacgcattcatgatcaccacggaaaatcaaatcaactcaaagtccaaatgcaactttttttttttttctgagacagggtcttgctgtgttgcccaggctggagtgcagtggcacgatctcagctcttagtagagatggggtttcaccatgttggccaggctggtcttgaactcctgacttcaagtgatctgcccgccttggcctcctaaagtgctgggattacaagtatgagccactgtgcctggcctctcttttttaaaaaaaatagagatgaggtctcgctatgttacccaggctggtctcaaactcccggcctcaagcgatcctcttgccttcacctcccaaagtgctttgattacaggcgagcttttctctttttaagccaacttgtgagtagaatcattcacttgtgcctttagctgttgtctctgtgttgaggaatccagagtccagtccttctagacttatctggggacccgagtttccttctgtagagttaaaacctgttgcatccatccccagtccctttacggcacctgtgtaggcctgtagtggagctggcttttgtcctttgctgtccctggctgagccttggcctcatcttgggccagcgcctcctcccctgggctgctgtgatgtgttggcatttcctgggtagagtcttgtacttgctgttttctcctgtctcagtcttttcccccagggacctggcatgtctgtgtgttggggaccctttgctcatcttacacactgaggacaggcaccttagcgcttggtgccctgggatggaacagccactggacagccagccctgtgccctgtgtccactgcaaacctgatcctgttttttggagcccttcacttggcaatgagaccttcatgggtggggttactgaagcaggagttggtttaagttaaataccatcagccgcaaagctcagaatggatgatgaagtgctttaggggttgacagggcagagctggctgtagggagtgatggagagaggctcccaggaggggaaccctctgacgtgggagttaaaggactggggccatttgtcgtggggggatgggagcagtggcttgggaagggacagaacgggagcaagagggccttgcgcactgatgcttttgaggactgaatctgaacgggagagtggggagagggctggaaacctgggcgagaacaggagaggagaggcccctggatgccagcagagctgtaggcatgatctgggccatgccctgggagacgcttccgcaggagatggtgcggctggggtggagacttcctggcttccgagggcgggcgagggggcaaagggcctggggcatggacttgggcaggtagcaaaggccagaaggagtgggagtcattccacctgggatgtgggaatggctggtgggggcaggtagggggagaccaggatgagccccatgtgcgcgtgacctgtggcagaggggctgtgtcagagccccggctggcgagaggagcatcactgtgtccagaggacgcggtgcctttcagaccccttgagtaagagacagagtgggtctgtcctgtctaggctgagttttcattgcccagcacagtgcctggcacacagtaggtgcttaataaacacgtggactgaacacaagaggttgaggggaaaggtcggaattggccacaggtctcctaatgcctggcatgtgcgtcaacgcatctctgaggatggaatttaaaggcaagagctggaggcccagggctgaggctgtggggtgagcacagcatttgcggggcgcgggaagggagtggctggtggggcgggggagggaaaccagcacgttagaaggtcagccaaggtcaggcggccagcagggcgggaggaggcgttggtgtgcacacgcggggagcctccgtgtcctcaggacaccatggaagacggcaggacacacgtgcgagccacagcaggtgggcgggagctcacaggctgcagaggaagcgcaggggaggcgcaggggaggccaggctctggcatttcccaggaatgtaaaccccggtttcagctttccccgtggctcccctccgccaaatcttaaatcctcttgttaagacgcgctccgcccctgtgtccttatttcccaccgtggtgggcagcttgtctgccatccccttccaggtgccccgcagaaccaccacccttgggaaggcggctcctcgtgccccccctcttgtgccttccctccccagtgccttttctgaccccctcctgagaccgcctccctgtgggccatttgagcacctgtagctttccatccggtgtcttcacccctttgctctttgtagctgtctcaccccgctgcagcttgtgaggccatgcaggccctgatgtttagtgttttttttgtttttttttttttttttaaagacagcatctccctttgtcacccagaccgttgtacagtggcaccatcctagctcactgcagcctcaaccttctgggcataagcaatcctcccacctcagactcctgagtatctaggactacaggctcttgcacccaccacaccgggctaatttttgtattttgttgttgttgttgttttgtggagacagtgtttcaccatgttgctcagtctggtttcgaactcctggcctcaagcaattcacccgccttggcctcttaagtaccgggattacaggcatgagacattccctaatgtttagttttaaagagggggtggtgctatttatctccaggctcaaagcagggcattctttccttaggatctgcgatactccagtcaaggctgtttcttttctgccttttgtaaaactcttgtctagaaattaatggatgagggaagctagggactcttctcagattatttcttgtgaaaacctcaagagtctgaatttacagggaaatcttacaattagctcgatgtggattacagagcggcaaacaaccttaagtggtagagctggttctgcaagatttttccaaccctttgtggtctagttttcatttttccccttttaaagttgttttcagctaaagctgtgaggacagtatagagttttgccttgtaaaattggtagtgagtaattttagaatagatgcttatgaagtctgtaaataaatagtaaggcgcctcgcctagttccacgcacatgtcagtttcgtaactatctccccaagctgagctcacctgccagtgccttggatggacctagccaccaggggctgcagatgagtaggagagcgggtgttgcccagagcagggcggacacccctgttccctgtcatgttttcttctcaaaacctgctgcaggccattggagagcattcctgttgctctctgcacccctctttctgaagcattttactgtgtgatcctagcatccgtggttcaggagatcctgctacattttcctgactgccttgctctgcccgggaatacctggcttatcagcagaatacaggcctctgcttaactgaatttggtcctgtagtgaggactaagaagtgatgtactcagttacatgataattctaaaaaataaaaaaaagcctttttttttttttgttaacacccatcatagtggcagaatcttaagtctgcatgtagagggggttggcagggcagtagaagcagggggccctgtgtcctgttggtagaagagtgagcagaatggccactggagagccacttggtggaggtgcctgcagcacagcgagcagcctccttcccagatgaagcatgcatcttagaggcgaccttgggcacgtgcacagtgagacaggtacaggagtgtctgttgtcatatattccatgggagtgcaagagccggaaggatgcagatgtgcatgggtggtgctggcccccatcaggtggcatctagtagaagtaagtaagggtggtggtggcatgtgtggtcaccttgccagcgtcgcctcgcacaggaaagggctgttgaaaatttgtgggccgggtgccgtggctctcgcctgtaatcccagttctttgggaggccaaggcgggtggatcacctgaggtcaggagttcaagaccaccctggccaagttggtgaaaccccgtctctactaaaaattaaaaaattgactgggcatggcagtgtgtgcctgtaatcccagctacttgggaggctgaggcaggagaatcgcttgaaccccggaagtggaggttgcagtgagccaagattgcaccactgcactccagccttggcgacagagcgagactccatccccccaaaaaaaaaaaaagaaaagaaagttgtgtgcagcgtgattctgtgagttcaagatgcaaagcaatgactttacattattaaagatctagcagacatagaaggatattttatttatttgtttatttatttttgagacagagtctctctctgttgcccagtttggagtgcagtggcatgatcttggctcactgcaacctctgcctcttgggttcaagtgattctcatgctgcagtctcccgagtagctgggattacaggcgcccatcaccacgcccggctaatttttgtatttttagtagagacggggtttcaccatgttggccaggttggtcttgaattcctgacctcaaatgatccacccaccttggcctcccaaagtgttgggattacaggcatgagccaccgcgcccggcccatagaaggatttttttggggggaaagaatctgtaaagtgattattttggaggtggagaggagaaaatgagactaaagaagatagagtgggggcttctatgattttttttttttttttaaatagatatgacaaaatgataaaatttggtaaagctatgtgttaggtacataggaatttatacttttctgtatgcgtgaaatattacgaaaaaataaagccacatacactatctgtttttgtgtgtgtatgtgtcaataggatttaggccttttttgcacttctaggttaaagttttcaagatgagggtattttttccccctctctgttagagaatactaaagttatgttggttttattttttattttatttatttacttagtttttacaatgtaccattttaatcatttgggtatcctttttaaaatctctgagcttttttattttttattttttttgagacggagtctcgctctgtcacccgggctggagtgcagtggcccgatctcagctcgctgcaacctccgcctcccaggttcaagtgattctcctgcctcagcctcccgagtagctgggattacaggcatgcactgtcatggccagttaatttttgtatttttagtagagacggggtttcaccatgttggccaggatggtcttgatctcctgaccttgtgatcctcccatctaggtctcccaaagtgctaggattacaggcgtgagccaccgcgcctggcctcagcttcttttttttttttttttttttaatttttattttaagttccatagtacatgtgcaggatgtacaggtttgttacataggtaaacgtgtgtaccatggtggtttgctgcacctaggtattaagcccagcatgcattagctatttttcctaatgctatccctccccccaccccatatgttttattttattttttatagagacagggcctcactatgttgcccaggctgatctcaaattcctggcctaaagcgatcctcccacctcagcctcccaaaatgttgggattaccaagtgtgagccaccatgcctggtattatgttggctttaattatatttgtggaagaacttctatgttctctttccttattttaaatattgggagatagatgaaacattttaggtttctctacatttgaagaagaggtatattttcttaggttcttctttttgtgagacagagtgcagtggcacgatcttggctcactgcaacctccacttcccgagttcaagcgattctcctgcctcagcctccggagtagctgggattacaggcgtgcactaccacactcggctaattttttgtatttttagtagagacagggttttgccatattggtcaggttggtctcgaactcctggcctcaggtgatccgcctgcctcagcctcccaaagtgctgggaatacaggcatgagctaccgcgtcctgccaggttctccttttgatagaataatataggtacttgcctctgtttctattcagtatcagtgaattatctacaggaaaatgaacacaggaagactgctgaagtaaagaggcccacagtgcctgcattcccttgcctcatgtagtcttagactattcaggatgctttgaaaagagtaaactgtaaatcatatttcatattctttgggccaggagtctggaatggtttcatattgcctgtgaaacaagagatgcttctcagaatgagatttctggcttaattgaattcggattattgcaggcaggatgggagtgaaatggtacattcctttcatgccagttgtggagaggatctccgtgcaggccgttgatagaataatatcctgtgcttccttggtgtctctctctgaggaaataagggcttaatatgtcctattcaattaatcctcaccgcatccttaaaggtgactggaaggcagatagtattaactccattttacttaaaaagcagcggaaacatggtgatttggaactccctgggagccctcgaacttttctctaaactccaccggtagctgaggagcaggacacacgcacagaggaaggacatatttatggcgcatcgccttggtgccaggcaccgttgggaactttttaggatcgtgatgtctttgaattctcaggacgtttctgcgaggtggtgggcggtatcatcctggtttttcagggagaagtcaagtcactggcccaggtcctcaagctggccagtgtggcccggtctgaccccgaggttctgcccgggtttctgtccctccagcctggcatcgtgaactcaggggaaacagatggggaatctgttgttgtaacaaagattctaaggatttgaagcaaaatcaacacactcagttgtagagggtaccacgtggttgataccattgaagacaattgcacctaaatgaaataatttgatggcgtggagtccagtttcagagcgtttgcatcacaccttctgacaccaggctggggggccgcctgtcccagagcatcgaggacagacaccgctgctgttagacctcattccacccctttagtggggacccaccgcgcgctggccgcaagcctattttaatttgtaacaattctgcttgatgacaggaagacgtcaaaaaggagaaatcaggctaactggggctccttgtccacttggggggcatgtctcagtgtcttgcctggggccttgtacacaccctctcttaccgggagtaaagtgaggtttagaaagattacctttgtcctgggtcattcttccttaaatcacagctaggatgcaaacccagacctctctgatgtcagtttgcaagctctttcaggtaccgtcagccacatgccaggccttcagtggggtgatgttttttgttgtttttagaaaatactgctattcactcatgggaaatagggacgagggcttagatttcagctgctttgcattagacaatgatttctcttattataagcagagctctctattaaccaaaaacacttggctgttagacatggtgtttaattgctgttagaatgtatttttgtcacactgccctataataagccaaagaactgtttgtgccaaacagtgaagggaagctaggggaggatgaaaactgtgcctgctactccacctcccttctttcgaggtcgtggtgttttgtttgctgttttagctgtggtgtgtgtgtaccactcgtacctttcacaggaggacacctcatctgaataccagtcaggacctgagacgcgttgagcccctccccacagtgcccacgggtaggtgcgccgctctctgccccttccgggagctctgctttttctacctttagagatttctttcatcctctattacgtaggcctgactttttgcctaataaaggaaaaacaaccatctatttagcactctttttttttttcccaaaatggaaatgactttctctctgatttttacaaagcaaaaaatgagagtaaagattaagaaactacaagaaattatggtgaagggagtaaagatggccatgaatcctatgactgccgatggtttggtcccaggatgcattattcagatattttctccctgtgggcttatgtaaacagaaagctaggtgagtggaagtaacacgtcaaatactgatttgtggctgggtgcggtggctcacgcctgtaatcccagcactttgggaggccgaagtgggtggatcacctgaggccaggagttcgagactagcctggccaacatggcgaaaccccatctctactaaaaataaaaaattaaccaggtgtggtggcacacgcttgtagtcccagctactctggaggctgaggcaggagagtcgcttgatcctaggaggcggaggttgcagtgagccgagatggtgccactgcgttccagcctgggcgacagattaaaaaaaaaacaaaaaaaaaacctgatttgcaacaattttgtgtcctagcctagagtttaccgtgctattgaaaatatctttcggctgggcgcgctggctcatgcctgtaatcccagcagtttgggaggccaaggcaggcggatcacgagatcaggagatcgagaccatcctggccaacatggtgaaaccctgtctccactaaaatagaaaaaattagccaggcgtggtggcacgcacctgtagtcccagctactcaggaggctgaggcaggggaatcgtttgaacctgggaggtggaggttgcagtgagttgagatcgggccactgtgctctgacctggcaacatagcaaaactccgtctaaaaaaaaaaagaaaaatgaaaaagaaaatatctttcaatgatagttaatatatatatacacacacacactgtatttgaagtgacatgttacatggttttccactatatgatttctcatatttcatcaaattgatcctcttgaactcctgacctcaagtgatctgcctgcctcggcctcccaaagtgctgagattccaggcgtgagccaccgcacccggcctctgatctttttttcatctttttcctagtttctgacctcactaccactctgcaccacgttgggatgggtatccttgtacatccgtgcagcttttctatgatttttaatgtctgattattttcttaggttaaatttctaaaagtagaagtgaacagcgtgtgcacatttttatgactttgggtacatttcattacattactttccagaaaagttggaacaattcatagcagtaactgcactgaatttcttgtattacttacctatttttaagcaagtaatataatctcttggttccaaaaacaaagcataaagaaaagtctcctatctgcctacctccccacccactgttgttgattttttggtgtgtatccttccagagtttcattatatacacagaaacaaataccagtgtcaccctcctttgtatgcacatagtctagcatgccatgcacactcttgtgcaagtggctttttattttttaaaattaacaggccaggtacagtggctcatgcctgtaaacccagcactttgggaggccaaggaaggcggatcacttgaggtcaggagtttgagatcagcctggccaacatggcaaaaccccgtctctactaaaaatacaaaaattagctgggcatggtggcgggcacgtgtaatcccagctactggggaggctgaggcaggagaatcgcttgagcccaggaggtggaggtttcagtgagccgagaccgtcccactgcactccagcctgggtgacagaacgagactctgtttccaaaataaataaataaaaattaacagtgtttcttacacttttcaaatcagtacattaaaatccctccaattgtgtgtgtgtgtgtgtgtgtgtgtgtgtgtgtgtgtgtgtgtgtgtttattaaagcgacaccattgttcaatgatatgaataggtatattttatatacttggttccattttgatagatatttgggttgcttccttgaagaatgttgtgcgtacaccgtttgacacaggtgcaagcttatctgcagggggaagccgatttgcaggactcattcctatagggagaggggccaggcccagggacttaagtgtttgtgaatttgtaggaactgccagattacccacacttagcagtttacaccccttccctccagcactggctgcagagagccctgtcctccagggccctaatgctaattctttcatgattgcactaattatatgcacaaaaggaatgcaacagaacaaaacaaaccacctggttttgtaggtgtggaagtgcacattgcagtaaggagtcaatgaaatcggttactgtgggacaggaccctcccctccccttggttattttactaacttggaataacgccacttccttgtaggaaacaggcagtgactgtcagtgagtgtgcctaggagaggggtgggtccttttagagaccaacctcgcagttagccagcaacaggctgcagcttagctagatgaaaagttagtttgagaaactgaagtcattgccgctaaggctggcaaggtgtggctggggccaagttgggggaatgtcgtagtagccggccctgtgcgcctgagcccacaattactgcgtcgctgctggggtctggcaaagctcaccttgatgcagttttgttcaaagcagtgcaatttccaagcctcaaaacagatccttttcaatacaatgtgattgtaaaaattctattaataaagagaaaaaaaagacgcaccagcggcttacaagatctttttttgtttttttttttaagagacagagtttcactgtcgccgaggctgaagtgcagtggtatgatctcggctcactgcaacctccgcctcccaggctcacacaattctcctgcctgagcctcctgagtagctgggattacaggcgcgcaccaccatgccgggccaattttgtatttttagtagagatggggtttcgccatgttggccaggctggtctcaaactcctgacctcaggtgatcctcctgcctgggcctcccaaagtgctgggattacaggcatgagccactgcacccagtcacgagatcttaaagtagaagtaactatggtatttttttcgagaattctgttagggcgagaagcccattcgtactgtgctggaaccatcctgaccctgtctgttctttgcaggaactcaaaccaatatgcctaagtagctgaaactgttgcatttcaaagccttttcaagcatatcttgaggacactgttccctgcagctgaactgaagtcttgatctgagcccaggaggagtccctggggttgtcttgttgggggtggggaagtgggaatgcttgcattcagctttgggggaccttaaccctttgccccctcccctgtccccccttcacatagctttaacatgaaagtctttctgtctgtcagatctcccctgtacaaagagtggtctactctaaaaattgctttgaaattggaatggacccctccctctcttctattttagttctagtttctagctctttaaaataatgcaacttttcgctttattgttctaaatcaatgcattctagccgttggctgtcccagttgcttccctgtggctgggagcccctctctgtggttgaggctggtcttaccattgctccagttgtcttcggccttctggggcttacttcccctgccctggaggcctgaggccagccagccagtgtggtgtgacccccctgacagtgggctctcccggctggcccagttgagggtggtcagttccttttgtggccttgccttcttgggagataaaagtggccccctgggtgccgtgcggcccgcccgcagggtccttggtggagctccagcattgattcctgcaggttcagctcctgccccaaggcagcgtccagctggctgagtggggttctcccagggtctctaagcacaggacagcctgcttctgcatgggggcgcacaggggaccgcagagtcacactcagacccttctaccacctcctgacttgtggactttggtggtgggtggcgacaaactggagtccactgggtctgtggcagagaaaggtggctttgctgggggctgggggagaggaggcgtttttggatcgcagcatataccttgtctagaattgtataaaaacctacaggaaaaggctgatttttttttaaaaaggctgtttttttaaaaacaactaaaggcacaaaaactccaagtgtgagaatatccagaatgcgtttatataatgtgcaccgttgaaaggaacattgaaaaaacaaaaaactccgaggaacaggtcattgggtttggagaagtttccttcagaaagttctcttcctgctcgttcactgtggattaaagctcgttggcaatttcggaagttcacgttcttgagactcggtgcctttggaacaatggctcacaatgaggacggtgtgcgttcccggcaagaatgagtgttgggggcttttctccttatcacccgttccccagacccctctcatcggcctcataaagaaacagatggttcatcaggaatagctcagaaatcacgttggctcctggctgtataaagagtgggaactgggatcataaacatttgaaatctcctaggaaaggacaatgattccctcaatgaaatattgatgtaaagggagcattttaaaaggcagaaatgatgaacctgattcaggttgaagctggtagtgtactttaacctttttgagaattgttaatttaaaagcaaatagaatgaaatatagactataaaagcagattaaatcatttttatgcatcctgggttttttggtgtcacgtgacaggaagagttactacaaagaagaccaggttttggaaagacggtggggttcacgtgatgaaacacaggccatgacccctttaggaattggatggaagccagccaggccaggccccccacccccaggtcctgggttggggctctgtgggcccaaggagtcctccagaaccaaattctccactaagagcaatttttaaaagagcagctgctcatcccatgtccaattagagtgagcagatgtgtaagaaacatgtctttgattgattttgggggagccccccgcagtttgatgttttgcttggaggtaggggaaacgggggctgagttacaagtattacctgtaggaataaacaattcttttgaaacatcagtagggaagaaagaaaaaaaaaggcagcttaagatttatctaaaaaggaagtggaaagttaaagttgctggagatctcattactgtctgtctcgctcaccgtaattaaaaaatgcctgaatgatcttaataacacatgattcagctgacaagcactaattgccctgtatcaggccaagagaagatgaatgttgtcaagaaaaccacaagtcagacaagctgattctctgtgagtctgacaccgtgttcccatgtacagaccagtttttactggagttcttccagcatcaaaagcagcttcttaccttcccattaattttcatcgctggcaggcccgagttgtttgcgatacactgactacctcccttgattcctcctcgctggctcaggagcttgggtctgcagacaaaatgtaaatatgtttcttgctcttatctttgtcctttttcagggaagaaatctgttcccgtccaatatgaatgccctggtgggcttgtcagtaaattacatggtatttgggaattgattttctgacgccaccgatttgtcaagaacttatcctgccttttcagcgatttgacagcacctgttaggctgtagggccatgtgattgggcagttctcctgccgagaaaaaggggactgatgactttctgtcacttgggcatccagaaacctccttgaaggtggaggttattgagggaggaggcaggagtggaaaaatgctattggtttattcctgtgcttttatagaacagccgaaccattctatggcaataaaacagaatcacagggcaaggtgcagtggctcacacctgtcatcccagtattttgggaggctgaggcaggaggatcgcttgagcccaggagtttgagaccaaccttggcaacatagtgagaccttgtctctacccaaaaataaaaaaaaaaaatcagctgggcttggtggtgcacgcctgtagtcccatctcctcgggaggctgaggtgggaggatcgcttgaggctgggaggtgggagcttgcagtgagccatgatcacaccactgcactccagcctgggcaacagagtgagatcctatctcaaaaacaaacaaacaaaaaaggaacttgtttcctagcaagaagcagatgaggctggtgaataagcataccacataagtaagtaatccactaacttagggaatttcgtgaccagtcactcagcacgccctgttgcgaaggggacggctgaccaataggatcatctcagagtcaccctcacacaacttggcttagcctagttggcaaaagtgtctcttcagagacctaccctcctggaattgaaataaaatgaaaatttgtgatgacgatcagctactgtcagtgtgacttaggtgtagaaattaaaaaagaaaaaaagaccactctaaaggcatttgtgcatgaagacacctacagaaataaagccggggtgctgttcttggtcttcattcaggctagcacctctcgtcaccttttcactttggagctcagggcctggttcactcagcaagtgagcggctcacacagtagatgctctgcacatagtagtaggtactcagaatatagcagctgttgatgtacatgtttccagaggggccaacacaggaatctgcacgtgggtccttgctttaagcccagcccctctctgtgggcgtgggatggagtcttcctttcttggtgaccggcgccctctggggtcactggaggcctggacttccccactggcccagtgaccttgtttccttgttccctgtctcgcccagccttggctgtcctgggatttgaaaatctgggataaagcctttttcgggcctctaaggccctgctggttctgcgtgttccagagagctgcacctctgggtggtgagctggcctttttggcatttgatttatgtatagccctgagtcactgggagcggatctagagtccaggccagtgactgatttcaaacgctaacactcttggctcgggctcaggtttcaagtcagcctccaaaggggatgtttgctcatttcgtcatcttcctatcacagcaattttcgtcatatggaggggtggcactcatgtaccttgatgattattattcttttaaaaaatgaagttatttatgttatggggtgagttcgtcacacagtccgaatgtggaatgttgccatccttttcatcccaatcctgccagtgatttctgtttacaatagaactattgacattgtatggggatgaaactagcatgagatagtaattgttggcttgcctgagattttcatcatatgtacacatagacaaaacctggctttagttcctaaagctattgctgtttattgtacttttattagccaatgttacagatccccgtagcatgccagaggctattaagaaatacaggggtcgggggcaggaacgaagtccctggccatggatcatgcaattgatctatagttatttttttttctttttctttaatttttttttgaaattttaaattattattattactgttttttgcgatggagtttcactcttgttgcccaggctggagtgcaatggcatgatctccccctcccaggttcaagcgattttcctgcctcagcttccggagtagctgggattataggcgcctgctaccatacctggctaatttttgtatttttagtagagatggggtttcaccatgttggccaggctggtcttgaactcttgacctcaagtgatccaccgacctcgacctcccaaagtgctgggattacaggtgtgagccaccatgcccggcccaaattattattattttttataagataggatcttatcacacaggctggactgcagtggtgcaatcatagctcactacaacttccaacttttgggctcaggtgatcctcccacctcagcctcctgagtagctgggacagcaggtacatgccaccatgccaggctaagttttaaaattttattttgctagggggtctcgctgacttgcccaggctggtcgtgaactcctggccacaagtgatcttcctgccttggcctcccaaagtgctgggattataggtgtgagccatgcttttggccaatttttagttattgtggatacataatagttgtacatattcatggagtacttgtgatgttttggtgtaagcatacaatgtgtaatgatcaagtcaaggtaattgggatatatacttatagttagcctacagtcttattgataatgttctcagaaatttctgattccagagctccttgctcctctcccataattagataacgtgtttttctgtccggtaattgctgtagtactcatttttagatggggtagggaaggccatgtgccatgttggggcctcatcccaaagaccttgtgctgtttgggacaggtaattatttaaagccccgtgtgaggtgggtgggtgttaaactcatgctctccacaccttcccagagtgcctgggaaagcaggcttctctaagaaagtggaatagcgaataggcagtgatccctgagagagatacataatgattgtcagtttcatggattacagataattccgtttaatgtcctctgtttttcctttttgcaaatttctatgcattatatagaacattgactttagcatagaaagtgctaattcttgatttggcactttaatggatatttacacagtgacaccataaacattggataaacagaggatttgttttaatgagatcttcagtgatttgaagccgtttcccccttgccttctggaatccccggctccagttctgcctggttttggtgatgctgtcacagtggagggctgactgcaggcctcgactgtgagccctcactcggccaccttttcatttcctcgctgggttccaggctctttgaagcactcgcctcctcccctccctgcatgtcctctgtagtgcctatttctgtgatttgcatatagcggaaatatttgttgaactgaattatttttacacacaagcctttcatgtggccaacattttgaggtctgtctcctttggcgggagtctgggaggaatcttccagttcactaagaagtgtttgatagcttcagggcaggcgtgccctgattggggctggatgccctgcctccatccagaggctctctggccaggaggggaatgaaccaagtgcccagattcccccctacaatgtttatgcagaggtgactgtcacctgccaatggtgacagtccaccagggaagtccagaaggcctttggattaaagctacaggagaggcaggtccccttgcagggtcagaaggggaagagagaagagagagagaaccaaaggtgggaggttcagctactcgggaggctgaggtgggaggatccctcaagcccaggaggtcaagtctgcagtgagctatgattgcaccactgctctccagcctgggcgacagagcgagaccctgtcccaaaaaataaaaaataaagatggaaagatgggaggattctccccaggaaggcccaggccgcagggtccccttgtccttaaaggccagctcagtgaggctacaggtccccttgccccagttccccgagcacagagcaggcatggcctcggacgacttcctctttgtgtctcgtggactactcaataaatattaatgttttccaaagatatcttgcccagctctccctgacgaggctgttggcttgaaggaataacaacactcgttgcactcacggaatattaagtctgtgccagggcctgttctgagctcatgacttgtgctactcggtctctccccacaagctcacagggcggatgctattttcaccgccgtttataggagaggaaactgaggcacagggtccttcagtgactggcccccatgagcaggcagcacatctggaattccagcctgtgcagcctggccccaggatccccatgcctctgtgggggacactctggaagtgacaggtgaggcacttctctggcctctctggatctcctgctggccctgaatgtgggtggttacccttttggggtgctgtcggtgcctcttagatgtctcagtgaccctacagggtctgccttccataggactgcctttttctttttttttgagacaggttctcactctcctgccaaggctggagtgcagtggcacaatctcacctcattgcaacctctgtctcctgggctcaagtgatcttcctaccccagcctcctgaatagctgggactataggtgtgcgccgccatgcccaactaatttttttttgtagtttttttggtagagatggggcttcactgtgttgcccaggctggtctcaatcttctgggttcaagtgatctgtccaccatggcttcccaaagtattgggattacaggtgtgagccactatgctcggccggcacccacctttttgtggacttttctttgttgacttggcattcggcaaggtgtaggcttttgccaccaacacgatacccgtggggagaagccccctggcccccgtgcctgccagaagaaaggcttagggtcccctgcgaggacccacacgtgcactgcatgcctggatagcccatgccagcctcactgaggctggatttagttcctgagtatgttatggagaagtgcccagagcagggaccgcaggcacaaggtgggcctggcctttggaggaggctgggcacggccacctgctcctcctctctcccatgggcaggttggccttgttgccattggaaactcttgagagcccacgggtgttttctggccatgtgacctaaatgggaggcttgctgaagggtagatgctgcttcaccagcaacaagaggagcccccagacctcagccacaggatggcccccaccctgctgagcccccactcttcgctccctgctcagcagagcaacacataccattgcccaaaggatggaccaggcacagcgtggggcccaatagcaaatgttctgacgaaggaggtcagtgccggacactgctgggcgttgttgagtcctgggctggcagggacagttttgcagggacggtttggaaggggctttgctggggagggggtctctaggaggggcagcccctgaatagggcagccgagttgctgtgactgcatcttcctttctttccgatgggggcaaaactcactcttctttttaaccattctctgttatctgtttttcttttcttttgaaactttttttttctttctttttttttagaaagaggatcttgctctgttgccaggctacagtgcagtggtgtgattatagttcactgaagtcttgatctcctgggctcaagcagtcctcctacctcagcctcctgagtagctgggactacaagtgtgagccaccatgcctggataatttttattttatttttttagagatagggtcttgctatgttgcccaggctggtcttgaactcctggcctcaggtgatcctcctgcctcggcctcccaaagtgctgggattacagacatgagccactgcacccggccatgtcctctttttctgattcgggaggataagggctccccatgacactggcatcagcattgggagcatttccgtgaccccagggctgctgatacaccctgtggacagggcaggacccacagctaagtcagtaaagcaccatcctctgggagtggctgtcatacgacatttcttgcttttaggaccattggactgaaaaaccaaatcctgccactggatctggtgatgacggtgacatttttttttttttttttttttgtttagaagcttatgattcatcggatctcttttggtttacggaaagcccagatgtcgtggtccctctgcgtgcccactccaggagaacgcattcaatgtcaaggaaccctgtagtgtgcaaagttggatttagggatttcccgaataaagctcactgagggtcaatgagttccataaacattattgaggccgggtgtggtggctcacgcctgtaatctcagcactttgtgaggctgaggtggggggatcacctgaggtcagaagttccagaccagccctgccaacatggcgaaaccccgtctctactaaaaatacaaaaatctgggtgtggtggcacattcctgtaattccagctactcgggaggctgaggcaggagaatctcttgaacccaggagacggaggttgtagtgagccgagatcgtgccactgcactccagcctgggtgacagagtgaggctccgtctccaaaaaaaaagaaaaaaaaattattgaatgtcttccttgtacctgacactgtgctttatcccatttaattccactggataatatgttaaattcagacttgttcgtagatttatatacatgtacatatccctcttaatacattggtttattctgtttctccatgttcataccgccagcctgatgcctcatttgcacaaatgaatggatgagtgaatccagcttattcttttatttctccctgggatctggtatacaagagatggttattttttaatttgagacagagtctcactctgtcacctaggctggagtgcggtggtgcaatctcagctcactgcagcccctgcctcctgggttcatgtgattctcatgccttagcctcctgagtagctgagattacaggtgcacaccactatacccagctaatttttgtatttttggtagagtcagcatttcaccatgatggccaggctggtcttgaactcttgacctcaagtgatccacctgcctcggcctcccaaagtgccggaattataggggtgagccaccacaccttgccaagagatggtcattaaagttgaattttggcactccttgcagaaaccctacaaagttggtatcacctctattttgcatatcagaaaactgatgctggccaggtgcagtgactcatgcctgtaatcttagcactttgggaagctgaggcaggaggattgcttgaggtcaagggttcaagaccagcctgggcaacataaccagaccccgtctctacaagaaaattaaaaaatgagttggatgtgtacctgtgatcccagatacttaggaggctgaggtgggaggattggttgagtcctggagtttaaggctgcagtgagctatgattgcaccactaaattccaacctgggcaatggagcaagaccctgtctcaaaaaaaaaaaaaaaaaaagtgctgagagagatcgtttcccgagggtctttggatagtttgtagaaaaacagtactgttccttctaaagccctgtggctttttccctattccaggtgcacattggcctttgaggctggaaaacacttttacttacttccagctttatgggattcataaaatggccttgagaaaagtaaaccgatttttctccttctaaaaacatccagtgggccgggtgcagtggttcacacctgtcatcccaacactttgggaggccgaggccggcggatcacttgaggtcaggggtttgagaccagcctggccagcatggtggaaccccatttctactaaaaatacaaaaaattagctgggcctggtggtgagcacctgtaatcccagctactcaggaggctgaggcaggagaattgcttgaacctgggaggtggaggttgcagtcaggcgagatcacaccgctgcactccagcctgggcgacagagcaagactatatctcaaaaaataaataaacaaataaatacatctggtgcaggtaaagtgttcaggaagtaatttcctggaagagggaactctgcagttgcaaatgcggccttcttacaagtcgcttgtagggtgttgaaactctctcgcgatcccagtgacttgagatgctctgttttctggataactaagcttttccaccttcactacggggtaccagggtctttgtagcagagaggcagctgtcttgatggtggaaccactcccgccagtgtgtggtggggtgcccccggggatttagggagagagaaggccagtggcagggactggctggaggaagagggtgcgaggaaaaacactggctgacatttgaaggaacgtgcttcagtatcagggaaggccagcgtgggataatcggtgtcttggcagatggggttgacggggagccctgaagccggcagtgtttagagattcaaagaataggggggctgtggggagtcttttggttcacagcagtgtcccccaaaccggcacagtgggatgagagtgggctggccagggaaggggacagggtgttaggtccagaggtgctaaaatccccaaccatggtcaaaatggggacatgagagactcggggttcagagctcacatgaaggacagctgtccccccctccacccccgccttgggtcagagctggctaggagagcccaccctgcagcctgtccttcgtgggaatcagcatgaggggtgcaaagtgctcagcaaggcccggcaccaggtttgttcttgggatcagagtgatacacgcgccttacattttttttaagctgctggttttgcgggtcagtacggggaaaaacggtgagtcccttttataaaatatatagagaggttggtgcgaaaatagcagcttgtttctgcttgcgtatttctactcactgctgggacacaaatctacccttccattttctgaattgtattcattcaaactctgatttaacctctatttagttaatgaattgggcaagttaacctcgaactcttccaggctgtggctgttaccgtcaccatctcctgcttctcactttacacactcatatgagaccttttttatttctgaagtgtggcctgacattgtttaggctgttgtttggtgcttatttttaactcttcttttgtcacttaagtaggatgtcttaattcttgtttagtgttagatcacttagcaggattttttttttgagcgggggcggggggaatatgattttgtgtcacattttgaatacttctctatggcagtatcttttagagttattatggaccctgtaattctgttctcaaagacgtttaaccactagaggtagacaccaaaaatgttttatttgtctcatttgggactctaattcagtgaagttggctgtttggagtctgagactggatctgtttttttattttgttttgttgttgttttgtttgttttcagacagggtcttgctcttctgcccaggctggagtgcagtggtttgatcacaagtcactgtggcctctaacttacatgcttaagcaatcctcacgcctcagactcccgagtagctgggaccacaggtgctcaccaccaggcccagctgacttttgtattttttctagagacaaggcctcataagtagttgtttcccaggctggtctcaaactcctgggctcaagtgatcctcctgcctcagcctccccaaagtgctaggattataggcataagccctcacacccagccaggactggatcccttgactcacttaatgatcggggtttacttctgacctgcatggggtgctgtggggaacccagagatcaataagacagcccgtaccttcttggagctgtatttagcagggtcatagaagacgcactcataatcagaaaccatccagaatgtgacttctggccagggagaatagggaagggttcatggagatggtggcatttgattgaattctgaatttggggttgtaggtttcaaatattagtttggggacagtcatccttttattttcttctctaaatttaaagaaattgttatttttaaaaaccaattggaatgggtattgaatttctgtgtggagaatgtctaccagtttttcatcattttctccactgtatagtgtcaataagtgttaaatgcaatggtctgtaagactttgttgataattttcttttctttgacatagacttgtaaactggaaaccctgtgtgggtaatgggcagtgcctatttcagcatcttgtccccagaaatccactccctaaaaggcttgttgaatgaatcagatctaggagcatctcttttgtgttggagcggagagtcagtccggactttgagcctctccttgcactgaccagcggcaggctgaagacagttggacttaagaaaacttaatctagaagcaatatgctggtcagattctttcaatgctaggtttagtatcgttcctttttctcccatttggtgaagtggtgtaatgctttagcacattttaaataagattacacaagcggctgttagttggcatcaagaatcttttaatctggaaagaaaatgttacctccttcatttgcaaaacagagtgtttctggcaccgtatcccaaagtgtcttctggttgttccgtttttcagaagttactgtgggcttctaattaccctcatttagacatccaggacagaaattgccacttcaacaagaaaattttgtaatgagccggaggaaatggtctcatcattactacgttatacgcagtctgagagtctgcgtggatttttatttcacaagaatgtgactgtttaattgaaaaatgttgttaaaatgtgctttctgttcctatcagtatgttgttagtgcttatatagccatgctcgagtcagtgaaaattggtgccctttgccaaaatactttttttcatttttgtgtataattttgtgagctaggtctatttttgtttaattaggccctgcaagagaatgagggagagctgtatttaaatttttagaccattaaagggcctaaaactatcctagatgaaaggcccccaaaattagctttaatatttattatatgaataaaaccaatagggaaaacgtttccagaaaccctttctctttttccttcttcagacagctggctaagattaattgcaggcctgaacgtgggcatgtttgctagtttctcttgttctattactagaaaataactcttaagagaggagagaaataccgtcttcttgtatttggggggcaggctgtacattttataactcactaatataatgaaatgtttgttgataacatcatattttgctttctgatagaaaagtcctaatttctattttctttttactttttatttttattactttttttttttttttttttttttttttaaaatagagatgagggcttgctgtgttgcccaggctggtctcgaactcctgggcttaagcaaccctcctacctcagcctcccaaagtgctgggattacaggcatgagcaactgcgcctggcaagtttgttttactttttatttttattactttttgtttctaatttctactttcgacaggattccttttaaaattttaatctaggaaacaaaactgcacgtgaaagatttgccttgtagacggaaagttctggaaacatcagctccaggctgtggtgtgaagctgtcgggctgatttgcctggtaagaagcgcgtttggggcacggagggtcaccttgccccctgcgagcgttctttcatcatttgagcagccaagcatcccttttgggccaagtttgccaaagactctaacgtagagaagtggacagacccagttgcatgctgatgttaggggcagagagaaagaaggaaagatccttgcctagcttaagcccttgtgcttcttccccacatttatttgacttcccaaattggattggctgttgtgattgaaaagattgtcagcactatgtaaatgagaatgagaagtaaaagtgcatctcatgcagataatttctatgtagataatttgccataaaaatttatattgcagtccttaaaaccttcggagatttagtctgtctagggaaaggtgatttatacggcattaaaacactttttatgtcccagtcctttagatttaatgtttattgcctataaaaatgaaatcttcttgtggatatttaaaagttttggtactgtgtgaaatatatattcaagttagaaatgctttggagatgttgtaaataagtggcaaatctcttgctccaaagtccactgtgttgtctgggcccgcatcttggctttgcacgcctgaaaagctgcctcgggtaccggtgtctgatcatcaccatagtgggtcgccaagtaggagaatgtcttatgtagggatttggtggtttttcaaaaaacttaaattagctaacaaggatgggactattataattcctcagaaagttatgcaaggtctgaccagaatttcattccaatctgcagaaagactgaattatggtgcagtttttttggttttttgtttgtttgttttttgagacggagtctcgctctgtcgcccaggctggagtgcagcggcacgatctcggctcactgcaagctccgcctcctgggttcacgctattctgcctcagcctcccaagacgctgggattacaggcgcccaccaccacacttggataattttttgtatttttagtagagatgggatttcgccgtgttggccaggctggtctcaaactcctgacctcaggtgatccacccgcctcggcctcccaaagtgctgggattacaggcgtgagcccctgcgcccggcctatggcgcaggttttaaagagtggaagtgctttgacaatggaatgcccagtacaaagcagtttttaggcttttgcagccactcagattcataacagcacgcttcaattctggtcttaaataaaactctcatggagtaaataaatcatatggtggggacagcactgctgtggaggagggtactgtttaagcattttgggggttcctgaaagatgtttctcaaagtgagcgctggagaggagtacctggtttgattgttgaactaaagtgtggtttctgtaaccctagggagttcttccctaggtatgattgagctccctgagtgctgggatggtgacctccccagcctgtctccaagtctgagtactggtcggcttcctagactccttaaaacgctgggtattttatttaattaatttatttatttttgagatggagtcttgctgtgtcgcccaggctggagtgcagtggtgcgatcttggctcactgcaacctctgcctcctgggttcaagcagttctcccgtctcagcctcctgagtagctgggattacaggcatgcaccaccacgcctggctaatttttgtatttttagtagagacggggtttcgccattttggccaggctggtcttgaactcctgacctcaaacactgggtattttggaaatcatgtgggaagtgcttttcctagagttttgtagctcctcaaaaaggcagaactaatcaaccaggcttccccattgtagccacagttggatcccaatggtaagggccattgggaaaccaatggtctgggtgagtctggcctgggaccctggcatggggaagagactggacttgaaggctttggatgggcagcttggtctggacagtattggaaataaaggaacttgagactttgaaattgctgtgatgggggtgttctcacctgtccataggggtgggatgtcagtaagctttgccggtgtctgtcccatagatagactcagctctgcattgcagccccaaaaggagcctgcattcttaaaagaattttaggggaagaaagatttaagagagcacctgaagtcctgaatcccttcagaaggaattcatggctgcctgtagtcagctgccagtccaaccttgccctccaaaagaagtcacagagattgagttttcagcgaggcagggagaagttgtcacatttgcctaattcttgtagaggtgagagtgggagtaaactggaagggggcggattattggtgatttgggggccacgtttccttgtatcacctgtaaagttttttttttgtttttgttttttttttttttttttggagacagggtcttactctgtcatgcaggctggagtgcagcggcacaatcacggctaattgcggcctcaacctccccagactcccaagtagctgggactataggcatgcaccactgcacttggcgtatttatttatttatttattattttttcgaagagacagggtctccttatgttgcccaggctgttctcaaactcctgaagcaatccgcccacctcagcctcccaaagtgctgggattacaggtgtgagccaccatgcctggctcacccataaaattaaaatgaaaagagcagaccacagccagcagtcttccgacctccagctcttgcaggtcgtgggcagccttgccccaggtgcagcaggtaggccaggaagcaggtgtgggaacagagcaacagcaggcaccgtggggacatgcacagtaagcgtcgaatcggtgtgcgtttgcagaaacgtgaatgggtgaatgaaggggtgtatgaaggtatacacaggaacgccacagtcagctttgtgtaaagtagaccagtgaacagattgctggtattgcttctgacagctctgctcctcaggggaaaatggtgaactcactttagaactcgcctttgtcagctccaactagactctggaaggaacacaaatgctcagactttcccatgacagactgtgaagcaaagccagttacacagctaccgtcactaatatttttggtataaagcagttgctaaaattaattccagtctgaaacttgatgaattctcagtcatggaattaacaggtcttaaatgggaaaaataaaaaattagcttgattaaaaataaatgtttgtgctgaaatgtggagcctgtctgtccctaacaaactaaatatgaagtttttcatcttagaggatttgtttgcctttgagtattcatagggaaagtgcacgtttgtaccagaaatttagagacgcactcccagtaagttcttacgagcagtcagtattatcctttttgtataaggcaagcagtcagtccctatgaagagtaagatacaagcctggctcagcagtggcccccctgagcctatctgatgtgcagaaaagtcacgcacacacaactgtcttgaagggcagcctcctttcagccagcacccatttactccctcttattaggccttcctctgaatttatatcaagcaaactatttaggacgcatctgcgaagcaggaagtgtgtttcattttgtttttaatgaggtttcaaactctctcttcccatctctgtccctggatgacagcgcagagttttacgtcatttgctattagacatcttgtggcttgacatcctcgaaggctcagccacccctgggtgtgtttggttaatacagcaagtgaagcctgggcaacatatcgaggcctcatttctacagaaatttttaaaaagtagctgggcatggtggcatgcacctgtcgtgtcagctacttgaaaggctgaggtggaaggattgcttgagcccaggagttcaagcccgcagtgagctatgatcgtgccactgtactccagcctgagtgaagggcgagatgttgtctcttaaaaaaaaaaaataataataataaaataaagaaaagaaaaaagtagaggttctgtgcttagttagaagatatctaacaacacaattggttagactttcataattatttctgctgatgtaagtatcacagcgcaggtcatgggcaacagtttactgttttcacacccagcttcaatgttaaatgaaccccagactatagcgtgaccagtctgatattatcatccccaaatctttatagtttcagctcttgggatggatgactgaataaccattttttttccagtgtggtagtcttagggttttgcttattggtgtgtgtgtttcaagaggaacctctgttccttggacttgatgtgagtggcaagtcatgtaaaaagctggattttatcaatagtttttgtctaaaaaccaaaaccaaaaaattcttcccctgcagtaccagtgcttgaaataaaccaccctcctacccccacccagcttgcctgcgtggatccagtagcacccccggtaccccggtgggcctttttggcagccccgaggggtcagggatctagggggaagagtcaccgcagggagcgcagatgtacttggagtggggaatggttgggggggacccattcccctgctttaaaccgcaaatgtcttttgatatctagtaaaattggcaagcagaatgattgaaaacatgtgagaggtaactggatctaagtctcaagtagtacatatttgagaagttttccccaatgtaaaagtcactctttaagagccttaaactaataaaaacaaggaaattccatgttacggctgccactcggccttttcatttttattccagaagtcagatctgacaggtcagcagctcactggctctgggctccccgtgtttaaagcagtggggacgaggagaagaactggcagccgccgggacggggaagtctccaatgccattcagtgccaggctcgtaattccctcttagtttatcctattttctcttcttggggcggcttcctgtatgtactttattcactgaagctgcttcaggattccttcagagactattcttgtttctttccatttctgtgtctttttttttttttttttttttttgagacagagtcttgccctgtggcctgggctggagtgcagcggcgcgaccttggctcactgcaacctccgcctcccgggttcaagtgattctcctgcgtcagcctcctgagtagctgggattacaggcacgcaccaccacacctggctaatatttatatttttagtagagacagggttttgccatgttggccaggccagtctcgaactcctgaccacaggtgatctgcctgcttcggccccccacagtgctgggattacaaagcataagccaccgcacccggctaatttcctttatagttacactagcttggaagaataacatactgagtggcgtggaaggcgttggtgcacataggtgcagcatcccagagccccgtccactggcggctatttgtgcatggctgcctgtggcttcttatctgtgatggaacctcgtgggcagagaagtggctggagagcatcaccaaggctgcctggtccaagttgcttcctgttgctgcatgggcagtgttctggggtccagaccctgggtggtagtgataagatggtgatggggtggagtgggtccttatagatcccacattactgagcggccttttgcccttcaaaccagatcacaatcccctccctgccagttggtcctcaagaaatcacaggaggctgggcgcagtggctcacgcctgtaatcccagcactttgggaggccaaagcaggtggatcacttgaggtcaggagttcgagaccagcctggtcaacatggcaaaacccggtctctactaaaaatacaaaaaaaattagccaggtgtggtggtgcactcttgtgatcccagctactcgggaggctgagacaggagaatctcttgaacccaggaggcagaggttgcagtgagtcaagattggattgtgccactgcactccagtctgagtgattctgtctcaaaaaaataaaaaaataaagaagtcacaggaggcccagcatacagagaacatcaggtatagagagatgtccttcctgggccaaaacaggtggtgtcattttgctgagtttgatagagaaaaagtcctgatgtctgtgtacataagaactcacgtctagagttcgagaaaaaccggtgatgagaacttgaacttggaggagtcacagggggatcaggaaagcttggtaattggcatgaatttcctacctccaggggcctggcacagagacctaggatgaagagggggccatcgagcatggtgtgaacttggagagtgtggggagctgccccagccgagggcactggatgggaattcatgccagaaccccatcacatagcggcaggagctgtaattgtgcttcttaattgtgtatcttcatttagtgcgagtttaggtggttagcaatagctctttagctagctttacagagtctaagttaaagagcccctcagctatcttgtagaaagcgccctggacaggatggggtgatgctgacagctggagtcactgttccagcgcccagaatggggagactagcagcacttctgggcagcccatgaagcagcctcttccctctgccggtgtccctcatgtccagcagagctagaagtgaaactcactgaggattgacgcggcccctttaaaatcgcatctccgctcttggcaccaggagctgtcatgtagtgtaacctgttggtgcccagaacccaggtttcctggtggcagccagcggtaccggtgccaggaggcagcgaaggaatcacttgcgacgcccgctctctctgccatacgagtgtcgttctgcggggccatctggctggcagcagctctcagccaatggcaggatgttgtaaacctcactcgctgaatgcggcaccgaaaatcttgaaaattaactgcaaaaataaaatcaaagctggctccgagatggtatttcttggcctggcataagctctccggatgaacttgctctgccttgttgatagatgcctcttactagtttggttttttcccaggagccagttggcatcttttaacttttccttgtaaaatccaggcagaaacattttgagagctttctggagtttttatttgctaattaaaatgtgagaagggaacacagccacaggtagaggtctagtgcaagccacagctgtgattcagaagaagaaaaaaaaaagccaaacctgacagtttcaaaatgaagttattagcacttcacctataactgtgatagcttttaacttgcaggatccttctcttaggcaccacctcccatccgaaccccagagcatatgggaaaaggagctaatgtgtgtaagttgcaggatacttaatcactgaagaatctaacaatgataactactatctctctggaacttttttttaacttagaagagtatgtcttgttctgtttatatatcacatagttttccaacgaccctgggaggtgaggtaggtggtatattttaccaatgggaaaatcgatgctcaggaagtcttggtgacttgctcaagttcccataacaagaagctgctgaatccaggatggaacctggtctaccccaaatgcccctactgcttcctagggcccagtaatgcccctgggtagggcgggcccagctctggaagaaacagggctatacaaaaaatcacccaatattgggtcaccagccttcttctacttgcaaaataattaagcaaaatctgtttttatttgtttttgagacggagtcttgctttgtcgcccaggttagagtgcagtggtgtgaacttggttcactgcaacctccgcccctagggttctagcgattctcctgcctcagcctcccgagtaactgggattacagacttgcaccaccacgcccggctatttttttgtatttttaatagagacagggttttgccatgttggccaggctggtctcgaactcctgacctcaggtgatccacctgcctcggcctcccaaagtgcgggggttacaggtgtgagccactgtgcctggccacaaaatctattttaattctgcaagttataagcagccagtggcccaccaggcccagctgtacgttcccagggaccccccaaagcgtatatgtcccgggcacacacacactaggtggtttgttttgttccccagcagcccgtgtctgcccgggcagatgttagtggctgagaaaccccaacagggagtgagccacaggcccgcgggtggcttccctgccagtgttctcctcgcgaaggggaagggagcccttgccagaatggctggtgccctaacaaattgattcctgccaaacaatagaaataaatattttcagcagacagaaatgttggctctgaaagcattcaaattaaaggcttatttctgaaacaaatactttaggaggaaaacatttttaccagcgcagatgagatcagagctattccttttggcagtggcaggactattttgagactcagccacaacggtttccctgccccgtctcgtttttcactgatgacctcgccccctgtttcatggagacagggaattgcattcagctagaggcatggggaagagatggtggcatggtgttctgcagagagcctcagttggacagtcggccgaatctggattcaaatccaggccctacctctcctgctatgatttcgacaaagccggtcagtcatctgatcatcagcttcctcagtctgtgaaatggggcggtacctcccttgcaatggttaatagcgttatcctcaggacctgggggtcattggaggccagcactgtccctagaactctctgtgttgattaaatggtctctacccgccccagcaaatataattgccactagctacatgtaactgttgggcccttgaagtatggcagctggaatggagggaacaaattttaaatttaacttagatgaaatgtaatccacatgtggccactggctaccattttggatagtgcagttcccattcatccctctcatttcattagttggtccctggagccaattaattggttggagggtcaacccactacaaatctcccaagtctttctctgtgccggatgcagctgtgcggagttgggacctgtctgttgtctttgacatccgtcttctgtcctgcagacggagcagtggggcagtgccatcgagctgggcagaggaattaatatcttagccatcaactgcccaaatcaaccttcatgggcatcttttaattttctaagagatggggtcttgctgtgttgtccaggcaggactcgtgggctctttccgcctcagcctcccgagtagctgggactacagttgtgcaccaccacacccctctgatatttcttaattttaatggctgatgtttcttaattttaacaagttcccatatgtctcatgatgtatgctaagtataaaaagaataatagaaggcatgaagtcaaggggcctgtttcccgggcatttgtttcagtggtgagtcacattcatgcgaagcctcggtttccttatctgtaagaccagatcagcaaaccacctgtggctgcctctctccctggttgaccccgaggccaagaggaggggcagggtcagcagccggccagacctcagtagcccctccccatcctggtatgggggaacacaggaggtagaaaacaagtgacctacacaaggcgggtggtggcgggggaggtcccactttaacaggaggcaagatggccgggagaaagctatggggaacccaggcaaatggagatgagcagaccccaagaaccgtaccctagggggctggctgggtcgggggaattagggtcctttgggctccttgcagagccgaagattgtagtggggagcactgcgtgtgcctacaaggctgagcctggcaggcagaattatgtgttgttttgagataacagccacaacagagcagtaaagaatactgcttataaaacggacatttttttgtagctcaaaaatggtcaaatatcagtaatgtcatgtggtttgagtaatccataaagcagagcccttctcgttagggctgagaattatcctcccctctccctgccacagagccggccacgtggcctgccccggcacctgctccgccttacatgtcattatgcgtctccgagacagcgtctctcacatctcaccgtttaaatgagcgtctagcaagtattctatggagtgcaatgcttgttggatacatctggcattttcatcttcgcagagtgggtttgtgacggggtgaaaaacaaaaaaacaaattcttgattcttgatggaaatctctcagtcctgagagatttataaaaaaggcttgtaggaaaactttgtacgcgtagcttttatactcatagaccaaattataattttttattcaatcttattttctgaataggtaacgtgttcacttggtctaaaatcaaaattttagccaggtccggtcactcgcacctgtaatggcagtactttgggaggctgaggtggggggcggtcacttgagctcaggagtaacatggcaaaaccgtgtctttacaaaacacacacacacacacacacacacacacacacattagctggacatggtggcacgcgcccgtaatcccagctactcagatggctgaggcgggaggattgcttgagcccaggagttcgaggctgcagtaaactgtgattgcatcactgcactccagcctgggtaacacagtgagaccctgtctccaaaaaaataaaatttgtatgtttatatactgagaaattttgtctccgcctctgtccctttttacccctactgtctaccctaagtcagtactgtacttctgttcattttctgggggtgtgctgaacagattcaagagaatagcatttccatggaaaggccgcagcttgtaagtttcacttgaatttccgtgattgggagttaatatcaaatgatctctcagaatcaagaaatactgatacatatcaaatgtataataacattttgagaattttttttttttttttttcagacagagtctcactctgttgcccaggctggagtgtagtggtgtgatcttggctcactgcaacctctgcctcccgggttcaagcgattctcctgcctcagcctcccaagtagctgagattgcaggcgcccaccaccacacccagctaatttttgtatttttagtagagatggggtttcaccatgttggccaggctggtctcaaagtcctgacctcaggtgatccccctgccttgccctcccaaagtgctgggattacaggcgtgagccactgcgcctggccccattttgagaattaaaggaacatgggcacgtaatctttatacgaggtggagtcagattgaatagcaagaggaagagaaactgacatccacgctcattgcactgggcgttttatgtgacttaatcctcatagcagctctatgaagtatgtatcagagggtgtccccattttacattaaatcacttgcctggatcactcagctggggagggtgagagccaggtgacctacccaaggctgtgtctctgggtggggggctcagaacctctctccctcgttttgtagtagccagacattgtctcgtataaactatggcaactggaagtgaaccaggtcttttcctgccctctgattttggtggaaaatgtgacctacccaggaaaagcactatgattttaggagtttaggtgcacaaagctgttttccaagcatgctcattcttctcccaatttgggactcattgctgcctctctgccctcatctgtggggccaagggagctggagcgacagccacagcagaccgctctgcatccctgtatgcgttgtgggaaacagcagaggaggtggcgttgcgcccatcttacagactccagattctgttcacccgacaggcagtgggaatccgtgttcacgctggtcccttggatcagaaattcagtacccttccctccacaccatgctgtagacacctctttcctctcctagacccggaacatcctctcttcttcagggtactggggaccaagatccaccctcgtggtgagaaaaccacaccataaataaacacagccaccatacgccgtgagatctggccaagaggtttccttctgttcattcggccctaatctccaagatgggaaggcattgccagctgccctgtgtagagattcctgaacacgcagtgtttcttattaacccgccagataaccagaaaatcagtctttgggcaagcgcttgcttctccacgtgcccagtattttctttctttctttttatttttttaatgagacagggtcttgctctgtcgcccaggctgggctcgaacttctggcctgaagtgatcctcccacctcagcctcccaaatagctgggactacaggtgtgcgccaccatgcccagctaacttttttttttttttctggagagacagggtgttactatgtggcccaagctggtctcaaagtactgggctcaagtgatccccccacctcggccttccaaagtgttgggattacaggtgtgagccactgtggccagctattctttaatttactagcgctgactacatgcctgtgatgtccccaggaccctgcaaagttctgggaaattcatagtgagcaaaacacagtccttgctggagttcacagcccatggggagacggcaccaaccctgtgcccagactaggggagctgccacgcagccactcactgagctgggcacacaggttcccatctcttatgaggtgaggcaggaggagcagggagggagctggggaagtggcatcagaacattttttggaagagagaaaggaaaggtttccaagcagaaggaacagcctgtggcgaggtccgaggggaaaggaggggaccctgttctctggggacactaggggaacgtcagcatgccaggtcagggttctggggagccctgggtggtcttatcgatggcccccaggaagccacagaaggcatttgagcagggaacgccaagctcacggcgggctttggcagggcgcgccccgtgtcctggaggactgtgtcctggtcatctttctaggcccccactgcatgcccttgaggactaggaagggtgcctccttctctgcatcaggctgactcctagcagctgccgtatctccagctttcctgctttcaactatgctttttgtctccttttcctcattgcgagcctaggcctgtatggggtggtggagtgggtgggagctcactgcttaggtgggtgggcagtgtgggtggtggtggttccatgggtctctccctcccactgtcccatctttgccactcatctgctgccccccactcccggaccccttttggaggtcagtctcactctgtggaaaccctggcttcctggttcgagatgccccctctggcccacgtgtctgacatcacgtaccagaacactgtggccatcattcaggattttttatgacacagtagtgaatcaaagcctgtcagtgggaaagtgatggggaaggattaagtgtctgagaacatttgggaaatatgaggttagacctggttctcaaacttatgaaataagtgaaaacatgaacgttcactttgggaattctgcaagattctcctttaaatggagtccatgaagagaacaaaatgaattttctgcagcgttacgcaggagcacttttctggaaatgaggtttcctaggactttgtcagcccttcaaagcctaggtctccttactagaggggaagaaatgagattttatttatttttatttttattttttattttttgagaccagagtctcactctgtttcccaggctggagtgcaatggcacaatctcggctcattgcaacctccgcccccagggttcaagcgattctcatgtctcagcctcccgaatagctgggattacaggtgtacgtcaccacacccggctaatttttgtatttttagtagagacagggtttcaccatgttggcctggctggtttcgaacttctgacctcaggtgatccacctgctccagcctcccaaagttctgggattacaggtgtgagtcacccactggccacaaacttatgaaataagcaaaaacatgaactttaactttaggaatctacaaggttctcctttaaatggagcccacgaagagaacaaatgaactttctgcaaatgagatgtcctaagaccttgtcagcccttcaaagcctaggtctcattactggaggggaaaaaataagattttaaaatatcaatgtttagccagactcagtggcttacccctgtaaccccagcactttgaggaggctgaggtgggaggatcgcctgagcccaggaattcgagaccagccaggacaacatagcaagacttccatctattaaagaaaaaaaaaaccatcgtttacttttaggagtaggcattacatttacgtgcttaaaataccaaaggtacccaagtgtagatatgaaagactttcccacccccaagtgagtgcccagccccttaatttccctccctggtatggatactaccagtatcttatgtttgtagaaccttctacagaaccttgtgtaggtagaagcagattctatgcatctatgtgtatctgtgtatttgcagtgactagattgattgctgttgatggacatattctggggaggtgtttttacacttccattactgagcacaggctcacaggatggcactttcccgcatgcaccaccatgcctggctgatttttgtatttttagtagagacagggtttcgccatattggccaggctggtctggaactcctgacctcaggtgatttgctcgcctcggcctcccaaagtgctgggattacgggcgtgaaccactgcgcccagcctgttttttgtttgtttgtttgtttgtttgtttgtttgtttttgaatagagacagagtttcactgtgttggccaggctggttttgaactcctgacctcaggtgatccacccacctcagccttccaaagtgctgggattacaggtgtgagccaccatgcctggcctcaatttctcccttttctaagccccccacctctgtttttgtcccatggtctggtcctgtcggccttgttgcacctggcagtcagggttgacttatgatttacttgaaccatccctggagcccctggcctggtgggggatgctggtggcagaatgaattcgggtctgaggtcaagcatgtgtctgtgagagtacacaaaatgaactgtgatgtagcgtttactgtgccacaaacttgaaatgcatcatcttgattatgtccagagaaaggaagtcatttgaccacagccacacaggttacaatggggatgcggcctggagtccaggtgtgagctaccacacccagcccacatacactttaaagatgagcaaatccaggctgtaatcccagcacttagggaggctgaggtgggaggatcacttgaggccaggagtccagtcaggtttgggaggccgagacaagaggatcgcttgagcccaggagtccagtttaggtttggtaggctgaggcgggaggatcgcttgaggccaggagtccagttcaggtttgggaggccgaggcgggaggatctcttgaggccaggagtccagttcaggtttgggaggccgaggcgggaggatctcttgaggccaggagtccagttcaggtttgggaggccgaggcgggaggatctcttgaggccaggagtccagttcaggtttgggaggccgaggtgggaaaattgcttgaggccaggactccagtttagacaccactgtttgaagcgtcttgggatgttttcagtaggggacttggagaagtgatggaaagaggctggtgggtggggcttaggcccaccacccctttctagccagagaaccctccattcatcgaaatgattctgttgttggaaatgaaacaaaaaataaaatggtcttaggaccttcctgtgcaggaaccatggccgacctttccctttttgtacaagtgatctatttttttcactagcaaaaccatttaagatttctatataggatgtgctgtttgattagtttgacagataatcccccaagaaacatcagatgaactcactctttggattaaagtttgagataataaaacaagaatacttgtgttgctgatgtggccagcccaagtatgtttttcccaccagcccagaggttctgggggcaggaggcatcctttgcaggcctagaaggacccaccctgtgggagcctggccctgtgcatctgcagagagcacttgctggaaatctcagtgggaaatggtggggatgcctcccatacccccactttaaaacaaacaactgacaattacacttttttttttgagacagagtctcgctctgctgcccaggctgaagtgcggtggcaccatctcagctcactgcaacctccgcctcccgagttcaagcgattctcctgcctcagcctctcaagtagctgggattacagatgcacaccaccatgcccagctaattttttgtatttttagtagagatggggtttcaccatgatggccaagctggtttcgaactcctgacaattatactttttgagacagggtctccctctgtcacccaggctggagcacagtggcttgattatgactcactgcagccttgacctcctgggctcaaacgatcctcccgccttagccccccaagtagctggaaccacaggcacccaccaccgtgtccagctaatttttgtattttttgtagagatggggttttgccatgttggcaggctggtctcaaactcctgggctcaagcgatctgcctgcctagacctcccaaagtgctagaattacaggcatcatccactgttcccggcccacatacactttaaaggtgaacaaatccaagccaggcatggtggcttatgcctgtaattccgcactttggcaggccaaggcgggcagatcgcttgaggccaggagttcaagactagtctggccaacaaggcgaaaccccctctctactaaaaacataaaaattagctgggcatagtggctcatgcctgtaatcccagcttctcaggaggctgggtcttgaaccctggaggtgaaggttaaccagtgagccgagatcacaccagcgcaccccagcctgggcgaccgagcaagactgtctcaaaaaaaaaaaaaaaagatgggcaaatccaaatggatctctggtgttatttaaatacttatttgggaaaaaaattttcccactatttctgttaagcagacagctggttacatggtagttttttaattttgtttttaataacatctgaaatgcctggcagaaagtctggagttgggggcagagagaaacttaaaatgttaggagctttgccctttgaggagctgtcagaattggagaaaaaacatcccagaaattgtaatcagtgaggaaaacaggattccagctatccacagcaccccagctgtacaccagcgtcacgggatgagggatgcctgtgtgcacgtaggccttggtttctgagctgagacagcagcagccaggccgacttggtgataggcttggcctgcccctgcagtggactgcctgggcctgggcctgggccttggccttggtctcagccctgtggtggatgatctgagccttggctttggccctccagtggatggcctgagccttggccttggccttggtcctgccgtggatgacctgagccttggtcttggccttggtcctgcggtggacgacctgagccctggccttggccttggccctccagtggatgacctgaaccttggccttggccttggccttggccctgccgtggatgacctgagccttggtcttggccttggtcctgcagtagacaacctgagccttggcaattggccttggccctccagtggatgacctgagccgtggccttggccttggttctgctgtggacgacctgagccttggccttgaccttggccctccagtggatgacctgagccttggcgttgaccttggcccgccagtggatgacctgagccttggcgttgaccttggcccgccagtggatgacctgagccttggccttgacctctgaagctcttctgtgcaagggtggggctcctgttggtgacacccacttgctgagtctacacctgggaagctcttggtcagctcggcccattgacttgagagaggaatagttgccgtccagcgagtgctgggggtgtaaggtggaccgggccacacggctgccaaggggccggctgggtgggactgaaacctgacccatgtgggtcctcattgcctcctgacatcagtcatcctgtgatctcttagaaagataaaaacacattttctgcgttctggtgcctctccttgccagacattttctcagtaaagtttctgtctcagcctcgttggaagtgccaggttctgagcccatcagtttgctgctagcctgccagcttcccatgacctgggacctgggaccaggggcccgcaggtgtttctagctggagaggagttctagatagttctgagcggataccctcctctgtcttcctcgggagagttctggcttggtttggtggtgttttctgtgaccagcagtggccaccgccaccaccaacccctcttccccctcccctcttcctccccctcccccctccctcctcctcctctatctccatacgccctgagactggccagtgggcagcatattgtgcaagaaacagctgttgttttgacaaaggacataactcgcctcacttcttgcatcaccagacccacgaggctctggattccaggcctctgcccctgcaggtggacacacagaccgtaacgcagaggctcacgtgtcccacactatgcattaccatttgtgtacgcactcgttcacatttagcaggattgtaaaaattaatagttagtgcagttcttccagctagataatgcatccaaatggcaagacagtccaaagatacacactatggagtaagtccctctccccaccggcccctctggagagagccaggcacggtcacaagtttcttctgtatccctctggagataatcacagcctatgcgagcatatggatggatattcttttaaacattgtgttgcggtttgctttttggcttggatgtatctgatgattatcatatcccttacaatacaccgtgtttttttacattacaggaaaatctgtgaggggctaaaccgacagggtattgctgggcatggaggaggttgggtccaggttttttgctctttgtgactttttaatgcctttcagatgtgacgactctccatacgccttctcacacgtgacccgtgactcatgggccgaggcctctgcatttgggacccccacctccacctccccaagatgcatttcattcccttgttaatgtgtcattgtagttgacgctttgaggataggcaggcttggtagataataaaacagtatttggcttatgtttaatcgctgtctcctcccacagcccgagaacgccttagcgtccttcagaaaggatttggtggtactggtttttatgtgtgtgtgtgttgttttttaaaaaaattttctccaagggacctggtcaaagatttcaagccttaaatctgatcaacccaatctggggcggcggcagctcagtctctcctcctcgctgtgccaatctgtttctgtggtggcgggtggcggctcggtgttaaatttggagacccccgtgggtttcccatgccgacctgcatatgtctgcgggcacggggaagggagggccgcagacccccgttgagtccccgactgccagcagcaagttgccgcaggcgcactggctctgcagccccgggatcaaggtgggttcaccttgcaccgggccacctgtttcagtttcctcctccaccaggcaggctctctgacagatcagcccagggaggggcaggtggggaccgagggggacggagggggcccacagacccccggctcatctggcatcttccccagcgtttcccacacttgacccactagatgagaagttgggggtcggggctgggaccccaccttcatacctccagcgcctgccaactcaaagacatcggtagatgcccaccgattgggtaaccgcccccagcacccccaccctgctaggcttccatgcagtgggggaagtagggacccccggccaaaagcagtcatgttctttttgtttttctcctaagttttctgcgtctgtgtgcgattggaacgaaacatcaactctttttttttcttttttgtcatatttcaatattggctttcttccccgccttctttcgaaggctccttttataacttcggctgctgctgcttaaatatagatgtcaaagccctcctccctccagattgtttatatttttgaagagccttctgcttcgctgtgactgctcctctcttatctgtatcccccgttccaccacattggtttcggttgctcttttttttttttccctgccttcccttaactgggatgtgtttcaaatgtggtctatcaaaatgttcagtgtttcccttttttctgcaatagctttgacatctgttcttgaattctagcccacgttattccttaggacttgtttgcccaagatgtgcctgaatgccagaaatactaaggggagaagagtgtggtgtggtggtatcttcccctcattgcctggtttgttgttttattgtcgttgttgtttttttttctttcctcccctgctttttaaagtgtctacgattccttccttcttccttccttccttccttccctccctccctccctccctccctctttccctccctccctccctctttccctccctccctccgtccttccctccctccgtccttccctccttccttccttccttcccttcttccttccttccttcctttcttctttctttcttttttcccttgggacacctcactcatgcccaggctggagtgcagtggcgtgatctcggctcactgcaacctctgcctccccggttcaagcgattctcttgcctcagcctcctgagtagctgggattacaggagcccaccaccatgcctggctaatttttgtatttttagtacagacagggtttctccatgttggccaggctggtctcaaactcctgacctcgggtgatccacccacctcggcctcccaaagtgctgggattacaggcgtgagccacctcgcccggcctgtccatgatttgtaagttgacagcatgatttcatcccatccggcatggcccaccccgtagtagtaccaaggaagcatttcccagcaagaacttgtaacgtgtaggtttgctggttaacttccgccaaggaggaaagcctgtgggacttggtgagctgggtggtggggggtggagaaggagaggctctagtgtgcttcttggaggcgtggggataaatcttcagctttgatttttctcgccgttcagctctgcttggactcagggtgatggtcccaaccgtgagaagccagctagagcagccaccttggatcccagcagaacgggccgctgtgtgtctttagttgccaaagcgactcggcaggaaaacaggccttttggtggcgacagcagtgtgtccttgggcgcctgctgtcagcctggaacaccattctggggccatctgctgcaggcttgttggaaacagatcctcttggcagctcttcccagaatttctgaggccagggcacaggttctctggcgcgttgattatcggtttgttgcggggagcagagcccagagtcctcagccccctagcgggtccctcatggggaacccactcctggtggtcctcagcgttcccgcgcaagtaatgtgatttgagaataactgccaatggtgcctcatttctgaaaagtggttggaaataattattcttggaatttaccttttaaaggtccctcttgaaaactaatcataggttaatggtctcgaacatgatgcttggcctagagtgagctcaccataaacatttgttgaatgaatacaaaccaagtattactctcagagatcccaggcccacagcattgaaggacggccacacggaatgccccgaggaggggatagatcagcagaaggactagagctcaggagagtggctggctggaaggaacccttgggaagaagaggcgtggagcaacttggggaggcgggtgctttgggcattagcctgatagttgtggctggagcaagaaagatgtttctgtgtattctgttatgggaacagagtcatttatggcgtgcacattgaggcacgacccatgatgttgaacgagcttggttttctcaaccacttcacatgggacggacgtgggatggggggataatgttcatttctctgccttcccgccaccctccagcccctcctctgccaatgagttgatgttccttagagccactggggtctctcccccagtgttctggtcaaatgcaaataggaccctcctctagtacacagtgcaattacaatctcacttttcctttcctgtttccccaacagagagaactcgatgccaccgcaacggtattggcgaaccggcaggatgaaagtgagcagtccagaaagcggcttatcgaacagagccgggagttcaagaagaacactccagaggtgaggcgcgtgaccatcgtgttcgctttgaagggatcttagaatgctggtgcatgttcaggcgacgctccgtgagcgtttcattttcatcagatgaacgcacggccggcaaacaacccgtttctttccccagatgtcttcagccccatttccagcagaacgcatgccatcctgcaggctgtggggatgtggaaattgataggttgtctggaaatatgaaagtcagagccaattccaggtgcagatactggacaagcttggtctgtaagaacacgtgggcaggtgtgtgggtgtctcagaccctcgagctcatcccagaccctgtcccatgtcagttagcaagccaccaaagtccataagggatcctgtggggtggaaggtccgcggggcctgcttccctgttgctggtgcaggcggagtgtctgaaggctgcacgcatctgggcatagcagtgcgcctaacgcttcttgtaaaacagacatttcgcctgctaggccttttaaatgcctctctgtttcttgaaatatgccgtaaagggcaatggaaatgtgctttttatatactcctgttttttctctcgtgagtgtgcaatcgggggacagtgttgagttgctggggtggcgtttttctgctcgtttcctggccccttcttccttcccttcaaccctatcaggggcttactaagaaaaaaaaaaaaacatccaagcgtgttgcaggcagatgagcagtcgcgggaatggctttccgggtgacatctgccagtttggtccccatggcgctcatcccgcgggctcggaccccagcctctcttacatcttccccttgtatgggaaggggtcgcagcagcccacagcttcggcccggcttccgggcttggggaatcttctccgtatcgtagctcttggctcctccatataagacataggaacatgcctggaggcaaagctcctttctaggagagatgcccctctcttacttacataatattgctgggaaattatatgtgaattgcatttttaaaagcggactcatttaaaatgtttcaaaagaggcttgctagtcaagggactgctggcatgaatcattatggaaaacaaattaataaccttctgtcttcagaataaatattttaggagaaagcttggtagcagagtagaaagaaggcagcctttggccacagagccagctaagggttcaaatctcacacccgctgcttgcctcggctgcccctaaatgtgggtactccatgtttcacgagaccaaaaatgcaggtgggagtcactggtgcttgggggtttctgccttctctgccagtgttggggagtggggggccctattctccatgtcagccttgccatgagtaaaaacaggaggaaaaaaagagctggggacagaacgtccttcttctgttgcctccagcggcttcagagcagactttcctggaactccggtttcctgagcgcttgtccttgactcagtttccccagcccaagccccgccacatccatcgtgctagctcctcttagtgccgttcctgtagctagtggtcacccaccgttctgtattgtcactgccctttcctcggtgaccatatgtctgagggtttccatagaaaatcttagaggtttggctgggcgcagtggctcacgcctataatttcaacactttggaaggctgaggcaagcaatcacttgaggtcaggagttcaagaccagcctgggcaacataacaagactcatctctgttataaaaggtaaaaagaaaaaagaaaacgttttgtggttaaaaacaaacaaagaaacaaaaaaacccagaaaatcttagaggggcaaggccatccttcagaggccacggacaataaatacacgagtgtattcagccagagaatgaggttcctaagaggcctggcttcctgggtgttcctcagaagtccccaactcctagtgacagtggaggaggagcgtgtcccccttcggtcaccctgtccgttccttatgctctgctgataaatgccgcttgtactgcactgagccctatccctccatcgtgccttgtgtcgaattccacattagttactcaaagacacctggccttaaacttggcgtttttatctccttctgatcccaataaatggaagaggcttggggaggcggcagcctggtaggtacctgccacttggggcatttcttctcaggacacatttttagactctgtcttcatggagaaaggggctagaacccaccaggaaggggaggcagatgatggaaggtcaccacctgcttggccctgaccccgccactgccagtgggtggagggtggtgcccacttcctcatctttggctgtagtaacgagggtctcactgcagcatgcggtcctggggaggtggggagaggggagctggctgcaggctcctgccccgccagccctatgcactttctcatccaaggaccaacctggaaatctgtggggcgcccacgcggaaagtccaagacgagacccacttcacttgtgccagcagccagagcttcctgctggtaactttttttttattttttgagacagagtcttgccctcaggttggaggaccacccaatcgctcaggttggagtgcagtgtcacaatctcggctcactgcaacctccgcctcctgggttcaagtgattctcctgcttcagcctcccaagtagctgggattacaggcacatgccaccaccacacccagctaatttttgtatttttagtagatttcactatgttggccaggctggtctcgaactcctgacctcaggtgatccgcccacctcggcctcccaaagtgctgggattacaggcatgagccaccgcgcccagccctcctgctggaaatgttgaaaccacataagaccagaacagtggtgggagtcgggggctgtggccggagtgtgctgggtgtgcaggaggcggagttccctgctgttccctgtgacagcaggtgtgtgtgtgtggggggggagctgtgacagtacgtgtgtgtgtagatagcacatgtgtggagcctcagctcagtgcctggcctgtgtcccaaggggacactgggtcaccgtttgtttggggtctcagtcttgaggagccaccactgccctgacactggttgctcctctggccacaccgcaggattgattactaaccgtggaggtgacgtcgggttgttgcatgtgtagaaacgaggcttgcttagagctttcgcccgttgggtaggacagcctggcttaccgggaggagggtatcctcttccctatggatgcagcccacgatccccatggcaacataccttccagggcacagcgtggcagagccagggctggtggtgttcctgctggtgtgacaccaagggtgttgatcttgatggaaacgcccacgtctctctttgttctgggaaagaaggaaaggtttcctggtgtctgatgaatgtctaatgtgttccacagggaggattaggcacccgcgagggttcagtggggagtaaagtttgtctgccatcggagatttcaccttctagactggcccttcccagatgtcactgggaaaagctctagtccaggagggaaaaggtgggctgtgacggggaggtggccagggaggggtgctgtgtggtggctgggactctgacaggcgggagaagccacaggaacatcaggaggtgagcgccaggatggctggagccttgaagggtttttctggggacaggatcctgctctgtcacccaggctggagcgcagcggcacgatcacagctcactacagcctccaactcctgggctcaagtgatccctccgtctcagtgtcccgagtagctgggattacaggaacgtggcaccacagtgcctggctagtatattttattttattttatttttatgtgtttttttttttttcttcaagtgtcttgctctgttgcccaggctggagtgcagtagcacgatcttggctcactgcaacttccaccttctgtgttcaagcagttcttctgcctcagcctcccgagtagctgggattacaggcatgcgccaccacacccagctaatttttttgtatttttagtagaggtgaggtttcaccatgttgcccaggctggtcttgaactcctgaccttgtgatccacccgcctcagcctcccaaaatgctgggattacaggtgtaagccaccgcgcctggccgtagtttttaaattttctgtagaaacagagccttttgctgttgcccaggctagtctcaaactcctgcgctcaagcagggtcctcccactttggcctcccaaagtgctaggattacaggcacgagccactgcgcccagttgaaggttttctgtttagaattagttttttaaagtttcagttttatatcattagattaatatatttgccatcatatgatattgtgtctttttaatccagaaattgtagttaatttgcagaagattgcagttactctgcagataaaattgtatacgttttctttgaatctacaaaaagagtccctttgaaagaaaaacatttttaaatgttctaactgaacatccattccctattgaattaagaatcaatcgtggaacataataggcggtggagtgtttctagggtatattgctttctatatttttgttttttttggaatatagtggcacaatcatagcttactgtggcctcgatgtcctgagctcaggcgatcctctccttatagcctccagagtagctgggactataggtgcgtgccaccacaccctgctaattttatgttttgaagagaccgggtctcactttgttgcccaggctggtgtcagactcctgggctcaagctaaatcacccaccttggcttcccaaagtgtcgggattacaggtgtgagccactgcgcccagctctgatttttgtatttcttacttaaggcgacatacttagtagctgtgcgtcttggggcagatacctcccaaagccccagttctgtcatctataaataatgtaacaacagggccccgctcgcagggttgctgtgtgcacatatgtgtgtgtacgtacccatgtgcctgtacgagaagggctgcgcacaggcctgtccctagagtttagcttatgttcgttattagcattaacctgggaatactcaccgtgtaactcatgagatacagtggatttctgttcctcagagctagcttggggaatttctatgttttattttattttatttatttatttatttatttatttacttatttatgaggcggagtttcactcttgatacccaggctggactgcagtggcgccatctctgctcactgcaacctccacctcccaggttcaagtgattgtcttgccttagccttctgagtagctggaattacacgtacccgtcaccatgcccggctaattttttgtatttttagtagagacggagttccaccatgttggccaggctggtcttgaactcctgacttcaggtgatccacccgcctcggcctcccgaagtgccaagtggcatgagtcaccacacccggccttagctcgggcaactttaaaaaaaaaataacaacaaatataggtagtttcagcttaaagtgtttcaaaagttggtttgtggccagacacagtggcttacgcctgtaatcccagtgctttgggaggctgaggtgggaggatcgcttcagaccaggagtttgagaccatcctgggcaacatagtgagattccatctctacaaaaaaatcaaaagattagccaggatggtggtgtacacttgtagtcccagctacttgggaggccgaggtgggaggatggcttgagcccaggaggttgaggctgcagtgagccatgatcataccactgcactccagcctgggcaacaaagtgagatcctgtctcaaaaaaaaaaaattggtttgtaataacaattaatcatcttacaaatatttattgaacaccttccatgtgccagacagtttggccctgggaataaaaccctatctccattctttaaaaagtttcttatctttcttagtaagcaaatagaacccaatggcagagcgtgttaagtgctaggatagaatgactggaatcttctgactgtagactttccccacagaaacactcttatgtcagtggtgataaagttctctggataagccacatatggctcagtaaccctttttatagataaacagttctgctttttgagccttggttcttaacctttaaaatatccatgaaagttgaggacctacgcacctgggaaatgcacgtttgcagtttctggggggctcccagacactcatccatgcagccttagtttagaacaccagttctctgggcccatagtcccagtttcagctcaccattccaggagaaccagtgggtcacctctactctccttctcctccttgtgtcctggggtggaaggggatgaaggagggaggaggggggattctagagctttggggtgggtgacagatgagtaccaaggcctgaccgctgggcagggacagggtgtgcctggccttgggctgggtgctggggagtgggagatgggtgaaggagcaaggccacctgatgtgacaaggggctccacgggctggcagcaggggcagcacctctgcactgggctggccacagcatgtcaggagggagcagcagcagctatctggaagcctggtggtgttagaatcatgtatgtgagcagtggaggctgaaagcctagctctcgcaaaccccagaaagtgtctcttagcttttccgtttgccgtttgcttttccatggctttgatcgcggtcaaactccgatttcccgcgtgtgtgattccagagttcttctggaggcgaggttacgggaggtctgcagcatgtctgacctgcagccccggctcactggcctggctgtagggagttagtggatggagagtggctggacagtttggagaccaggtaacccagcgtggggtcctccctggagaaacccccagtgctcctgcgacatcggcctggcttcagggctctgctatttgaatgtgatgctcaactctccaataaatggtcgtctgtgttaggcttgcttccagaaagagctcagggatggttttgggttttgttctgcttcttttcaatatgggaggaaccttctctgatgggagaaaagagaggaggagaaccacattcctgagatgctgtgattttatcatgaaaccatccccagccctcatcctggtgacgtcagtcggcccagtcctactccagaacgcttcttgggtgtctgtctgcaggactttgctcagttaatttttgtctcctctaaaacagaccccgttgctctgggaggagagccgagctgcggctcaggggccgtcactggtcatttttgccctgatgtatttttgcctctacatttcttgatctctggaacgttaatcccaacgatgcctggtctgcggtgctcacagtctgtgtctgtgctttctacacctgtcctgctcagatgcacatgatgtcacacccaggtctccatcctggctcttgttggctgcggcggcagccctgactgtcggagacgcctggctcagcatgcccaccttgcaacagggagcaccctgtgctgctcacagaactgcccatccactttcttttcctttcctgggtgccaacatcttcctctgccccttctacgccggcctggcgcatttctctgatttctgtgttcccgggtagcagttgtaaaaattcaggcttgggagttgtcttgagataggacttggaaaggaatcttttaccatcgttgaaattggctagatttgtggattccttcccgaccctggcaggcacggtgaggggaggaggtccctcctttttattgatcaggatgcactgtgtgcggggtaagccaggaagccacgcacctgatgctatctctgccatggggaggaggacagaggatgggaagatgctgtgaacttttatgattcgtttttcactctcggtgagaaaaggagctagcaggatgggtgagggagtggagggtagtaatatatagttgtggcctgggcccaaacgcatttagtcactgcctcgacagcctttatatagacaccaccagagtgactcagcctggaaaaagagagtcacttaaaaataaagttgcgactccagtggacacgtggtgcacaggctgccctgagatagtcaccagggctccatggccctgcacaccccccaggaccctgggcgagtcaggtggtgaagtgagggtgatcgttgtaaccccatcttggcattgacgtgaggatttagcaaagtcacatatcatcccaattacttttttccttttttttttttttctttttggagacagggtcttgctctgtggcccaggctggagagcagtggcatgatctcagctcactgcagcctcaacctcccagcctcaaatgatcctcccacctcagcctcccgagtagctgggactacaggcgtgcaccaccacacctggttatttttttttattttttattttttgtagagatgggggtctcactttgttgcccgggctgatctcgaactcctgggctcaagcgatcctcccacctcagcctcccaaaatgttgggattaccggcgtgagccaccacacctggcctttgatgctttctaaacatgaaacagcatccaggcatcatcggctactccttgatatgtcagtgttacccactggactctcaactcttctctgttatcaacaaatcttgttttactcctcattagaccctaaaaccactgcacacagaaaagtgaaaagcccagcctcattttcctttcatcacgttgagcccattgagttggcttcattgaaggcccacagccctgatgtgacacaatggggcctttttttgagctagaattccactccgtcacccgggttggagtacagtggctcgatctcggctcactgaaacctctgcctcccaggctccagcaattctcctgcctcagcctcccaaatagctgggactacaggcatgtgccactgtgcccagataatttttttgtatttttcatagagatggggtttcaccatgttggccaggttggtctcaaactcctggcctcaaatgatccacctgcctcggcctcctaaagtgttgggattacaggcatgaggcacagtgcctggccaaaagtagatttctatagagatagaaacccccaggggtgaggggatagaggaatgaggaatgactgatagttggtatgaggtttctttttggaatataaaaatgtcctagaataagacagtggtgatacttgcacaactttgaatatgccaaatgccactgaactgtgtactttaaatgggtgagttgtatggtatataaattatacatcaataaagctgttatttaaaaaaaaaattcagccaggtgcagtagctcacgcttataatcccagcactttgggaggctgaggcagatggattgcttttgctcaggagttggagaccagcctgggcaatatagtgagacctcacccctacagaaaaatagaaatattagctgggagtggtggtgcgtacctatggtcccagctactcagaaggctgaggtaggagggtcgcttgagtctagcaggagattgaggcttcagtgagccatgattgcaccactgcactccaatgtgggtgacagagttataacccccgtctcaaaacaaacaaacaaacaaacaaacaaaaaacctaaactaaattaaaaaagaattcctctcttcatgggggtgtcagaaacccccgaagagatttcttattcagttgttctctcatcctctaaagaaactccccacagaaaagtatcttgtgaattttcatttttgcagggggcagtttggttttaaaaagtctactccaggatttggcaaaatgagaaaaccccagtaatcaacttgtgtgtttaatcattctagaatcacctactgttaagttataataagcctttaactagaaaaagtttaaaaattaaaagtgaacttttaactgttaccaattaaaccctttaagccagtttatcaacccaagacattattttctttcttttgggtctctaggggagaagaggtgccttgagtgggaccagtaatgaaggcaatttgaacctaattcgggccccagtcagggaaggtggctgcattatccccctacatcccagcaagactttgccgcatggtctggagggcaccagcaggggcctgtagggaagaggaggttgcctgggcccagggacattgaatgctagtcaagccctggtttcatttgctccaacagcattaatagtattgtgacctccatggcactgtgacagaaacttaaccccagtttcttcgtctgcaaaaaacataccctgcctacttcaaggggtcctggaggctgaatgtccagtctcaggccaggagtagaacgcataactagtaagtggtgacgtgcagtgaccttgagcaaggtcaaaaactgttctaagacttggtccccttatgtataagcaggaagaattggtgctatcccatttcacccaggaggtgaaatgaattcagatgcacagagcatatagtaggtgctcaacaaacaccctcctctcttctttccttccttgctttcttttacaagtagtcctgagcccttttctagggccaggggcagtcagatacagcagggatggagggagaagattccagatctcacagagatctggcagtggccaagtaaacaaatgatgcacaagataatttcaggtggcggtaagagctcagacagaacaagatggcagtgagtgatcaaggatgggcgaaggtactttggggagtcagagaacgtgttttgatcttaagaatgcaaaatgactttttgtatcacctgtcaacacaacacacacacacacacacacacacacacacggaggctttagtgcaaattttgaaataaccattgattaattttggcaagctgttagcagtggagtcccccacatttcttccatgtaaagccctgatcatcttggctgtaaccactcacttactttgaagcgtcagattcagtctctctgctttctaagaccagggatgctatttaatctgggcattagaaaattcagttggccaagtgcggtagctcatttctgtaatcccagcactttggaggctgaggtgggaggactgcttgagaccaggagtttgagaccagctggggcaacatagcgagaccccatctctacaaaaaaatgaagaaattagccgggcgtggtggtgcatacctgtaattcaggaggctgaggtaggaggatcccttgagcccaggagttcaagactgcagtgagctatgattgcgtcactgcaccccagcctgggcggcagagcaagaccctatcttcaaaaaaaacaaaaacacacacacaaaattagtcaatgaattgtggagtttcaaagagaccttattttgtttgtttgttttctgggccaaaggcccagaaattcttaggtaattcttcggtaattaattcttaggcaattcttaggtaattaacgaggagctaatctcccagttgctctgttccttgtcactggaagtggtcagagctgttgcggggcttggcccaggggcggcgggtggcatctgaagaccccgcaggccctgctttccttccgggagcatctcaggacggccgctttgtctgtctgcccccgccccttgctgaaacgtcaacaaggccggcatcccctttccttcctgagagccatgtgtcgcttccttcatgtgtccagccgtttttacagggctattttaagtataaaagacgcattatctgagagtttaataactgtcaaaagggaagcactgtcattagattcatgtgccctggaattttagtcaaaaacatgctgcgttctatcacgtctaagcctctattttcttatctcaaaaaataggaatgataacgacctcggagtcattatgggctggatgaactcttatagggattcagaacaacccaggcaccaagtagaaggtcaataaatggcttattgtgttcatgttaccaaaatctactcttttgagaaattgtgttcacaaatggccttttttttttcttttttctttttttttttttgagatggagtctccctctgtcacccaggctggagtgcagtggcgcgatcttggctcactgcaacctctgcctcccaggttcaagtgattctcctgcctcaacctcccaagtagctgggactacaggcacctgccaccacgcctggctaatttttgtatttttagatggggtttcactatgttggccaggttggtctcaaattcctgaccttgtgatctgcccgcctcggcctcccaaagtgctgggattctaggtgtgagccaccacacccggcctcacaaatggactttttttttttttgagacggagtctcgctctgtcacccaggctggagtgcaggggcgcgatctcggctcactgcaagctccgcctcccgggttcatgccattctcctgcctcagcctcccaagtagctgggactacaggcgcccgccactacgcccggctaattttttgtatttttagtagagacggggtttcaccgttttagccgggatggtctcgatctcctgacctcgtgatccacccgcctcggcctcccaaagtgctgagattacaggcgtgagccactgcacccggccacaaatggactttaaagttataaatgtgacggagggcagtggctcacacctagaatcccagcactttgggaggctgaggctggcggatcacttgagctcaggagtttgaggcaggagaatcgcttgaacccaggagatgggggttgcagtaagccaagatcgtgccactgcactccagcctaggctacagagtgagactccgtctcaaaataaataaaaataaaataaagctataaacgaacacttaaaaaaattattaaagcctagggtagaccctagtttctactgcggacttgaacagatacagtaaaattaaaacttgccttcttccatatgtgtctagagagtaattttctctccttttgcattagtttcactgttcatagagtggaaatgtttgctgctggactttcttttttgaagctattctttgagagtagcccataacttgtctttctggtcaataacctcaactgaaatgcattctgaatggagaacgtcattctgtgtaggatttaataataacttcagcacagaaaagcactctctgcctcttctcagcaaacaactttgttgagcatgattttaaaggtgtaacggctaaatgtgaaagccatatgatttggttgaaatcgtggtgagctgttattaatatttattgagtacttgctaggagtcaggcattatgctaagtgcatgaccatcatttctctgcccctggaagtcaccctgggagctaagtatcatcggtgccacttaatgaagcgtaagccacccacccacctaccaggattttcccgggcagacagactcctgggaatgaggccatataatcccctgaacaccctgcctccttagggttccagaagccaattttttttctttttttgagacagatttttgttcttgtcacccaggctggagtacagtggcctgatctcggctcactgcaacttctacctcccgggttcaagcgattctcctacctcagcctcccaagtagctgggattacaggcaccaaccaccatgcccggctaatttttgtgtttttagtacagatggggtttcaccatgttggctaggctggtcttgatctcttcacctcaggtgactcacctgccttggcctcccaaagtgctgggattacaggcatgcgtcaccacgcctggcccagaagccaaatttttagtcacttaaccattagcaattcctcttctattagattttttttaaaattgcttttgagtatttctttgaagtggcatactcatttaaaggattctatatgtcagggggaatgttttctaggagggtacttaggaaggaacatatcgttatagcctaaaatttgccattggcctgtgaaagccttcttaacttacggaattgattataagccaaagcgtgggaaaatctccccttccactttgagattatgtcagtcaagaaaatgacaattggataccaagccatgctaactctgatacttgctgtcttcgttttcttctttctttggctagggggatggagcgcgtgtggtgtgggtgggactagtcactgagcatgttattgactaacattggcttttcattttaacttgcaaatgtgagtggcataaaagtgagtttacgaggagcatgactggcctgttatgcagagtcttgtaattttgtttgtggccctttattttaagaagatgttgtgttatatagttggtgtccttaaaggagtatataattggatctggaagcttagattgtgattctgacttggccacttaatgaatgcaagatctgagcaagccatgacctctctgttgttcagtctaagaaaggaggtgttggtgctgagcatggtggctcatgcctgtaatcccagcactttgggaggctgaggcggacgggtcacttgaggctgggagttcgagaccagcctggccaacatggcgaaaccccgtctctactaaaaatacaaaaattagccgggtgtggtggagtgcacctgtaatctcagctattcaggaggctgagacggagaatcacttgaacctgggaggcggagattgcagtgagccgagatcacgccactgcactccagcctggatttcagagcgagactccgaggttctgtgtggctgagagccacacattttgcaacaagagactcgtcccttttccataggtgtccttattcctattgatcttacctgtgggcccaagacttaggcacatccctttcttcttaaaaggcatcacctcctctgcctcttggagttttcctacccagaattcattcatgtgtgcagcaaatattcctggcagtcccattgtgtgtggaatggggtaaaccaggaagactgttgtgagggctcagtaacttcagggacacagccgtcgtagcttataatggcagctgatatttagtgagcacttactgcatatccagtactattctaaacactggaaaggcatttaactaacttaacactcacaggatccctacgaaacaggtacagtgtttatttctgtttcaaagagagggaaactgaggcccagagaggaggagtaacttgcctaggcccacaggtggcaaagctgcctgaaggttttttttgagacagagtctcactctgtcgcccaggctggagtgcaatggcacaatctcagctcactgcaacctctgccttccgggctcaagcgatcctcacttcagcctcccaagtagctggggctacaggcatgcaccatggtgtctgactgatttttgtatttgttgtagggaggggttctcactatgttacgcacgctggtctcaaactcctgggctcagtccctcccaaagtgctgggattataggtgtgagctaccgtacccctcaggaattcttattttttagatggaaattttaaattggcttttattggaatctcattaaatttgtagatttggagaggctttagaaggcattttcaagttttgattgattgttttagatttcattcataggtgaatttcattctctatattttacttgagggatccacggaaactacctacatggacttcacttactctggttcattgtgtgggatacaaaatcgtcaaaattgaaggattgatcattgtgtctggagccaggcataaaaataaacctcactctgttatcataggtggctgtgattaagatcgagggaaatgtcggccctgggcctcctaacattgacagtttccttcagaagattaagtgcggcttcatttttggcccgggccatcagtagcttaaagccattactgtctattggctgtttggtttgtctgaaatatggggccggcgtcagcctatttccctggggtcaggtgtgttcacataatcaaagtgccaggaacccatatcgcatgcaagcgtgtgtgttcaaattagccttctccagggaggaattcacagcaccaggaatacgcgcagagatgttcttttgcacttttgcattttaaaacgtgcatcgcttacgagcgcagcattttcaagccttttcttgagatcagctcgttcagttacatgtgcttttgaagatgaccatttgtgaaaccatcagccactggcaaagtgaagaaaaatgaagatttcggcctggttgatgtgtgctcggggaaaggtgatagcttctgtttccttgaattaaaagctgcagacaagtatattttcatttattttgtttataaatcaacaacccacgaaaggtatttcatacgtatttaaatgattgctttgccgccatcaagaaaaaatactgtttcacttaacagtgaattgagacaaggaaaagtgatgtgtgaatagaaataaagaaattaaagtaaaaaacaggatcagggtaggttctagggctaataatttaagaacagaacatgtggtttaactctttttgccactctaaggagaggtgatatttgtatttttctttttactgaaaccagatcgtgagacacgcttttcattcatacttgaaacttgataaaatgtttggctttatattaattttctcaattataagtgtgggaaatgaattcgttgataacccttttcaagtaaatgaactgattagaaccagaagagccgagagtcatttttattttaaaattctttttgcatgaacacatgtagtgttgaggaatatgtggaaaattgaaatattgcttctctcctaccgtgtctccagtgcctcgataaatcaccttttttttttccttttaaaatgtctggccttataatttatgtttgcataacccattactaaattcatagtaggtgttttagttggcaggcattattccagggatttggaggagtttaaaaaaaatacagagcctttgttagtatttatactaagtggacattttccttttttaacaacaacaacaaaaaagaattagatttttaaaaaagaattcagagctagctatttacctttttcctagacaaacactattaagtccatattctcacattattcattgtcttaatggagattaagatttcttaatggactttattatagcttttctttctttttttcaaaattagaactggccgaagaaaatgcttctactattaagatcagatgaatttctacagaattttcagtaggtgtcatgttgtataggaaataaacatttctgttttagtaggttttcgatttcttacctcccgttgaccgttttgatcataaagtgaagatgaatacattcattcatttactgcagtctttggtacttgaacagaaatagcagtgttcttggtttgttcgcatacttgtggcttacctttgagactttctaatttttaaccagacatttaaaaatagccattctgtcttttagccctaatttagaaaaacttgtagcgctttcctttgaaatgatgaaaaaaaaagttctttctgttttctatcatcaaagtttaaaaagcgatgtttggatattttaaaagccggaaagaccatgtatggcgtgctgaggaagtttgctttgtttgatcattttctcttcccctcacccccatcagctggctaataatgttttccatgttaaatgtgtatcacagcctgttgaaatccctgtggttaatcagaagagaagttgtttctatcctatggaaccttaatacagttgtcaggaggtttgtgaacagaaattcagaattcatcacactgtaacgatgatctaaaggtcaagttgtacagtataaatttgaaaatctctctctgacttcctttctacctaaattagagcctaaaagtcatgagaattttgtcttctttttgtttattttagagatagcatagtcgatgttttaaaaagttgccaccttttcactataatgcgctcccattatcagagatgtttattctggttgtatctctctgacaaccttcaatacttaacagaataatttagtttggattcaaagaagtgcctcttctatttctgtgtttgtttctagaaactttgaggtggaggaattattgttccttcttcttggcaatgttcagggtttcacgaatctgacttttaaaagcccagctctcagccccgagcctctcatgagttaaagaaagggttttgcagcttttggtagacgagaaacacattttatggctcttcatgaagttgcccgctccgtccacgtcctgtcctcttcctccttcccagtttctgggctccctggctcttgtcatgaggctttcagttttgtgtcccagaaagcgcttcccccggggacagtgccatgccaaggctgggagaagggaaaaaggaggtgtttatcgccttgaagatgccttccagcctttattattaactcccttccaaagtaaactttcgggtttttttcaagtctgttctggccaaagtacagttgggtttgccgtgttctctaggagtagaggtgaaaacagcattgcccggggtgaggagcaggaggaggaagggtccacgtataggagtggatggaggggatctgtgagacagctgctgggacagatccgacttggagactgtcaggcctctgagcccaagctaagccatcatatcccctgtgacctgcacgtacacatccagatggccggttcctgcctttactgatgacattccaccacaaaagaagtgaaaatggcctgttcctgccttaactgatgacattatcttgtgaaattccttctcctggctcatcctggctcaaaagctcccctactgagcaccttgtgacccccactctgcccgccagagaacaaaccccttttgactgtaattttcctttacctacccaaatcctataaaacggccccacccctttctcccttcgctgactctcttttcagactcagcccacctgcacccaggtgaaataaacagctttattgctcacacaaagcctgtttggtggtcttttcacacggacgtgagtgaaagagactgccattcatgaatggacaaggcctggctccgtccacgctttcccagctctgtgtcctgccatcggacatgctggcacatctgctgtgggtgccctgcacttctccgggcactcctggcccagctggggaggttggcatggtatccaccattttgttctaaagtagtaaatgaaactcttgggagggcagcacccagcagatgtttggagctagagacagggctctggggatgtgtaggaacccggacctggtgtggcaatggtgtggggctgtcacgaggcgtgaggaggctggggtggtgttggggacagcacacgatgctggggctcaggccaagtgaagcttggacttcactctgtctgaggctttgccaagtgtcagagggtgcacacttgggagtcacatggccaggctcacatttccagccgaagttacactctacagcctggcagcagatggacgtttggggacagaggtggagccggaacagctgagacactgttttagaggactctgcgagaaacacgctcttaaaacaaggaagcggtggttatgtcttattcaacaacgatctgttgtggaccagctgtgtgccaggcagttgcaggccctgaggctgcagcagtgagcagaaggccaaggtccctgccctcgcggtgcttacattctagtggagacagatgttaaactacagggcaggaaaacactgtcaaggagatgcaggtggaggattctgactgtggaactggggcatagagacagtgggttttgaaagcacttggctgagaaggatgggaggagggaggagggaggagggcgggtacatctgtagatggaccaggttaaggtatggacttccccatcctgacaagggggagccccaagcttgttttcaggtgtgacgggggtggggagaaagagagcattccaagagaggcacgaacgtcatttccagagcgagatgaaggtcacagagtttgggaggagatgggatccggcactcgggctggcgagcagacaggagggaactcagggagatgggaaccccggggaggaagttagggcaggatcccctgggagttttcccggatacataggagaaaaggttatccttcaagggtgagcgggggctaagtgcaggggacagaagagaggaaagcccggcgaccatcatgcccggctgccgtgggtggtctggattggaggcggcagccgggctgtgtttgtgcggagggtggcagggggccagcggaggaaactgcccaggcgccagccctgccatccccaccggcctcctcgctttggggttttgctttctgccctggccacgtgggaccggctaggtggagatcatgcaatcagggttcccagctctcagaaccataatggttaagcaagcagcttcgtttccaggcacgcaggagctcccccgtgtcagcgttttcctaacatggctaatcataaaaacctcctgggtgtgtgtgtatgcttgttaaaaatactgtccctgggccccaccctagacttagtgagacacagtcaccggggaagggcctggggacttgcatttagaaccagctcctggaatgcttactctgaggccagtttgggccccctcccatggcctccctctgtgtcccttcctccagatgctgattgaggatgtgtcccctgccgggactgtgtttgcatgtctctgtctctgtcacaaagtagatgcctggggagtgtgtgctgcgtggccccctgaagaccctgtaccgggatgtcagcaccccagcccccagctcctccccctgtgaaagacattagctcctggaggggctcaggtggtggaaatgaatcttagcatcaatgtttagacctaaaagccatctccaggtcatcatagcacatgacagagatagaggcagaacctggtggccataggattatttctgagcaaagatcgcccaagctttggcataggccagggttattcacatgtccgagtccctggaagtggggtgtgaggaggttgtggggggccttcagaatgagggaaaagggataaatcaaaatcaagtctttttttttttttttaattgagacagagtctcgctctgtctcccaggctgcagtgcagtagcacgatcttggcccattgcaacccctgcctcccaggttcaagcaattctcctgccttagcctcccgagtagctgggactacaggtacgtgccaccatgcccagctaatttttttgtatttttagtagagacggggtttcatcatgttggccagggtggtctcgaactcctgagctcaagtgatccacccgccttggcctcccaaagtgctgggattacaggcgagagccaccgcgcccagcctaatgatataaatattagtagatttctgcttactcacttcaccaccagcattttctagcaaatgtgagttcagcagacaccaaagatttttataaatcaaagtagacagtctttaacgttgagaagattctgttaactcatctgttctacccacactcttgcccttccctcctcacagaaaagccaggagaagggtgaataattgaattacagatgacagtaaatatttggatctagctgcttatgaggccttaatgatatcagtcagtacaaaaggttgatatccatgttttttggtgtgtgtatttttttttttttttgagacagtctcactctgtcactcaggctggaatgcagtgacgtgatcacagctcactgcagcctcaacctcccaggttcaagcgatccttccatctcagtctgctgggtagctgggaccacaggcgtgtgccaccacacccagctaattttttgcagagacagggtctcgctatgttgcccaggttggtctctcaaactctggggctcaaatgatcttcctgtgtcagcctcccaaagtgctgtagttacaggcatgagccactgtgcctggccgatatccaccatgtttggagcctgtttttggttacatttcatcctcatctactggcctggagatattggtgtcaatcagttcttcactgggggaagagatttttttaaaaagtcagatttacactcagtaagattcacccttttcaggtgtccactttgatgaattttgacaaccacatatagtcatgtgccaccaccactattaagatagaggacaggctgggtgcagtggctcacacctgtaatcccagcactttgggaggccgaggttggcagatcacccgaggtcaggaattcgagaccagcctggccaacatggcaaaaccctgtctctactcaaaacacaaaaattagccgagcgtgatggctcatgccggtaatcccagcactttgggaggctgaggcgggcagatcacttgaggtcaggagtttgagaccaacctggccaacatggtgatacttcgcctctactaaaaacacaaaaattagctgggcatggtggtgtatgtctgtaatcccagctacttgggaggctgaggcaggagaatcgcttgaacctgggagatggaggttgcagtgagccaagatcgtgccactgcagtccagcctgggcaacaagaccaaaactctgtctcaaaaaaaaaaaaaatacatatatatatatatatatatatatatatatatatatatatatatatatatatatatgatggttccactgtcccccctattctcccaggcctctatgtagtcagtcccttcccccaccctcagcccatggtaaccacttatctgttttttgctggcatcattttgtattttctggagtgttacatagagggatcataccatatgcagtcttcgagtctggcttctttcacttagcgcagtggatttgcagttcaacagtgtggccgctgtcagtgccaagtagtattccattgtatggatgtaccacagcatggagggatttttaaggctggtcaggcagtgcttatgtcacaggtccaacatccagtcccctgggccatttaaagccaagcacagccccacacctaaccctcgtctgaacgatcttgtacagccactctgcagtttcacatcctgaatgtgagcagtctttttttaaagaaggaggttttgggccaggtgcagtggttcatgcctgtaatcccagtactttgggaggctgaggcgggtggatcgcttgagcccaggagtttgagactggcctgggcaacatagtgaaaccccacctctataaaaaaaatacgaaaattattggtggtggttgcctgtggtcccagctgcttgggaggctgaggcaggaggatcacttgagcctgggagtttgagaccagctggggcaacatagtgagacccctgtctataaaaaatacaaaaattggggctgagcgcggtagctcacactttgggaggccaaggtgggtggatcaggaggtcaggagttcaagaccagcctgaccgacatggtgaaaccccatctctactaaaaagacaaaaattagccaggcatggtagcgggaacctgtaatcccagctacttgagagcctgaggcagagaattgcttgaacccgggaggtggaggttgcagtgagccgagattgcaccgctgcactccagcctgggcaatagagcgagactccatctaaaaaaaaaaaaaaagccgggcatggtggtgtaagcctgtggtcccagctacttaggaggctgaggcaggaggattgcttgagcccgggaggttgagaatgaagtgagctctgattgcaccactgcactccagcctgggtgacggagggagaccctgtctcaggaaaaaaaaaaaaaagaggaggttttaatgttcgcaaagctggtcagtttccaatctggtgtcaccagtggaaaaaagatgtaagtgttgttggcaagagaagctcacccagagacacgctccatgaagtccctgacccccgctgggggtgcctgtgatggagggtaggctgtggtgcctgcgggcgcgcacaggtgagatggaaggaataaggggttattccttctgggtgcagctctgcctggaggccagagctgtcctcctcccttcgatctctgaattaaagacgctcttctagtattttcttatgttgatatatatgtgtatatatatatatgtgtgtgtgtgttttcttattgttctagttcttatattgtcatttaattcctttgtcctttagcttgcaagggaatgtgttttcttattagattgtaagctctggggaggtaagaccagcacttccaccctcccagatccttggttgggcacgttattgatcagtccacatctgttgcttggctgattgattaaatgctgtggtgcccgtgttcactgagggattccagacccctgtctagcccaaggatgcctcacagtgggaatgctggcacagctgtcttggcaatcagtagaccatcctgtcagttcttcaagcccagagagggtccgtgacttgctcagagtcacacagcaatccattagcgaggccagccccttccctgggctctgcatttctcttgtagtgaagagctcctcacagtttatttgcatactgtaaatttgcaaagtcagaaggaaaagggcagggagccgggcttccttgaggcaggtggctcttttaaagctggggcatgttgtcgccaatctgagcttgtttccatggacgcagccagccgggcagcctgttcccgtcaacctgagccctgatggagcctcggacctgacaggctgcctggggaactcactgggaggagggcgggttgggggagacccagaagccatgctggagtctctctctggcctactttttgccatagtttgaagggaaagttagtgaattgccaggatcaacctgcagtttccccaaaacttgcacaggagtggctttcatcgctgcatggggagacctcctttgcgggtctgcttagcggtagctggattgtctctgagggatacctggctttcctaactgttcctggagaatcttaaagacgaaaatggaagaaagggctcacatctttgttttgtgctgcaagcaaagtcttggaaaaatgaatgatgccaatggaatctatttcttgtaattaatttcctcaagctactggatctccttttcttgctgagattgtggtttggcagctgcagtttgatagccccattctgagactggatccctctcttccctcatctggtagttttcacgtcggggcattcctgaactccgtctgcctcgtttcaggctgggatcacagatcaggagcgaaggctttatgatattaactagtcaacagatacattctttgaagaatttctgtgtttttaattaccccacgaaagcctttggacgcacgggttatgaggggcattttgcattgctaaattccagccttgattgcaaacctgaaaagagcagaaactgctcagaacaagttgttaaaaccacagacacaagggaaaggtttctctctctccctccccctctctctgtccctgtttttaagtcctttcagctggaggtgaaactgcaacgttatcaaacatgccagtacacactgtttcccaggcctgtttttgcatgagttggggtagaaatgtacccagcttctgttccagtaggtggagaaagatgcttaaatcctagaagcactgttcacctacctttttagggtactgcaggtttagctcgagggttggagggcatccagaaaagcatgactaagagagaaaaagactactcccaaagctaacagggtggagtatcatagccaggacaggaaaattcccagcagggaaacggcctgtctgtaatgcagacacattgggtcataggtttgctttcacagaataagtgaaatggaacaaaagtcttttttgaattctcattccaagaggcccagtttctgcaggtgtgtcttttcgatcttaccttgtattcagtattatttcaagcaatctccattttaggcagtgtctactccagaccaaaaaacctggctaagaaagaaattttgttgattttgagacagggtctttctctgtcgcccaggctggagtgcagtggtgtggtctcagctcactgcagcttcaacctcctgggcttcagcgatcctcccacctcagcctccctagcagctgagaccacagatgcctgccaccacacccggtgaatctttaaattatttgtagagacagggtttccctgtgttgccccaggctggtctcaaaccactcctgggctcaagtgatccccctgcgtcgacctcccaaagtactgggatcacaggcgtgagccaccgcaggcctcccagactctgggtcagagggcagcttgagctcctccaccgactgctccaagcctttgccccagctcttggtgcctggggtggtgggagcagcatgggcttcgctgcacacggacctgggcccagatcttggttccatcggctgctgggagatcagttcccttctctgcacctccattcagcttggacgggaatctgtccttcctagaacagctgtgattaataactgagaccacacccatgttcgttgtggcttagcgccatgcacacaggtacctagtggatgttaactttcctctccatcctggtcagtgctttttttttttttttttttttttttactttttctttttctgtttttgagatggagtctcgctctgtcacccaggctggagtgctgtggtgcaatcttggctcactgcaacctccacctccctggtgcaagagattctcctgcttcagcctcctgagtagctgggattacaggtgcccgccaccatgcctggctaatttttgtatttttagtagagacgggttttcaccatgttggccaggttggtcttgaactcctgagctcaagtgatccacccgccgtggcctcccaaagttctgggattacaggtgtgagccactgcacccggcctctggtcagtgcttctgttgagttcaagaaaaatgaccaattcatctaaaaccccgagctggcagatgctctcccgcgcggcggcggctgacgtcagtgctactttcagcgtctttggtgcagtcttggtgttcgctctcaaatgggctcttttcagtatcacatatcatatgcaggatgcagaggggcccggcttacataccgagagtcagaggactcatgcggccacaagtaggttgggaacagtgtcccctaataggatgagttttgggctttaaaatttaaaaaaaaaaaaatgggggcattgatgagtctcgttggcaccttttggcttgtggaggctcgtgatctaatattggtctctgctgtatacccagcacactacctgccacttagccattccataaatatcgttaaataagtgaattaggccgagtgccatggctgacacttgtaatcccagcacttacagaggccgaggtgggaggatcgccttgagcccaggagtttgagaccagcctgggcaacatagcgagaccgcgtctctatttaaaaattaaaaaaaaaaaaaaaaaaagacaacttgagccgcacacaggttcttgccaaagcctctattagtgctgtgactcgggaaagaaaacttgtttttttcttcagttgactgggctcagccatcccaggtgtgagtgactcaggccttgagagcaggtaatggatccatagggagccctgtccccacccagggagactgtcccagcccctcccgatggctccttccagaaaggggcgcagtgggctgggttgcagggggtagttgtgtccaagagtcctgcaggatggagtgggaaggggcaggaggggtgtcctgcactgccagctgttcatctaccccagtgccatggaaacagagctcctgcttttccccaggaaggcgttgatacatttataggctagcattcaacatcagcgttgtgctctggcagtctcagcagtaagacataaacctaccaaggtctgggggaagcactgggtgttaccatcctggctcacgcgggagacgcatgctcctccgtgactgtttgtggccagtgagccaccagttgacaccagcaatccagccttctgcccctctcacttcacagatgagggaagtggggatctgcctaaggtcacactttggtgcatttctcaaatcaaacccaggagccggaatttttctactgagctcctgctaagacaccctgggtcgtttcctccgggcagtccatgtcatctgctgtggcgtgtatgttcatgggtgattctgtttctgtttttaaaccctgtgcctcttggttggtgcttttcctcctggaggatgctgcagacctgcagcggtcacctcgggccacccagggagcaggtgggcacacccaggttgcatctgtcgccacactggtgcaggccgtgttgcacatcactgctgccgggttgaccccacttggtatgaaatgagagggcctcttttctgaagcaaggtgttgcaatttagcctggggatgaagctgcttcttccaatacccagagttaacaccaaatgccacgagagtgagaaaataagacagcattgcactttcccagaaattgtcaccccagggtgccaccccacctcccaagcccactctgggactccttccacacacagtcacccactggttaccaagcctgcggggcaggtgctaggtgcgtgctgggagtcaggggtggatgaggtcttttgcagacagggcagagcgacctcagggcagagccatgagggcctgtgtgcagcggcttccacccaggcaggctccggctctgcaccttcagctacaggatacacttgctttcgacacctccactgtcatttagacacaaagcacaccaccaccgaaaccactccacagaatgtagagtttcttgccaggaaaataaaataaattaaaagtcactaatacttttatttaaattgcgagtacatttcctcgctgttgcattttgtaatttatacctgggagttaatttattgttatttacagttgcacaaggactcatggaaatgccttgtgtatcgagtgttctcattatgctgggcacggtcccaggtgccggggaggcaggtcatagtcctggcctcgtggagctgatgttctgaacgagagttgagtacccagtgggacatcctgagagcccaatgcaggtcctggtcagggctgtggggactgtggggaagacctggatggcaagaggagtagggacaagatctacaggattctgcatgcagggctgcaggccaagagggaggagttgggggttctagtccgctaggttcagggagccagacgtgtctgctgtcccaaacctcctgtgctcaggaacgtggttctgatgagcctgtatcaccttcccttccctccacctatgggtctgagtggcaggaagagttctagctgtgtcagccaaggccggggacaccagaggcacagggcttggtttaggagtcaagacaaggcatttgcttatttaaagaatgagttctatgcacttccaatgagtggttctgtggtcaggagggcggcacctggagagaggtcaaggtagaattgtggatttggaagggtggaggatggaaggccccagaggaaaccagcagtcagggactgaggaggtgatggcattctctagtgtgatgtgtggacagacagagtagaagaaccaaaaccagtcttggagcgacaggtgggtcagacggcagctttctctggacccgggtcaggaagagaagggtttccagcaggagggaagattgcgcttaggaagagaagggtttgctgggctcgatggctcacgcctgtaatcccagcactttggcaggccaaggcatgtggatcacctgaggtcaggagttcattttgagaccaacctggccaacgtggtgaaaccctgtctctactaaaaatacaaaaattagcccagcgtggtggtgtgcgtctgtaattccagctacttgggaggctgaggcaggagaatcacttgaacctgggaggtggaggttgcagtgagccaggatcgtgccactgcactcaagtctgtgtgacaagagcgagactccgtctcaaaaaaaaaaaaaaaaaaaaagagagaagggtttccagcaggagggtcagtggcggtgaagcttgcagctggcaaatgttgggttggatttggggtggggagtgaggccaggagctggtggaggggggcagaggaaggaaagatcactcactgctaagcctttcagatgagttccccgtggtcatcagaggtaggccttgctgtcttaattttacaaaagatgaaagccacaggaggcatagacttgctcagagaattcatactcagttcagcagactccagtattgatgctcaacccatgctgctgctggggagggctcaggggacaatgttaagtgagaccaaggaggtggcacccctgaaccagtctctccgtgagctcggcggtgagaaaacagtgcacagggagaggagccacagaaggcccgggatgtgtcacccagggtttcagctgggaggggacaaagccgatttgggtgggagagtggaagtaggtcccaagaacttttattttaaatgttttgatgacagatttaaaacttgagtaacttcattgtaaaatggccaggcgtggtggctcacacttgcaatcccagcactttaggaggctgaggcgggaggatcccttgagcccaggagttgggagaccggccttggcaacatagtgagtgagaccctgtcttgacaaaaaattaaagaattagccaagtgtggtgacatgtgcctgtagtctcagccacttgggaggctgaggcaggaggattgcttgcacccaggagctcgaggctgcagtgagccgtgatcatgccactgcactccagcctgagcaagagcgagactccgtctcaaaaaaacaaaaaccgaaaaaaccacctcactattctaggcccgagcccgagcttaaatatttaccccatatccaaccataagttaatcccgcacacaccttcatcagtttcttaaagaaactggtgccccagcacggggcatgccaacgtattagacaggcaacaacttagacatggggatgaaatgaattccatcttaaatctcaaagtgcacaatacagtctctaaaattaaagaaaagaaagatttatttccaaaaaagcccacagtgaaataattgtctcagtctgtggagagagctaatttggacagaatcacatattttgattcctgggatttttttaaaaggaatcttttaaagcagtaaatgaaatatttttggatgtagacaaaaatgacttacttagccattccactggcaatgtggaaaggatgaagaccaattttgagttagcaaggacaccttcagaaagttcagctcccaggaattgttgaccctagccatccatgtctgtatttcctgaggactattgcttacggaattaattgggactaatttctgttgcacctgatctccagccaaaacactcacattttgcctcatctgcagagacctgggctgagttttatctctgcgtcactgccgagttccctgcccccgctctgttaacagagctataattaactcacaggacgccaggcagccagattcggccaggcgccaagaaatcagccccaattactatattcacattgtcagtaatgcccacttcacagcttctgctaatttgaaatggcaagttccaactttccatagtaaaattaccatttttgtcctattctattacgtggtgatatttgtccattatttgggctccgtaaacttggcattatcacgacaattagttgttgagggttttctaaaatgatttgcaattacatctcttaagcggaaaactgtctgctctgatggagtgagaatccattccctctgtgccctagatccactttaggaattggcttttcataggggaacgtggtgcctcgggattttataataaagtcgagcctttaaaataagggctagccttggaacgttgcctgctttgtagatttccagtgttcaagttgtctgatttctttataaagatggagaagtgtctctgtccctctgggtctccgagttcccttgagtctgggcctctgtatctggatcccctcaagccctactttgttgtaagagccaaattagccaggggctactggttggtggctctgctgggggggcatcacagagtctctcttctctgacatttgctgaccttcaacccgccctggtacaggagcaccccattgaggtcctccgttttccagagtcctgtccctgaggaatcacctgcctgagtccctgagcttgggactggctggcctgattgggttgtacattttgttctcttttcagcagagaaatctcaggaggcaccatgccaggccactgtgcccctgcaagtgtgtctgagtatggcccaggaccctgcccatcactggtctgcaacaagataagcacagaagttcagagtaggtgtctagaaatgttcatagcaatttaacgtgacggtgacatccaagtggcattttaattttattttataaagatctgagtccacaatgggctggaaatgtaaaaatctgttgtgtgttcttctcccacagattgtttgacaaacattggtcattattattattattattattttgagacagagtctcactctgtcgcccaggctggagtgcagtagtgcgatctcagctcactgcaagctccacctcctgggttcacgccattctcctgcctcagcctcccgagtagctgggactacaggcgcccgccaccacgcctggctaattttttgtattttcagtagagacgggtttcaccgtgttagccaggatagtctcgatctcctgacctcgtgatccgcccgcctaggcctcccaaaatgccgggattacaggtataagccaccgcacccagccaaacattggtcattatttaatctcctcatctctgattggatttcactgtgatcatttactgtggctaaggcagagtgcttgctttttttttttttctttttcttcctttttttttctttgagacagagtctcactctgtcgcccaggctggaatgtagtggcacgatattggctcactgcaacctccacctcccgggttcaagtgattctcgtgcctcagcctctcaagtagctgggattataggtacacatcaccatgcccagctaatttttgtatttttagtagagatggagttttgccatgttgcccaggccagtctttgaactcctgacctcaggtaatccacccacctcagcctcccaaagtgctgggattacaggcatgagccaccacgcctagcgagtgcttgctttttctgctagacagtggtcctcaggcccaatccctgagagaggggcttctgagaggtgaaggaggcaggagttcttgcccctgactctcaggagctggtgtctcctgggcatcactcacggatgggctgattattgctcattaccccacaggatccgacagttccagtacaagctgcttctttgagacagagtctcaccctgtcgatcaggctggagtgcaatgctggcgcgatctcagctcactgtaacctccgcctcctgggtttaagcgttctcgtgcctcagcctcccgagtagctgggattacaggcacccgccaccacacccggctaatttttgtatttttagtagagacgaggtttcaccttgttggtcaggctggtcctgaactcctgatctcaggtgatccgcctgcctcagcctcccaaagtgttgggattacaggcgtgagccactgcgctcggcccagaagacttatattttatgatataagaaaattatatgaaattcccaaaaaaacccagaaaattatatgaaattcaaatttcattgcccatagtttgttgtttttttaaaaaaaaaattgtagtaaaatacacataacataaaatttaccattttagttattttgaaatctacagtttagtggaattaggtacattcagtgttgtgcaagccatcactgccatccatctccagaactttttcatcattccataactcacctccataaataaagttttattggcactcagccatactcatttgtttatctattgtctgtggctgcttttctgggctacagcagcagagttgagtagttgcaacagagaccatatggcctgcaaaacttaaaatatatttttttcttctttcttttctttttttatagagatgaggtctcactacgttggccaggctggtctcaaaaatcccagacctaagcagtcttcctgccttgcctcccaaagtgctgggattacaggcgtgagccatgtagaatatttactatctgaccctttccagtaaaacttggccaacccctgtcctggtgcacactctccttacttcttagttaccatagcaactgcctaactggtctcacttcctttggtttcattccctttctgtatatctgccccctggaggagtttttccaagatacaattctgattgattaacttcgctggttaaaatcttttagcaggctggtgcggtggctcaacttgtgatctcagaactttgggaggccaatgtgggcagatcacttgaggcctgaagttctagaccagcctgggcaacatagcaaaacaccatctctactaaaaatacaaaaaataagccgggtgtggtggcgcacgcctgtggtcccaaccacttgggaggctgaggtgggaggatttcttgagcctgggtggcagaggttgcagtgagccaagatcatgccaccgcactccagcctgggtgatagggtgagacactgtctcaaaaaaaaaaaaaattcctttagcagcatcctgtagactaatgccatgtctgggaacaccagtcccaggataactgcactagttattaaaggctctataaactcttgcagaaaagaaacctgctgaacatcgatcaacccagtacccttcaaaactcattgactgggcaagtctttttccttttttttttttctggagacagtctcgctctgttgcccaggctggagcgcagtggcatgatctcggctcactgcaagctccgcctccagggttcatgccattctcctgcctcagcctcctgagtagctgggactacaggcgtccgccaccacaccctggctaatttttttttatttttagtagagacagggtttcaccgtgttagccaggatggtctcaatctcctgaccttgtgatccgcccgcatcggcctcccgaagtgctgggattacaggtatgggccactgcatttttcttatcacccattctcattagcctacagcagggattggcaaactgtttactgtaaagaaccagatggtaaaatactgtaggtttcggcagggccatatggtctgttacaaagactcaactctgctgtaaagtagccatagataatacaaaaatggtgggcgtggctgtatgccgataaaactttatctaaaaagacaatcaggcccatttgaactcctgtcctgtagagcagtggctgtcaaggtgtggcccaggccagcagcatcacaggacctggggacttgttagaattgcagattctgaccaggcgtagtggctcacacctataatcccaatactttgagaggccaaggtggaaggattgtttgaggagttcaagaccagcctgggcaacatagcgagaccccgtctctacaaaaaaaaatacaaaaattagctaggcgtggtagcatatgcctgtattcccagctactcagtagacttgaggattgcttgagacctggaaggttggagctgcagtgagccgtgattgcgccactgcactccagcctgggtgacagagcgagaccctgtttcagtaataaataaattaaaagtacagattctcgggtctactccagacctgctgaatcagaaaatacgcgggcaggcccagccgcctgtgccttcaccagctctcctggttaaggcctgagaaccctgctacggaaccccgagtacctttcagaacatgttgacctcattcgcagggatcagtggccctttgtcatctggtctctggccagtgtccctccctcatctggtggacttggtactgatgccgaaccacctgtgggttccaaacgtgccattgtttctcccacccacgcatttgcacaaatgtggtcctgtgtggctcactcccttttctgccgccaccttctcccccactgcgccatgctggtctcagctcggggcttacctggtcccagaggtgtgttgggaggtccccaccccttgcctctgcccgttgccttttccacccctgcactgggtgtgcataggtgcgcagggcacgtgtgtgtcctctgcggtcactgacttgattgtctgcctttcccaggaggacatgggctctgtcgggacattttatccgtctgtttacaacatgaaatagacacctccgaaatgtgtgtgtgttccgtaaatgaaggagcagagggaccccttcggagcatctcagaggccaggaagcctggcttctggccgccctgcccgctcctcacgtgtgaggggaactggggaagtcgagtcagcccgctggggttcctgattctctgcggttctgggaagagcttgcagtggaaggcctcccagccatttcctcttctcccccaactgtgactcactgattgattaatgtttggaaattgtgactcatcttgttagagaaggaaaaggaaattttattctcttcattctccctccctttcaaataagtaataaataaaaagtggctgatcttccacttggtgcggtaagaagcatttaaatacattcccggccctcataattggtggcttcttggagaaaggtacttattagaagaaaaacacttccctatgtgttgttgttcggccttctcgttgatgaaattacacggtgagttggtgagcgaatttaccttgcccctttttaaaggtatttgtggcagctcttgttgtaggaatcaggggagaggagccacttctcttttagtaagaaatgcgaagagtggcctctccatcttcagagtttcaaaatgagttcactctggtggtgagtaatgatgtcttaagctggcttattaaaggcggaggaataagatgttcttgctttacctcacgtaccaaatatagataaggcgctggatcagcagagcctcaggcccgtgccaggacacagtcgggcctggcgatgtctgttttgtctcacgactggagggttgaaggggaagcacagcctttgcttttaagggttttcttctgggaaatccacaaaaaaaaaaaaagcatttgttcacttctcacgttgtgatgttgaaattatggcttggagttttacatttgccttttaattctctttatgggcagcatgtctgtatgtcttaggctcttggttctggaagaccaagtaaattcagtatcttttcaaattgtaaccctctggtctgggtaacacagcaagacccccatctctacaaaaaaaatttttttaagtcagccaggcatggtggtgcacacctgtagtcccagctactcaggaggctgagacgggaggatcacctgagacacgagtttatgtgtctgagacgcctgagacaggagtttatgaccatcctgggcaacataacaagagcccatctctatgacaaaatgtgaaaattagccaggtacagtggtgcacacgtgtagccccagctacttgggaggctgaggttgggggatagcccaggagttcaaggctgcagtgagctatgatggtgccactgcactccagcctgggtgacagagtgagaccctgtctcaacaaaataaaattgtaacccaaagtaagggctcaataaatgttagccactgtgattattctattattcccgtcctcgttgtaaatatttgtgtggcttggtgcctagcgtcttttgtagctgtatgtattgccaaggagaatcccaaggaaaaaaagtagaaatatggttaaagctggctgggcacagtggctcatgcctataatcccagcactttgggaggccgaggcaggcagatcacttgagtgcaggagtttgagaccagccagagcaacatagcaagaccccttctctacagtgtgctggcatttgcagtgcagccaccattgcccatggtagcgatgaggaagctgtggcttagaccaacttccagaatcactgctctggtcacacagctgctcgcaggtggcatcatgaacacacctagtctgactgttgcttaaccacgacaaactccatctccttccactttgcctggctgaggatcggatgcattacatagaaatatttgaatttggaagctgttgaaatacaggttcaggccaggcatggtggctcatgtgtgtaatcccagcactttgggaagccgaggcaggcgatcacctgaggccaggagttcgagaccagcctggccaacatggtgagaccctgtctctactaaaaatgcaaaaatcaactgggcctggtggtgcacacctgtaatcccagctactcgagaggcaggagaattgcttgaaccctggtggcggaggttgcagtgagctgagatcatgccactgcactccagcgtgggtgacagagacagattcagtctcaaaaaaaaaaaaaatgcaggttcaaggaagggagaggatgatttgtgttccgctctgcgcctcctccctggtccattcccttctccctgttggaccattgctgtgacacaggtgatctgagcatcaagaaaaaggcatttcttgcttctcagtgatattagcaagcacctgctgcttgtattcactgtgctgagttctacccatttattctctcattcagtctttacatctccctgatgaggaggcataataatatcatgcccattttatagacttgagggaactgagcccaagccattcagccagagagtaaccgagctggagttccaccaggtctgtctgctctgatagcaggcatgcctgacctccgcacctacccacttccccacttctgcagtctcatgtgtcccagggaacgcacagctggggcccctctcctaatttgcacccttcctgagccagttcagaagtcccagactgtgtctttctggctggctgtgtcactgggcccaaggatggtgctacggggctaaagatcttctacactgaccctctccactaacgggaaatcagaaaagggaacttgaagagaacattggcaccaatggttggacctagggatttgtagccacctttctaagggagatagaggacagggctaagagtcacaacttttgttctctacccttgagcaatcgaatacttgcaaagccctgtttctaaggttaaaaaaaaaaggctgggccctgtggctcacgcctgtaatcctagcactttgggaggccaaggtgggcggatcacgaggtcaggggatgagaccatcctggctaacacggtgaaaccccgtctctactaaaaatacaaaaaattagccgggtgaggtggcacatgcctgtagtcccagctactcgggaggctgaggcaggagaatggcgtgaacccgggaggtggagcttgcagtgagcccacgtctcaaaaaaaaaaaaaaaaaaaaaaaaaggaggcagctttgggggacaaaacattcagcgtggccggctctccgcatcttacagtggtagggatgaaatgcacgcgccctcatttgaaatgagaatcgcagtgcctcagttaaacagcggcctctccggatgccaagctgagatcatttccatttctgtgccgagatcggccttttgcagagatagatgggttatatttatcaccagctaacttattagcatgtgacaccagatacaccaaattgtaatctgactcataaaaggatatgtagttcatgacttgatggtgaagcaggtcagtttaaaaaaaaaaatcagatggattatggagtcaacgtttccttcagaaaacttcttcaggggtaaactggtataataggaatgtctgttcagactgttttgaaaacagttaccttgagaattttgtattcctttgacccagcaatcccacttttgaaaatctatcccaaggaaaaaaattagaaatacagttaaagccgcctgggcacagtggctcacgcctataatcccagcactttgggaggccgaagcgggcagtgcgggttgagtgcgggagtttgagaccagccagagcaacatagcgagaccctgtctctacacaaaatacaaattgtttgctgggcatggtggtgtgcaccagtagtcccagctatctgggaggccaaggcgggaggatcgcttgagccagggaggtcgaggttgtggtgggctgtgatcacaccactgcattccagcctaggtgacacagtgagaccctgtctcaaacagaaaaaaagaaatgtggccaaagctttatgaacaataatgttaattatagtgttattgatatactaaaaacaggtgggagggaacaaggctagtgtccaatatagaggaacggctaaatgatgctaaaaatcattcattcaaattattatgtaactgatattgtttcccaagaatatttactaacacagaaaagatcatgatatcacctaaagtaagaattaaagatgctgtatcaccctagtttaatgaaagaaaaatgttcaaaaatataaagacaagatgaatatatagacatacagcacaatagatgcaaatacctgcacatcacacaagggctggtgaacatgaggacactggattcttccaggcctttttctaagtcttagcagggattatttttggttggtgtgagattggcttttttctttgttatgcttttctgtgttttgcagattttctccatagagaatgttacttttttttaggcagggaacggtggctcacgcctgtaatcccagcactttgggaggctgaggcaggcagatcacctgaggtcaggagttcgagaccagcctggccaacttggtgaaacaccgtctctactaaaaatacaataaaaattatagccaggtgtggtggcaggcgcctgtagtcctagctagtagggaggctgaggcaggagaatcatttgaacctgggaggtggaggttgcagtgagctgagatcacgccactgcactccagcctgggcaacagagtgagattccatctcttaaaaaataaaataatttaaaaaaaacaagagaatgttactttttaatttgaaaacaataagaaaatgtccaagtctgcaaaatagagtctttttgaaagactcttcgtacttattaatttattcaccagacatctttaaacggaaacagtggttaagtgtgagagtttggaagtcccacagatcagaaccccagctgccgtttactcactgcagtccctgggcaagtaattcagtcatctgagtttccttgtccctacccgtgtaatgggggatctctggtacccatctcatggagctgctaaagtgattaaatgagacaaaagtatgcgagccctttgctggaacatgtttctggaatacttgctgttattagtggaaatattgccaccgtgccatgtgccagactccgtgtgaagtgtgcagagtgctaggtgggtaaaaatagcccccctccttctagaacctccaacccaaaggtgggaaggggcacacaggtaacagaaatgacagcgttgacatctggtgtgtgctgtgtaagtcatgtcatctgtgctgaaccctggggctcaggagagacgtagtggggctgtcgtgggaactgggccctacttgggagccaggatgtgggcccggcctgaagctgcagcagcagcagcagcagcaagatgtgagaatatttaggagatggaacttggttcagtgggaggagtaacccaaaaggactctagggtggtcctgagattttcttttctttttttttttttttttttgaggcggagtctcactctgttgctcagacttgagtgcagtgacacagtctcagctcactgcaccctccacctcccaggttcaagtgattcttcttcctcggcccctcaagtagctgagattacaggtgcgcaccaccatgcctggctaattttgtattttcagtagagacggggtttcaccatgttggccaggctggtctcaaactcctgggcttaagcagtctgcccacttcagcctcccaaagtgctgggattacaggcatgagccactggccagtcctgaagttttcacagaagcatgaaaacacagagagaattccttttctgtcataaggagatgatgcccttttttttttttttttttttttttttttaagagacagtattgccctgtcgcccaagctggactccagtggtacagtcgtggctcactgcagcctcgacctccctggcttaagcaatcctcccacctcagccctcctaagtagctaggactacaggctcatgccagccaccatgtctggctaatttttaaattttttatagagacacggtctggcagtgttgcctaagctggtctcaaattcctgggcttaagtgatccgcccacttcggcctcccaaaggattacaggtgtgagcaaccacgcccagcctggatgattggatggtgcctatagattcaggaaaaacagacttttcccccagaatgttttccttacctagctctatgtgtgtgcagtgtgtgtgtgtgtgtgtgtgtgtgtgtgtgtgtgtgcaagagagcgtggctaagacaagggtattcacctggcatcctcattcccaagttgccaatactcctctccccttttttcttaactcaccacctgggaagttttcctatttctctccctcctatcccagataagaagaattgccttctttcctcccagctgatttgcttttctcgtcattatatggcaaaccaggctgcactcccctcctaaggcaggcggtggttctctttgggctctgagtcctcagtgttctgcctcttcgggtgccaaccaggaaagccgccttccgcttttagagcaacgtgaagaaatcatggcagcccacgtaagatctctcattatttctgttgaaactgattctatcgagggtggagtgcattgcctttaatttctttgtttgcgtgtattttttttcccctctctctcacaagaagtatattcttttctttcctgtttgttcctgctcgatttggggaggctgctgtttccactgcctaattaatgggaaggtgttctgcggaggatttcaccgcgtacatattctctgtttggacatggtacaacctgtggacccttttaaacatagttacatgtttgactctttatagggtaataactcgattaattttgcaaggctttttagaataccattgttctcttgaaaagaacaggtttgctgttttaacaagactttaatgccatcgagatgcctcacattggcacggttgcgtaagaatcgcacggtcccatgaaatgaaattgagagagctttttccggcgcctggttggttggggcggcctccgttcggtgcttttttcatcctcgacccagtgaccaactgtgtttgccctgatgtttctttcaattccaccattccgaaatgtctccggaatctgtcgttttagcttttgcagcaaggttcgttgtgtttgtcttgcccgcttcaggtttctctaatgagattcacgtgtaaaggaggattggcaattaatcggatgactgattaattgtgagattcttattcttaccaaggaatgctatggaagtcctggcttcagataaaattctcaatgagggccagttgcagtggctcacgcctgtaagcccagcacttgaggaggccgaggtgggaggatcacttgagctcaggagtctgagaccagcctgggcaatatgacaagaccccatctctgcccaaaaagaaaaaattagctgggcatggtggcacacacttgtgatcccagatacagctacttcggaggctgaggtgggagaatctattgagcctgggaggttgaggctgcagtgagcagagatggcaccactgcactccagcctggacaacagagcaagaccccgtctcaaaaaagcaaattctcaaagaggccttaatataccttttttaatcataagctttaagagcctggtcatgcaaagataattcagtgagatgaaagattgtttatttcctactgtgcattggtcacaactttgattccacagaagggcagtgtgctgtcctaacagagctgagtgtgtggagtcttaagagcttcctccctctcagcaaatgtgtattaaatgtttctgctttgccagttccagtgccagtgccctgtgattagaaggtgagcttcaccgaggcctcctggtgttgtggagagggagccccgggaatggctggatgcagaaggtgaaggttgagatgcaggagagggagcagttagccttctggcttgggctgtggtgggtggtgccctccatgagattccaaaaaggactagtttggggaggaatgaaattggcatttggagagtgtaagatactagtggagtctccaagcagagctgcccaggagacaggctggccatgaggagagtagcattcacctggatatagatttgggagccactcaccgggagagagattccatctgtgtgtccctgggcagcgtgatcatgggaatactgcttaacctcaaatccttggctttctctgtaaagtaaatgtaataagatctccacagggtttgctgtgagggttgaacgagctcagtgcacatgaaaatgccctatacactcgaaaccagctataaatattggttattattgttaggatgctgacgttcaaatataaattgccaaaatcatttgggaagcattgcatactccattcccacatggagagttgcagggcatgtgattatctgtttgttcatttagtcacaatattgatcaatatagaacaaagcagtatattttaaaaatcaaccaggagcagccattctttgaagtgttatgcaaccattaaaaattaggtttggccaggcgcggtggctcaagcctgtaatcccagcactttgggaggccgagcaggcagatcacctgaggtcaggagttcgggactagcctggccaacatagtgaagccttgtctttactaaaaatataaaaatcaggcgtggtggcaggtgcctgtagtcccagctattccagaggctgaggcaggaagatggcttgaacccaggaggcggaggttgcatcgagccaagattgtgccactgcactccagtctgggcaacagagagagactccatctcaaaaaaaaaaaaaaaaaaattgcagagagtttgtagtacatgggtcaggcttaagcaaaaagaaagcaacttaggaagtatatatacagtattattacaactacaaaaggaacaggcagaaaaaaccctggaaggaaccatgccaaaatattaagtctcctttagggagcaggacttggagtcgtatttctttatgtttttctgtgctttaaacatactctgccatgacatattccttctgtgatcagaaaaatataaactaacagtaacagcagaacatcccttccccccaaatacaggtgggaattagatgtctgaagagctgaaaacacaaatgtatcgatttcatctttttaatatttccctgcaattcatcttgccttaatcaccgttttctctctgtccgtggaatcacagagctaactgcacagaaacggtgtgaatgaaaccaagttggccctacgtggaatctcaaatcgctctaccctttcgggatcttccgtttaagtttttggataatgaaaatttgatcttgatttcaactaaagctgttgtgtataaatctaacctttctatttagcgaaggtttttagcggtccatagaggccggagataacgaactgttacttgtcttctgtctttcccgtgtctgccatgggttctggtttgtaggcagatataaatgcagatacgtgtgcccctgtcgtgtctgaaaggatgatagaagcgagctgaagactccttcctgggagaaatggatttctcccttgcttttagaatcctcaactcctcccattcattctgagcaatagccatcataccatatttcatcaatctcagatttcttttttcttcctttttttgaaacagggtcttgctctgtcacccaggctggagttcagtggtgcaatcatagctcactgcagcctcaaactcctgggctcaagcaatcctcccacctcagcctcctgagtagctgggactgcaggtgtgcaccactgcaccaggccaatttttgtattttttgtagagacagggtcttgccatgttgcccaggctggactcaaactcctggcctcaagtgatcctcctcccaaagtgctgggattccaggcatgagccactgtgcccagcccaatctcagctttctggtttggccaagggatttactttcaagttgtaaagtaaacaacttgtgcttttctgcttttgccatctcctggttccccctgctgatgccacctctgatgccacttgtcacctttctctaaaccacccccttctctcacctggcaggaaaattccctgcctatccttcagtgaccccagcaccggtttcagtgccagaaaatgtgctgtcctccctgtatttggctcgcctgtcctccccctcactgatgttttctgctcattgggtgggggaggaatcacatgggttaggtgcccatccgtccactcctgtattccatgcgcgaccacggtggcccaaagttggattccagcatgtgatgttgaatgaggcaggcgtggctcccgtccccgggctgcacccagcagttcatcccggatccaggcctctgccttcctctactctcacctcttctcctctgcagagaagtgactgctgctggttagtagggtgggaagtggaggctggagggcatttgagagggcagagctgagttctggcctgatccagtcactcaacagcccatttcctcatctaaaaatagaataataatcaattacttagtacctgtcaacacaagcctatgtatatatatatatattttaagagaccaggtcttgctctgttgtccaggttggagtgcagtggcgtaatcatggctcactgcagcctcagctcttgggctcaagtgatcctcccacctcagcctcccgattatctgggactacaggtgtgtaccacgacatctggctaactttttaattttttatagagatgggatctcactatgttgcccaggctggttgcgaactccttacctcaagtgatcctcccacctcaccttcccaaagtgttgggattacaggcatgagccactgtgcctgggcaagccaatattttaacaggccctttacctatgtaatttcacttcaacttctcggcaaccctgtgaggtcgggagatcgggtgttcttgtcaaaggcacatcaagaaatgacaaggcggtaccgggcacagtggcttatgcctgtaatcccagtgctttgggaggccgaggcaggtggatcacctgaggttaggagttcgagaccagccttgccaacatggtgaaaccacgtctctactaaaaaatacaaaaattagcctggcgcagtggtgagcacctgtagtcccagcttctcaggaggctgaggcaggagaattgcttgaacctggggggcggaggttgcagtgagctgagatcatgacagtgcactccagcctgggcaacagagcgagactccatctcaaaaaaaaggtgaaagaaatgactgagcaggaatttgggcccaggtttcgtcaccaaattttgtatgttttagctatcattattgctgtccttgttattgatgttatcggccctgagggtataatgatgagcagaatatatcccgattctaagaagtcaagaggaaaggaagctagctttgctttatttcaagtttctcattcttttttgccgtcattcttttttgatcacaaaatgcccacctgtgctctagaaaccacgcctccattggacaggctttgggagtactggctccagtgatttgggtggttttgcactgatttctcatccagcaagcaaacctcaacaccttcagactgtccccagcaaccagaatattatcgtttcagagtttcgagggaccatagctgtcagcctgtctgtccaccctgcctggcgctggccttaattggaggatggttgcatttggaccagagcagaggcagatatctcattcctccaatgaaatacgagggcttgtgcaacaggcttcttatctcatctccacctgatcccaggagcctgattcctttccagggagcagcagatgagacttttctctttccaacaccagtgtgtgtgagcgagtgaatgagtagggtttaatggtgattaaaggcgtggtcttcattttgacaccttttgttctataacaagcctgacaaccatgaacctacttcttgccagacagaaaagtcattcccgtgccttgcccctgagcctcctcggaaatggcagagctgcacatgaggaattatgcttcctcgaacagcaacatatgagtcgtgcctcttccctaacaccgctttgcagtttgtgactataatctaatgaatccagctgacgttgatcaggtccttggtgtgggcgaggcactgtgcggcggggagggggcttccttcctttgttcctccctagtgcaaagcagtgggtatcacagacgaaactcacaagccacaaagaggttcccaggtcgagctggcctttgtgcccatgacgtctccctcccagacctgttctccttccaccatccttggttcccagtcagggcatggtggtgggggaagggcagggtcagcagggcatatggcctggccctgtcctgcagtggggttgactgcggtactgctccagaaaaatggactttgttgccagcgttaaaaaatgatgacttggccaggcgcggtggctcacgcctgtaatcccagcactttgggaggccgaggtgggcggatcacgaggtcaggagatcgagaccatcctggctaacacagtgaaaccctgtctctactaaaaatacaaaaaaaattagcggggcgtggtggcaggcgcctgtagtcccagctactcgggaggctgaggcaggagaatggcgtgaacccgggaggcagagcttgcagtgagccgagatcgcaccactgcagtccagcctgggcaacagtgtgtgactccatctcaaaaaaaaaaaaaaaaaaaaaaaaaagatgacttggagattgaaagaggttgaagagatagctaaaggcaatgtgtggacctcatttagattacagttggaaacaagccagcagaaaacgtgtttctgaaacaactggagaaattagaacagtgggtttctggatattttatgatattgaggcgttattgctattatttgtgaagtgataatagtgtttgttttgttttgttttgggacagggtctcactctgttgcccaggctggagtgcagtggcaccatcagggctcactgcagcctcaacctccccgggctcagctgatcctcttgccccaacctcccaagtagctgggactacaggtgcgcgtcaccatgcctggctaatttttgtattttttgtagaggtggtgtttcagcatgtcacccaggccccggattatagtgttttgactgtcttttttttttttttttaaaggatccttatcttttagagaattcacactgagatatttctggatcaaatgacttgatatctgagatttgcaacaattaatacagtaaatgaaacaagcctggccgagagttgatactcattgaaagcgcatgatgggcacatggggactggtgttactgtttgcttgatgtgggcttgtctttgagattttcgtagtaaggtggtattttgcacaaaaccccagctctgatttttctgggaaagtgggaaggcctggtgattgcaggctgctggagctttagatgggtgggaatgtcctaggtggcggatgtcccatggtcatgtggagggaaggatagaaagagcatggcagggggccaggtgccccgacaggtgagggccacctgcagggaacatcagaggtgtgtgcttcttgagggtcgttacccacggtctgtatctccctatattcaccaaaatacacgtgggacttcccttctgatcaggtgcacagcctaggggatcctctgggccgagcggacctgccagggaagctctcaagtggtctggatagaacaagcagggggcttctgcaacaagccggcctagctccaggacacccccatccaagagggatttgacagatccatcccagccccataacttggttcctttgcagagggatcatttggaatttttttattttattttattttattttattttggtgagatggagtctcactctgttgcccaggctggagtttagtggcgcaatctcggcttactgcaacctccacctcccgggtttgaatgattctcttgcctcagcctcctgagtagctgggattacaggtgccctccacttatgcccaggtaatttttgtatttttagtagagatggggtttcaccatgttggccaggctggtcttgaactcctgacctcaggctatccacccgcctcagcctcccaaagtgctgggattacaggcgtgagccaccgcgcccggccagaaatctttttccatttgccacacttgtgacttagccaagtgtctttttcaaagactaataaagccttcacagcttccgaaacaccgcgctagatctggtagccgcggacaatttggattccttctccagtgggaaagattcaaaactgcaggtttcagaagcctttaaaagcttcttgtctgtgtgatgttcattgaatgcaaattctttcgcaaataatggcctgcaactgctttaaagaaataaactcatcttgctgagcccgggcatgtatgcgtcaatggtgaaaaactgcaaacacacattctgttagcagaatcgtttaattaaaccacattcttgaaatggtctgcactataggaagggatgttgtgtgcaccacactttctaaaaagatatgtaaaaggtccccagaaacatataatcagaatttatcctagacaagtaatttcctctccccatgtctgtgtcctcatctgtaaaatgaggtagtggggccaggacgtctgtaaggtccttgtagtgatgctgttcacaggtgctgttacttgggggaatcataatgctctagggtttttggtttggggatttttctttgtttttttgagacagggtctccctgtgttgcccgggctggaatgcagtagtgtgatcgtagctgcctgcagcctcaacctcctgggttcaagcagctccccctgcctcagcctcccaagtagctgggactataggtacacaccaccacaactggatatttgttaaaatttttgtacagaggaggtctccctgcattgcccaggctggtctccaattccgaggctcaagtgatattcccaccttggcctcccaaaatgccaggattacaggcatgaaccactgcacctggtactagggttgtatcgtttgtcttttaaaaaatcttcacataaaagttaattgtggggtgggagggagttcctatatcaaaagtatgttgaaatacaagagtcaagaggttgagtctggggtccaggtgggtcccctggacaaccctctgcagacttgctgctgcttttgttaaagtgtctgggagtcccaagccacatggggtaggggcatcagaagagtctagaattattatttttgagacgtggtctcgccctgttgcccaggctggagtgcagtggcgcgatcttggctcaccgcagcctccgtctcccaggttcaagtgattctcctgccttagcctcctgagtagctggggttacaggcgcgtaccaccgtgcctggctaatttttgtatttttagtagagacagaattttcccacgttggccaggctggtctcaaactcctggcctcaagtgatccacctattttggcctcccaaagtgctgggattataggcatgagccaccatgcccggcctgaagagcctagaattcttcagccttctccaggatatccctgctgcctgggtgggagacaggggagagttggtagggagaggactgtgctgtggaggtatgactctgcaaggtgaccccggctcagcagctgatcagctctgtggccttgggcaggacacggggctccctgaactcctctctccacattggtaaagggtctggtcaggccagctgtgggctagtggtgagagtaacagagatactgatctgttactggaaacgccatgagctgattgctgtcattaacctccctgtactgagagttaaacaaacaggcacctaggatgggtgcagtggctcacacttgtaaccccagcactttgggaggccaaagcaggaggatcacttgaggccaggagtttgagaccagcctgggcaacatggtgaaacctcatctctacaaaaaaaaaaaatgcaaaaaattagctgagcgtggtggcgcacacctgtactttcagctacccaggaggctgaggtgggaggattgcttgagcctgggagttccaggatgcattgagccaagatcgtgccactgcactccatcctgggtgacagagcaagaccctgtctcaaaaaacaaacaaacaaaaaacagcaaaaaaaaaaaaaaaaaaaaaaaagcaggcacccagattttcctgtactgtaaagagaaaaaccttgaatttggattaggaaggtctgaccctgtcacaaacaaaagtgaccaaatcatacattttgaaattcacctcctttgacaaagccaggatcctcatgaaagagaagattctgatgtgaagtcagccctgcactttcagcctttccagcgtgcaggttgatagaatcccacactttttagcggtcgaagggaacttaagatgtagcagttatttcagagttgtgaagcagagaccaaaatagtttgaagctgaattttaagcctcttttggccagatcaaagaaacccaaactcctaaaaataccaaattagctttttaagcatagtttctatctttagttgaaaatgtgtgcagtgtatacttctggaacctgcttaaatgtatccattgaaatgaagatgtaccttgaaaaaagaggcgcctgatctgcagtaataattaagtaactttctctgcccttgactcttgccccaacgcgtatcaggattccacggtcccctttctccttcctttttcaattctgaaaccatccttgtcttcttgccggagttagcaccaaaaaaaaaaaaaaaaaaaaaaaaaagttactcttgtagtttacatgtcataaatgaaaatggatattccctcccagggcataatctgaaatatttgtatttgggtttcaaatgtgtgataagatgctctctgtggcagatcggcctttctaattgctgtgcttgttaaaattcaaattaggctttattctcttagcaaacgttgactgacagttgcagagagtggcccagaatggcactgagtgatgggtggccaggaagcctgcggtaggaaattcacaacagacctttcatagagaaacggctggccttgactttgagtccttccatcccaggtgctttagagacagagccgcctgacccttccttagcttggcccgggggtgcgttggagggggctgttcccacctgcagttcctaaaggacaaactgtctgatacaggcttcatgtggggctggccaaaccccaccgaggtttgcacacaccccaggattgcagaacctgagctcgaggagtgggacatgacctccccacgcctctgctgagtatcccagaccttcccatgtctttcttttctttctttcttttttgaaaaggagtcccattcagtcgcccaggctggagtgcagtggtacgatcttggctcactgcaaccttggcctcccaggttcaggcattgctcctgcctcagcccctcgagtagctgggattacaggcgcgtacgaccatacccggctgatttttgtctttttagtagagacagggttttaccatttggggcaggctggccttgaactcctgacctcagctgacccacctgcctcagcctcccaaagtgctaggattacaggcgtgagcccctgcacccggctgaaccttcccatttctaatcagaactgaccctgggatcaactgacctccttggagtgtagaggcatcctggttgtctggggactttgggtgggatctctgccagttttgcctgcagcagaaggaaagggaagtgacttatcttaggcacctgctttgaacaaggcactgagctgagcacgttcacatgtatctactaatttaatcctgacaacagtcctgaaaaagatactttccccattttccatctggggagactgaggctcagagaggtcactggcctgcccagtatggcgctgccagcaagggttgagctcatattgagtctgggtcggtgtgaccctacagccatgcccttgacactatgccattcctgccctcctggctggttgtgttctgctcacttccaagaatgatttccaatggcttgcaaagttacagttagcacagtatgacaagcaaggcatgagactgggagtgagtgggaacgaagaggaaagaaagtgagaggaggctgggcatggtggctcacacctgtaatcccagcactttgggagaccaaggcaggaggatcactggagcccaggagttcaaggtcagcctgggcaacatagggagacccaatctctattgtaaaaataaattgtaaataaagtgagaggaaaaggcagttagaaccagaattagacaactatccaaagttccccaggccctgtgtactttgtaaagatgagatacagacttgattgtgagcttcccagcaaccaatgcaaaaagggcaaccagataagtcatgtgacttacgctgtccacaagctcaaaacaaagcatgtgttgagggaaagcacagctcctctggtgttggcaaaaaaaattctccctaaagatcctcgtaaaaagaagtcacttggtttcattgccggttacaagttgctggcaaccaagtgccactggcaggtatcttacagcttaatagaagcagcattacattggtctaaaagaagacaagagaattacaggcccatttttaggagtggatacacctctttctataggtagaggaacttctgtctggatttgtgagttgggtgatttcagatactgatttatttttatttatttatttattttgagacagagtctcgctctttcgcccaggtgggactgcagtggcgctatcttggctcactgcaagctccgcctcccgggttcacgccattctcctgcctcagcctcccaagacgctgggactacaggcgcctgccaccacgcccagctaattttttgtatttttagtagagacggggtttcaccgtgttagccaggatggtctcgatctcctgacatcgtgatccgcctgcctccgcctcccaaagtgctgggattacaggcgtgagccaccgtgcccgggccagatcaactgatgttttgagttcagatacagagtaaatgtagcttgtaaagtactggtcattagaaccagagaatgaactctgtccctcttttaaatctggttggtttagtctttttagacacataccgttcggggacaaagagatcgatcagaattttcttgcctcctcggacggcatctgacctggctaggttgcggggatctgttggagagagaagcgtgtcatggatcccgcatcgaaaacagccttgaagagggccaggagcacggaggacctggggagggccctgaccactggacacatctgccctttgctcctcctttttgtctctgctggtggccctttctgctgtattcacgcgccctcaccacctcctgtgtattcgtgtgctggagttcagccgccaaggtggagagagactccctgtcggggaaggactccggccccaatgcctcctcctccaggccaggccgccatggtgggtgggaagagaggccactcctagagaaagagacactgtcagtaggtgtcaggaggtgtcccgggagctcgccgcgtggtaaccaacagacacagcccttcttggcattcaaagttgcaccctgatgcctgtgagggagtcgtgactttctgttaccactgacccagggcagagttttaaacagtgaccttaaggcgaaaagctccagatctcgttactgaccagtgcagccagccactgccttccttcctttttgattctaaaaatgacactcgggttttagagggttgcttttcaggcagccgaaatccccgcatgcaccttctcgtacatttcaggagagaagaatcaagtccatccacggtatccttgcccaggtaccggtatccatcagagcgtgattggggtttcagcagagccaggcctgcttttcctggcagaggctgggcccctttagatttttcttgtagattttgcttgagcctcccagcccttccttgctcagcacctgtgacccactgggtcacagtgacccacatcccatggctctgaccgcagctggactcatctcacactcacgttcatcacggctcccagaaggcacgtgtttttaatgagaggctcatttccaccactgccccccagccctccgcagcaagccagtgcaacgccaggacagtctgctgacaggggaattggagactggagggagcaagttttacctttttggtttgaccatttaaattgaagtcatgcatacagggaaagttatgcatatagaaaaatgtacacttcatactgcgtgcattcaattaatttgcgccaaatgaatgcacccgtgtcccctgcacccagatggaaaatgccaccagcacccttaatagcccccacctggacccctgaattggagtgaattttgaaagaagagggaaagaaagtgacatgtcccaattagaacatatgggacaggcactttctatactgtccaccttgccccagattctttttctttttctttttcttttttttttttttttgagacggagtctcacactgtcgcctgggctggagtgcagtgtcatgatctcagctcacggcaacctccacctcccaggttcaagagattctcctacctcagcctcccgagtagctgggattacaggtgtccgccaccatgcctggctaattttttgtatttttagtagagacggggtttcactatgttggccaggctggtctggaactcctgacctcgtgatccactcgcctcagcctcccaaagtgttaggattacaggcgtgaaccactgcgcccggcccagattcttttttttttttttgagatagaatctggctctgtcacccaggctggagtgcggtggcacaatctcactgcaacgtccacctccctgggctcaagtaatgctctcacctcagcctcccaagtatcaaattctcattttaaaaattaagaatcagacccaaaaagaacaaatgacttgaccatgactgaggccacagagccgaaaatgtccccatcctggagtcttactgtggcacactctcatcttaaccacacactctagttttatcctctctgtgtctttcatagattatcaggaagcgaaataacctgttaatattttcaaaagttcttatgaaatgtgaagtgctgtataatgattaagatagaaaggagaaactaggaaacgagagcttttaatcctagcttacaggaaattctaactagtaggaaatctaattcaggcagcgctgggaaacatcacaggctatgagatgaaagtcagctaaattgggatctaattctataatctaaatatagatgtagatatattacaggttggccttttcagctggagagagtatcattcactccaaaagtgccttttgtatcacagagaagagcgcagccaggggtgatatcagctgaggaagggggcgggcagcttggcgtgaggggctttcattcattccttagtcatctctattttcttaaattttatagtaggaattatttgtgcgttgtatgtataataaacacatggaaaagacaagagcgaggaaggcatctcaggagtgtttttgggaaggaggctgtcatggcatgtgggcagagggaggtctgggaatgggatttgctgggtcagaaagatgtccatgttctttgccaatttggcatcagaaatggcccacaccagccaggtgtggtggctcatacctctaatcccagcactttgggaggccgaggtgggtggatcaactgaggtcaggggttcgagaccagcctggccaacatggcaaaacctcatcgtccccactaaaaatacaaaacttagccgggcgtgatgggaggtgcctgtaatctcagctgctcaggaggctgaggcaggagaatcccttgaacccgagagatggaggttgcagtgagtcgcgattgtgccactgtactccagcctgggcaacagagcaagactctgtctcaaaaggaaaaaaaaagagagagagagagagaaaagaaaaggctcacgcctgtaatctcagcactttgggaggctaaggcaggaggagcttgagaccagcctgggcaacatagtgagacctccttatctctacaaaaaatgaatttttttttttttaatcagctaggcatggtggcatgtgcttgtagtcccagctactcaggaagctgaggtgggaggatcacttgagcccaggagttcgaggctgcagtgagctatgattgtgtcatgtactccaacctgggtgacagaacgagaccccgtctctaaaagaaaaaagaaaatgcctgtttcagttgtcactcctcaccagtgaggcatgggagtgttctcttcctccaaacctcactaaccctggataatggcattgtgataaattttccactggtcaaaaaatatatattgccttaaactcaaaactcgtccatcaacagtgaggttggctgtctttccgtgtgtttgttagccagtggtatctcctgtgtaaattaccttttgacatcctttgtttattttggttggtcttttacctcgtcgtcatcttactcacttttaaagagcatgaattaaggccgggcacagctgctcacgcctgtaaccccagcactttgggaggccaaggtgggtggatcacctgaggtcaggagttccagaccagcctggccaacatggtgaaaccccgtctctactaaaattagccaggcgttgtgatggatgcctgtaatcccagctacttgggaggctgaggcagggagaatcacttgaacctgggaggtgaagattgcagtgagccgagatcacaccactgcactccaacctgggcacagagagagaccccatctctaaaacaaacaaaaaaccacagtatgaattaattatttctctcttacatgttgtagaaatttttcccaaatctaccattcattttgtaaacataaactatatttctgtactctcttatagtaattgtagatttctagtgtttcacttggtttttgaatcgacaacagttttgtgtgtagggtattgtagtgtaagggatctgttttttcccccaggcagatagctcattttcccaatgcaatattcctttaaatattctgaataaaagaaaattttaaaaatcatttttgagcgatgggaaatgtgaaccaaaaatatgcataaggaatttttgattgaaaaacccagacgggggcaggagtttgaaatgaacttcccctaaaagccaaaacttgtagaggtggcagcctgagggctttccagagagctgtaattgactgtttctcccatcagccactctcctctttctcataacttttttgggcagccattaaagatctgatgacgagtgtgaatgtggcagcattttggcattttggatggtggcataattgcacatattgaaaaactctaaatttacatcggtggatccagtgcgtctcattatactggaggtgtgaaaactccatgtgcctctttgaacaattgtcctgctctgtcacagttcaggggaaacaaaagtagctccaacttcccgagatttaaatttgactttattccatttagttgatattgtaactagaatttgaatagtcttttccctttctgattttttttttttttttttttttttttttggagatgtagtttcgttcttgttacccaggctggagtgtcgtggcatgatttcagcttgctgcaatctccacctcccaggttcaagcagttctcctgcctcagcctcccaagtagctgggattacaggtgtgtaccaccacacccggctaatttttgtatatttagtagagatggggcttcaccatgttggccaggctggtcttgaactcctgacctcaggtgatcctcccgcctcggcctcccaaagtgctaggattacaggcgtgagccactgcacccagcacccttcctgatttccatttccgcttttatctctccactcccgaagatgtatcaacccacaaggaacttccttccagcccttacttaaaacattgctctttttccagctccagatattccctacattggctgccactcctccttgtctctgttcagtcttggaaaattggtttggtccaagctgaagctattctttgaagaaataccattatttttaaataaaaggattccccagcctggacagtgtagcaagaccccatctctaccaaaaaatcaaaactttagccaggcatgatggtgcacacctgtagtcccagctatttgggagggtgatgcaagagaatggtttgagcccaagagatcgaggctgcaggttagctatgatcgtgccactgtactccagcctgggcaacagagtgaaaccgtggctcaaaataaataaataacataaaaagattctcctttgagagaatcgcttgaacccaggaggcagaggctgcagtgagtcgagattgcaccactgcactctagcctgggtgacagagtgagactctgctcaaaaaataataataataaataaataaaaaagattcctccttccaggagccaagaactaggaatttcaagctgcaatcttgctttttaagcatggttatatatggggggtcagcagaatgtgtgaaaattattgaaaagtaaagcatgagatgtgactgagctcttgagagcagaccactttccccttcttaaaacgttttttttttccctgacccctgtctgagatacaggctctcctggttcggcccaccttgcccatcactctgctgggtccccactcgcgccctgcacctgaggttagagggcacataagtctcggggacctgccctttgatatctacaagaccctgtcctcaggggatcccatcgactctcgtggcttaaaataccatccacagaaggatggcgtctatatttatattaacccaaatattcaactgaatattcaacatctctacttggaaagacatctccggcttcacatggcttcaaaagagaactgttgacccctcccacacacaccgcctgcaccaccaatcccagtccccctgtcacctcgggaaatggcgtcaccacccaggggctgctcaggctaaaacctaggtgtgccctggggctccccctcctctcccccgacatgcctggtccaccagcaagcccgtccttcctcctggatacacctgggctcccagctacacgctgtcaccttggcccaagccactgtcatggccaccccaccaccacttccgttcttggctgccttctgtccattctctttccccagcggcctcagttttatttctaacgaatgcagttcagatctttccgtctccctgctagaccctctgatgtctttccatccaaccttccacattctgtgaccccacgtcgccctcactggctgggccacggcccctctagccccggtcttcacccttgaacctgcctagcctctgtcctcctcctctgcgccccgtggcttcttccactttcttccacctggctcacccggaattccagctacttgtgctcttcctgtcacacattgcctggtgtgtcatttccatctctgtctacctttccctcctagaatgccattcccatgagagcactttcaggccacttcacggcgtacgtccagccccaggcacagagcccggggtatcataggtgcacagtaaacatctgttgatgggctggctggattctatgtgggaagcataatgaccagtggtcacaaattactggggccagaggggcgctgcctggtgttaaccgcctggtgcctgccctacctttaaagccaagagtgtccatttaatgagcaagaagcagaaatcctgggcaagcagtgcagatgtaggctctcgggaacatgttgaccactcagaaaaccttccaggaggtgagtaccaggagatggaggtgctctagactgtgatgctgggaaaggattgtgggctagaaaaagggctccctagggccggcatatgggccactgggtggaagaggggctctgagaccctcaccctggagcaggtcatcacccacaccgaaggaatgaagcgtgaattcggtcacgcttaaaatgttgaattgttggcaaaagcccaagttaatgaaatagcatggaaaatggatgtgatgagatttttgaattgtaattagattaacattgtcactagttatcagtctgatatatcttataaatcaaacgttgggttgatttatcttttatcacttctagggacttactcctaacagtaactcacaaaccagccccaaatcagagctggtaggatgggctcccagctatctttaggaggtttgttggtttggggaagacagctcccccttggcagggctcaggtgttttctttcttttttcttttttttttgagacggagtcttgctctgtcatccaggctggagtgtagtagcacaatgtcggttcactgcaacctccacctcctgagttcaagcaattctcatgcctcagcctcccgagtagctggcactacaggtgcccaccaccatgcccagctaatttttgtatttttaatagagatagggttttaccatgttaacaggccaggctggtcacgaactcctgaccttaggtgatccacccgccttggcctcccaaagtgctgggattacaggcgtgagccaccgtgtccggctgggtgttttatttcttcgtctgttattcaggaactttgtttccagcgctgtgagtatgagtacaggcccagggctgggtgacagagtgcggagagcggggccctacccttgagctgtttctggaagggctcccagccagcaccgggcttagggagcagtgccctgcagtgtcattctgggccagggaggttgtgatgaatattattctcaacagagggtccccagggcagtgatgccactactcaggatcttacagaagaagaaccttcaggctgggtgtgggggctcacacctggaatcccagcactttgggaggccaaagtgggaggattgcttgagcccaggagttcgagaccagcctgggcaacatagcaagaccctgtttctccaaaaaaaatgtttaaaaagtagctgagcatggtggcatgcacctgtggtcccagctactggggaagctgaggtgggaggattgctccacccgagaggtcgaggctgcagtcagctgtgattgtgtcactgcagtccagcctgggcgacagagggagaccctgtttccaattaaaacaataaaaatcttcattttgaagaatctgaccagttctctacctggcacttgagtgaaaaatgacacaatccaaagtaggtggcagattggttctcactcaggcagaccctggagacacctctcccgcttctgactcaggggagagtgcggtgacataaaccaccttcttctgctctaggccagcttgtaactgttcagccagccagccgtctcctaactctgtgacccccggcccaagaacagggctcctgaaggccccgagaaccagcccgccgtccgcacggatgtacctggaagccacagtgccccacaccccgtgggactttctcccgaacacagcacctgcgcttcctgactcctctctctgaatctggcctttgagttcaatgtcctgggaacttaactctagggatgctctttccccctttagctaccgagtcacatgctgcgtctttggaaatttcaggcaatatttagtttggtgcaaaagtcattgtggtttttgcaattaattgcaaaaataataaatggaaaaatgaatttgtggacatcaggcttgcctagggagatgacctagggagaggcctcttttggcatagctcctgaacagggagaggtcctgacatgaataccccccgttttgtgaatcctgagccagtactgtgtccccggccccctcctcccccaacctatacacacgcctcactttcccttgcaggacgttttctaccacagttcctctctcctgacatagtatgtgtttgtttcttacttgtcttgccgcatgaggatgtaagttgcctgaattcaaaaacatgtcttcttttttgtgaatgaaagagtggctggcatgtagcaggtactgaaattatttgtagagtgaatgataaatctcagttcagggcactcagtgtggcctgggctacgtggaatagccaattggtggccacagagagtggccagccattcccaggctggcaatgtgagtcttagccactctcttttacagataatgtgcttattaaaatgatatcccaggcattccccagtggtgtttgaatcgtgaatgcaaatgtcagaggctctgaagtttaaagtctttttttttttttgagacggagtctcgctctgtcgcccaggctggagtacagcagtgcgatctcggctctgcaacctccgcctccctggttcaggcgattctcctgcctccgtctcctgagtagctgggattacaggcaagcaccaccacgcccagctaatgtttgtatttttagaagaaacggggtttcaccatgttggccaggctggttttgaactcttgacctcaagtgatctgccgccttggcctcccaaagtgctgggattacaggcgtgagccaccgcacctggccaggtttcaagtcttgactctaataaaaccagggaggtttcgctcagccacataagtgggagggaaaattaactgttgctttctgtattcaccaagatggcctaaaataagcaagcagaaaagggaagaaagaaaaccaaacccatgaggttgtccaagtcgatcttggcaggtattttcttgcctgttgattgctagagtttccctctacctgcattgcaggctgaaatgtatgactcagccctgaccaataacatagcagtaaaaagtagtttcccctgagagctttctcttcctccatagctgtgactgctgacatcttccactgtaagtgagaaaagttgagtgtgccctgctgcctcgtttttctcaccaaggtgttatgagctggtagggaaggccaggagctagggcagcagctttagaattagtgcaagagacaggaggacaagtcactgggtctcctgaatttcctcacctgcaaaacagggacagtttttaaatttcttttttttttctttttttcttttttgtttgagatggagtcttgctctgtcgcccaggctggagtactgtgttgtgatcttggcttactgcaacctctgcctcccaggcttaggtgattctcatgcctcagcctcctgagtagctgggattacagatgcgggccaccatgcccggctaatttttgtatttttagcagagatgaggtttcaccatgttggttaggctggtcttgaactcctggcctgaaacgatctgcctgcctcggcctctcaaagtgctgggattacaggtgtgagccaacagggacttttttttttttattatactttaagttctaggatacatgtgcacaacgtgcaggtttgttacatatgtatatatgtaccatgttggtgtgctgcacccattaactcgtcatttacattaggtatatctcctaatgctatccctcccccctccccccaccccatgacaagccccggtgtgtgatgttctccttccccaacagggacagttttaatcaatcccctttctgggtggtgtcaggacacccacagaggtgtgggtctaagcgctttgtgagtgtccacgtcctgtgcctaaggaaagcactagtcattcattcattcacccaacagttcctgacggcccacctcaacaggaaggaatattatacagccactaaaatgtaaaatcaccagtgctgttcagaaggacggagatgtttatgtcattggctgtgtgaccaaaagaaaaagttctgctggggatgtgggatgggcatatacgtgttttgaatataagatctttctttaatgctgttatatttggtctccataaaataattattctttgggtgacaacctcttagaaaaagaaagacaaaagcagctatttgcataaacctcagcccaggtgtggtctccagccccaggaaacttctctaacacccctcccatcctcccaccagtggttcctccctcggtggcatgaggtggttcagtttttttcctctgtgcccaccctggggtgccctgggcccatggccactgactgcagtgaacaattatgtgtgagtctgttagttcatttgcattgctataaagaaatacccgaggctgagtaatttatgaagaaaagaggtttacttggcccatggttctgcaggttgtacaagaagcatgacgccagcatctgctgctggtgaggcctcaggaagcttccagtcatgatggaaggcaaagaggacttgacatatcacatggggagagagagagtgagaagggggaggtcccagactcttttaaacaaccagatctcacaagaactcagagcaagaattcactcattaccaggaggtgggcaccaagccattcatgagcaatctgccctcatggcccaaacacctcccaccaggccccacctccaacactggggatcacatttcaacatgaaatttggaggggacactagccgggtgtggtggcatgtacctgtaatctcagttactcaggaggctgaggcaggaaaatcgcttgaacccgggaggcagaggttacagtgagctgagattgtgccactgcactacagcctgggtgacagagctgagactgcaccactgcactccagcctgggtgacagagcaagactctgtccccccccaaaaaaaaaaaaatatatatatatatatatatatatatatatatatatatatacacacacacatatatatatgtgtgtgtgtgtgtgtgtgtgtgtgttaggggacagatgtccaaagtgtgtcagtgtccatcatggctattagactgtcaggcattgaatatgggcccatgttttatttctctttatttcctcattgttgaacacatgggtgtgcctcctatggatgggaccagtggctgactcacctttccaaacttgcatcctgatgatctgtaaagtgtacccaccctgtaagattgtcgtgggacaatgtagataaaaacctcgatatacagcctagtacacaaaggacggtgtaaatattctcttccgtgcttcgtagatttcatttttgaacgctcagattgttctccggcaaaaaaaaaaaaaaaaaaaagtgcttgcagtgagaacctgccctgcactctcaggcgagctgttgggtgcaagtcctgcaggactgagctctgaaggccacccacaccctgggttgtgcttggatgatggcatccctcctggcacaagcgcagatgggcagtcgggagggaacatcagcctgggaaaactagatgtcagtgaaaaatgctggaggtggctggcgttcgcaaaactcagtcgtaaaaaacagcacgttctcagtacaaaatgagcactgttaaaaataaaccgcgcaagaagaaatatatgaatacgagggcatggcaaacagttttgcaaggtattaagatcgcattaatcttaattttattatatattaaagtttctaacttttcaaataatgcagttttcgttgttttaaaacgtctgagaattatagagctatttggtgtggctctcaggcaaggactcctgccatttattggggccctggttttatttaatagccagatgaatggaatagttaataaaagaaatattgctttattccctgacatttatgtccttggtttccaataaagaattgaaattatgaatagttgatggtttaaattgatgttttatgttgaacgctagctataatttgccctctgaggattgtaataccgagaaacagatggtttctcacagtaacaaattgctatgtgtatacacgctatagtcttggctttcagatactttcacctttggttctgagctgctctgcagacgggagaggggggtcgtgcggggagatcagcctctggaggaaggggtttcctgccctgtgggggagacacagacaggccctgggggttcagggaaactggggaaatgtagctagcctggcatggtgtcagtacctggggccaagaggagcgttctgtccacgatcatggtggcagctgcaaggtagtgcctgcaggactgctgtgcatgtggctgtttgacaccatgccgtgctgcaaactccacatcttcctagaacaaccaggagaatgccgtggagacttgttgccagatttttgcagttgccctgcagtggagaggttaagagcttggactccggagccaggtggctgggccactttgggggaagtttcccaaattcccacatctcagtttcctcatctgtaaaatgtgcataagagcaaaagccaccaccctgttttgaggattcagtaaaaccatccctctaacacaacactgagcccagtgccgggtatggtgtcagtgtctgccaggtaatggtgtaacgaaaattacaaagcagattgatgtggtgtgattcttgacgttacaaaagcttccttgtttttcagagggagttcccacaggggttctttagacaggcagtgcattaaggttgcagaaatttactttccagaaggttttaaaggaacgcagcttcaatggcagcaaggtacctgaaacaggaacccttccagagtgtctctgttttgttggcctttgagacctgccgcttctgactgcggggacctgggctgccccagatctgtctgtcagaagcctggagttgttaagctggtgaaatttaacaccactgtaaagagcccctcacagacaattcaggaacgcttacagatagaaaccggtcctggttttaaggtgtaattttgcacaagtgttaacaacaagagatggaattggtaacgaggcactggggtcggatcttcatatttttgtcacatttcatcggtgagatcagtaggtctgtctcccctaagaggagtgtggaatttagtgtttttccttttttgggctgtgacccaagagcttgttttcaagatatgtatttatttagaatacaaggctcttttccataaggaaagaaaatgttacagaaatgagctctcagttaattgaataagaaacctgttcgtctcatgactcacttaagagagagctggcagcccttcctgaatgcctattacaggcggcactgtgtccttttacttaatcttcccaaggaggatgagggttgcaggctccccaggcccatcgctgtgttggtgagtgacagagcctctgtaaaggaatggggatgagctctgagcccttttcccgtgggctctgctgcctggaggcatgccctccctcggcttgtcttccagctctcgcacagaaccaagtgttaactggtggtggtttggagacgagaggaaatggaccgtaaggaccattgagttggcataaggagaccagggcccaactccggaccctaccagagcagagtctttctcctctgtaatgtgagactgtagagctctagaatgttccttctccaactcagagctgatgctgtcagggccctgctgcagggtccttcagtggctccctgtggcctgaaggacaagccagctcctgccctggaagccgtggggatgtggtcctagcctgtgctcctgcctcgctcacctccctggaacaccagggccacctctctgggctcctcctgtgccccagtctgctcctgccacccctgtcccaccgtgcttcctccctccctgtgcctcagctcaggccttgccacctggagctctgacctcgtccgtcttggaatgaggcacctgcatgggtagcccatgggtagagttgcagtcatctgtttgctttcgattcactcccgcatcccgacacagtgcccagcacatcatcgatgaatgagtgtggggcaaatgcttgcacagaagtccgtgcgtgagccacgacggtaaacagaggcgctcctcttgtcctaatgtggaactccccaagctacgggaaaggggtgcatatggaccgctgctcactcacggctcagatacttccacggtaatgggttggcgacagtgactcagcttctcataggttcaagcggaagaaatggtgagtcctggagcactgcttgctttgaagtctgtttcagactagggtcatgtttcaaagtttttgaatttcttttttattcaaaagacatttgatgagttgactattgggggaaccttgaccccggtgactccgtgggacaggggatacccccggggtcccttataagcctgctgactcaccgcctgttctccatcttctgtcttccacattagaagcaagggcggggacattgcctttcccggccgctgcggtgtcctggcgcagggcacgtgcctgagggcccttggtcatccgagggaggactgcaccagggacatcagagtgctgatcttacaggaaacggcaaatgaatggaattggtctgactccatattactccttacttagatgtaaaacaaatacacatgatttttcatcctagaagaaagtctaaacgaactcttgacaaaaacagccaagttcagagaaagctgactctgttggtgtaagaagcgttttttcaggctgggctgctggctcatgcctgtaatctcagcactttgggaggccgaggcaggtggatcacttgaggtcaggagttcgagaccagcctggccaacatggggaaacctcgtctctactaaaaatagaaaaattagctgggcgtggtggcgcatgcctgtaatcccagctacttgggagactgaggcaggagaatcacttgaacccgggaggcagaggttgcagtgagctgagatcacgcactgcactccagcctgggcaacagagcgagaatctgtttcaaaaaaaaaaagaagaagaagctgttctccgtgagtcagccccggtgtctgataagtgtctgcagctgacagctcagagctggtgtcaacccactttggaggctggggtgggaggcaagaaacccagacagaacccctcctggctgcaaaacctccaggcttaactgtggcgcccactccatggtgggtcttaactctcctgaaaacacttcatgggctgtgggcctctcgggtgcttctgcgccagctcttcctcttcacctcctgccacagatctgtgtccccaggctctcctgtgtgtctccctgctcctcctttccctccaggtccgattccacagccctgggctgcctttccacctctgccttctctggggtatgtcctcgcctctcctgtcaccattgtcctcagggatcttccagctttccaggcatttggaaagaggcctccataccttgatgtggcctcccaggttccttgcgacagagtcctgcgtcgggataccaggggctgggcgcggtggttcatacctgttatctcagcactttgggaggccaagacaggaggattgcttgaggccaggagtttgagccagcctcggcagcataatgagattccatctctacaaaaaaataaaatttagccaagtgtggtggcatgcacctgtggtcccagctactcggaaggccaaggcaggaggattgcttcagtcctggaggttgaggctgcagtaagctataatcgtgccattccagcctgggaaacagggtgagatcctgtctcaaaaaaaaaataataataataataataatatttgtaggggaaggacactcagatttcctactggaagcaaggcttcctcattccatcagattctgctcctcctccaaggctcggctcaggggcctgcccctccatgaaccttcccagccctcagcccccttccttcctattcccccagcaccgacgtcacctcatcctgcccgactctgtagcatgcaggcctccgtcctccacccagctgcagaaccggagacctcaggtggtatctggttccacgtgtccccaatggcacctcgcctggaacgatgtctgcgccgaccagtgataacaatcgaaatagcaggcgtggctgaccgtgtgccgaggctcggcgtgccgcactggccagccgtgatttcatctcagcctctagcatcctgctggggtaggttaataatccctggatttctcagatgggaaatgttaggaaagtctgtaagcccccatggaaggtcccggagcccaaattcaaacccgagtggagcgttctgttgcttcactgtgctctggtgtgaattttaatgtaaggccctggcatttaagagctcgaagacaccatggaggtggagagctcagccctgtcattggatggaagctgagactggtgagattctcaccggggcttttgcagggagtttgggggaattttgaaggtggtacaggtgttctgaccccaacaccatctcctccagctgggccacacacttatttcctgctcctacccccgtccttcccaccccttggattctgggtgtacagaagagtgggcacatgctaaggtcagccctgggttagcctcatggacaaggtgggcctggagcaggaacccgcctgatagaagacactcaaagtctgtccgtacacgctcggtgtgggcatcgcttgcacgcaggtgcagcttttgctgtgggaaaccactttaaatgaattgatagcctcaccacagtggagccatggcccgactgtggagagactccattgtagagaaatatttgagtgaaaggtttcatgtcagaatagcatctgcatgcaaataagaggcatgggcgggtgcagtggctcacacctgtaattccagctacttgagaggcagaggcaagatgatctcttgaacccgggattttgagaccagcctggacaacatggtaagaccccatctcttaaggaaaaaaaaaaggtttaaattagctgggcgtggtagtccccgtagatgaagttatttgggaagctgaggcaaaaggattgcttgagccctggagttcaaggcagtagtgagctatgattgtgccactgcattccagactgggcaacagagccagaccccatctcttttgtttgtttgtttgtttgtttgtttgttttgtttttttgagatggaatctcacccaggctggagtgcagtggtgagatcttggttcactgcaacctccgcctcctgggttcaagcgattctcctgcctcagcctcccaagtagctgggattacaagtgcccaccaccatgtctggctaatttctgtatttttagtagagatggggtttcaccatgttggccaggctgatcgtgaactcctgacttcaagtgacgctcccacctcggcctcccaaagtgctgggattacaggtgtgagtcaccgcgcctggcccagaccccatctctttaaaacaaaaaagtacatgggataaatggggaaaacactcttgagacaagaccaaaacatacagtggctgctaaatgtcagtgccatgagcccagggttctcctacatccccttccgtggtcagggaggactgctgggctctgtgtcttctgtgattctcccctggctctgagccctttgcacctgcaactcacagcgccgctcaggtccctgggggtaaagtgccataggataaaagccacaggagggttttgaaatgctcttttcctctcagatatgtatttccgcatctttacggagtctcatcaacgctttttaaacctcccctgggatttgaaccagcgcccatagatacaggtggcttgtcaggtcagctaggtgctgctactgaggcagcatctgtccctagccccgcacccacaggttcagaaggggaacgcttcccccgggtggcttatgagatccagtacttctagtttcacttctttaaaaataccgtaaaaaagaaaaaggctgtcaaaacacaagcagtgtttgaaacgaagctttgtaggtccccctacaccaccaccgtcgtgggcagcatagcggatgagttctgggacaccagctaaaatgtgggcaagagaagccagggcgcgtagcagatgtgtgtgtgtatctttatgggattcaagtcatgtctctgttttgttgaccaacttccgctagaattcatagccatctagcctatgtattggatttttatttctgtgatgtctgcttcttttaaaaatatcagttggggccgggtgtggtggctcatgcctgtaatcacagcactttgggtgaccgaggggggtggatcacttgaggtcaggagttccagacccacctggccaatatggccaaaccctgtctctactaaaaataccaaaattagctggacgtggtggtgtgcacctgtaatcccagctactcgggaggctgaggcaggagaatcacttgaacccgggaggcagaggttgcagtgagctgagatcgcgccactgcacttcagcctggggaacagagtgagacttcatctcaaaaaaaaaaaaaaaaaaatcagttagtagccaggcaccatgcacacacctatagtcccagccactcaggaggctggaggatcacttgagttcaggagttcaagaccagtctgggcaacatagcaagacctcatctctacaaaaaataaaaaattagcagggcatggtggcacatgcctggagtcccagctccttgggggaggcaggagcatctcttgagcccaggagtccgagaccaacttgggcaacatagtgagattccgtttcaaaaatatgtatcagtaggttaatctagactttgtttacatgggccaagtggccaaggtcacatcttagagttgtggactgtataatcaggtaagtgtggctacagtcacagaaagtcagggtagaaagaggcttggaggggggtgcacttcttctagccagagctttcctactgagctccttaaagcacaggggaaagtgggacggggttggggggcaacctaaaacccaccccctcccatcttcaaccagtgcgaccctgtttttacctgctcagcagtattgtgcatccctgtaaaattttatttgaaaatggccttctgcagttaaaactacaaaaaaaggttgaaagtggccaacttaaactccactctgtttcttttttgattggggagactggtgtgcatagaagggaggtgtcagctaacgagactgttacctcaccacagatgcccacccgtgggtgatggagctcccaagtcctgggccacaccctacgtgccccatgcccagcaagttgggtgggggaggggtcagtacatgtttgtaagataaagaaaaacatccttcccaatcagccgtattacccagagggtgatactgatttagatcttatttcagtttggttagagaagctcaggtaccagtgagcagaagtctggccattgtggtggcttctggaagatgatgtgccatactgttagcaggggtgcaatttggggtgtgaggccaccagagctttgatttccgcccccgccgcccccctccaacccccgccccgccggattatttggagtttttttattgttgttcatggtaattacctgctattagacaacaatctagttccatttgcaatagggaataatacgtctgtgacacagtctccagacttagggagcctctggccaccccgagggggccctggtcattctgctgctggtcatgcctagctctgggtggccgactaggtggcctgggcgggagggtccactctttgcctttataaaaagaagggcttgggccaggcgttgtggttcatgcctgtaatcccagcactttgagaggccaaagcaggaggatcaccttaggtcaggagttcaagaccagcctgaccaacatggcaaaaccccgtctctactaaaaaatacaaaagttagccgggtgtgtggtgggtaccagtaatcctagttactcgtgaggctgaggcaggagaatcgcttgaacccgggaggtagaggttgcagtgagccgaggttgcaccattgcactccagcctgggtgacagagtgtgactccgtctcaaaaataaataaataaataaataaataagataacaaggcgtgctggagatggccacaggcctccagcagccgcaccatcagagaaatggagtcagagagagctgcagctgctctgatggggggtgggagtatgcaggatcctctgggggtggctcaggcctcccaggggagcacttaccttttcatttcatagtatgtcggagctgctgatgcaggaataaagcaaagtgcctggcactctgcgcgactgctattttttcattcattcatatatttgtccttcctctacacatgtatggcagattaacaaaagcacctccacggcctagctatgtggcccccacgggtttcttagcctctctgagcaagttggacagggctgccttttcctctccctaactctgacttctgtcccagcctcttccatctaatgtcagccctcatccctgcctgcccctcccggtgcagactgggacattctcaggctgtttgagccaccccttcatcctctgtgcttttccctggcatcctggactcccttctccccttcatggtgctcctaggccattcccagcgctcctgttactctctctgtcctcccagccccaaacccgtccagctctgtatccatctgcctggctgccattcatgctgcagacgtagcactcccagagcccatctgtctccacacattgaggcttccagccccctaaccccggtagtggccacagtgcccagtgggccaccccagccaagcccaagagtggccacatgggagcccttcttccatctccctcccctcatccacacattaccaagtcttgccaatttcatctcctgaggacctcagcttctgtcattctctccccattatactgcagttgccaccgttatttctctcctagaccttggctggcattacttggacattcatttctttggaatctcttggccagctttgcacacctttaactagactaagaagatttgaggccaggggcagtagctcatgcctctaatccccagcagtttgggaggccgaggtgggcagatcacctgaggttaggagtttgagacctacctgggcaacatggtaccccgtctctattaaaaatacaaaaattagccaggtgtggtggcacacgcctgtaatcccagctactcgggaggctgaggcaggagaatcgcttaaacccaggaggtggaggccgcagtgagccaagattgtgccattgcactctagcctgggtgacagagcgagactccgtctcaaacaacagcaacaaaaaaggaaatatgagctcccttcccagatccgtgcctctggacctgggctgaaggcttctactccctccattgtcaccttcgggaatctgcttgttaccttcctcccaagaatgttccagaaggtcttggtttaatttctggagggcattcaagaactcagtcatctcacgtgtctagaagagaaacattaaggccaggcacggtggcttatgtcggtaatcccagcactttggaaggctgaagcaggaggaccacttgagcccaggagttcaagaccagcctgggcaacatagcaagatctcatctctacaaaaaaaaaaaaaaaaaaaaattagccgggcatggtggcacatgccattagtgtcagttatttagaaggccgagacggggggatcatttgatcccgggaagtgaaggtgctgtgagctgcgatcctgccattgcatccagcctgggcaacagaacaagaccctgtctcaaaattaaaagagagagagaaacaaacatggcagctcagaaacctggctgggggtgattgtggggaactgctgctgacgggctcttgggcacacccctcactccagccattctgcctggatgccttaggaacactcctcataccctcctaagagtcccatccaggccgccatggctcacttatccctgccacgtggactccagaaaacattctcagtagaaacccacagaaactgttcccagtcacaaagcacgccaggtgcatcctgttctttctgtcatttaaaaaaatgaatgtgtctctatccctccttcttataaaacagtaccctctcaccctgcatggcttaaattctggtctatcttacgcctttggattcaatgaccttcatcaaatgtctgcaaggcaagggccatttacagtaaacatggtgggaacttagcaatgtacttgggaaataaattctggtcaccaaatagagaagcaaatgcaacaaataatcccacagaccattataaaatgtcttttagacgatagttgtcaagaattagagttactcgtccaaaactgttgttggtgtttggaagcatccaaacatcggctggcccatgtcccataggggcgtctgcttagcaccctggtgagtggagagttgtgtgtatggggacttagcagagtgggaagcagcttgcaggaaggttgccaacgcttattaatatttaccaaaaagatgcaggaccggctgcggtggctcacgacagtcctcccagcacttagggaggccgaggtgggtggatcacctgaggtcaggggtccaagaccagcctgggtaaaatgtagaaactccatctctcctaaaaatacaaaaattagccgggcatggtggtgcacacctgtagcccagctactcgggaggctgaggcaggagaatcgcttgaacccaggaggcggagattgcatgagatgagatcgcgccactgcactccagcctgggcaacaaagagcaaaactccatccaaaaaaaaaaaagagagagagatgcaggaccatctgcctatgttccattttggtgatgatatctgaccttctgggagagagaacatcttaccccacagacccaggaaggcatgcacatgaggatggcaggagagtggctgtggacacttcctgtgtcaccatcctctgctctaggtgtgtactggtcacaggcacaggacagaaggctccccagagtccgatcccgtctcttgagctcagctggctatcctggaaccccccaacccgctgacctttggaagtggacagcagcccacgcctgcaggtggtccggccctgctgtgcagccctgttacagcacgttgtgtttttctggcttgtctctgccaagccccatgtgaccatggagggggccccgagcagacctgggggtggcggtactgaggcagaggcaggcgcacagtggtttccaagggagaaaatgaattcatgatctaaaatgcaaaaccttaattatgcctgactcctttcctccctccctccctcatttctctccctccctccctccctccctccatccatccttccctcgtttccttccctccgtctttttccttccctcccttacttccttcctctcttcctcctacccttcattgacctttcattttgtgactttgtcaaatacagccccaggctatcttctctttctcctctgctccaggttgttttctcttgctcctctgccgcatacatacccttccaccctgcgtctgcccatggaaatctcgtgtcccctccagtattcctgcccacagtggcctttgttaggaaattccggcacagtctcctcacagggcagcccttctgggaatcgctcccctgcgctcgtgtgcactcccctgcgctcgtgtgcactccggcccagccttcagagctgcttacctggctcttgtcttgtgtcctctgaccgcccatcagggcctgcccatggggctctgtctgcaggggagcagccccaaacacagtccttgtcagcacgccgatctggacctgaattgggcccttgcacacactagctgtggaccgaagacaaatcaggttctccccgtccccagagtggggaaagcggtagtgtgggcctccctggggtgcccatgatggtgtaatgagtgcgtgcacggagcctgctccacgtctctatggacatttccataacttttcttttggtttgtttttttgtttgtttgtttgtttgttttgttttctctgagacggagcctcactctgtcacccaggttggagcgcagtggtgcaatctgggctcactgcaacctccgcctcttgggttcaagagattctcctgccccagcctcccgaatagctgggattacaggtgcccaccaccacgcctggctactttttgtatttttagtacaaacggggtttcaccaggttggtcaggctggtctcaaacttctgaactcaaatgatcctcccgcctcagcctcccaaagtgctgggattataggcatgagccaccaggcccagctaacttttcaatttataaacactaatacctacttgtgtcccgtggcctcatctcagccatgtgaggccgatgttgtgcccattgtacagatggcagagcgcagctgtgtgtgcagtgcggattgcaggactgtgcctgagtctgggacagggtctttgccacagctcttgggatcctctcttctcatcaatgttatctcagagagctttcactgttggataagaggttgaccctggaccccaccccagtgctgctgggccctgtgggcactcacagagcagtccttgctggcctgactcatattcctgagtctcaggggttcctgtgccaccagagaacgaactccccaactgtcagtcactcagctcagtgcctgtatcttaaattgggcacctttagcaaaagtgcagtgtggaactgtgtatcctgctgccccagcccaggacctagcacagagccgggtactgtgccataataagccttggtaaaggctgctgtaggcttcacagtacagatggcagggctgtgcccgggctgcaggctcccatttaccagatgtgtgcagtgtggattgcagggctgtgcccggctgcaggaacacatttactggatgtgtgcagcacggattgtagggctgtgcgtgggctgcaggcacacatttactgggtgtgcacagtgcggattgcaggactgtgtctgagctgtaggtgcacatttaccgagtgtgcacagtgtggatttcaagacttagagatgagacagccagttcctgtcctgcccaagggtcgggcagggatacgcatcaaagaccctgggcatctttcccagcccgggcggtgcccccagccatcgcttctcagcaggacagccggcagggcatctgtcgtcttcgtccaccagcatcacgacctgtttgggggagaagtagtatttccacaccccactcagggcgatagcgtttgaggaagaagagaaagagagacttttggctttcctgatttcaatctttctgaaggtggacccatcactggtgaaaaaaattggtttttttggaaccaagaaagcagcctcggcctccagtgcctgaccaggctctggccagggtataggatcctggcgaggatgctgtgctgtgttgggcaggaagccacttcctccctctaaacgtcagtgtccagctctctcttcgtcgctttcttaagttgagggagctgctatgccaagggcaagcaagaaacaggcccctgagcccccaggttcacggctgggctttgaagcaggagtttcctcttcgccctcgggccacacctctgtagggtgcctctgcagcatttccctcctcgggcaggagcctagcttgcagaggacagacaggcaggaatgctggcctccatcgtgccaccagatcctgtccccaggcaagcaggaggggaggggaggcagtctcatcactgcagcaggaggggccacctctggagtccgcatggctgtggctgggctgtgcttctagaagcagcagctgtcgcctccactctctagggatttttatctttcctttacaaacttttttttacctttttttttttttttttttttttaagatggggtcttgcttgttgcccaggctggtctcaaattcctggactcatgtgatcctcctgcctcagcctcccaaagtgatgggattacaggcatgagccaccgcgcctggccgatttttatctttcctaccagccttttcatatgagctgagcctgcaggctgtgcctaagcatagccctttgaacttgattgaccatgagctttgaaaggctgctttgcagtctcagttctctggcaaatacaccagctcggttaagacgacttttctttgattgatgtcggctacatctagaaagcaggattgccaccactcctcgaagcaccccacgattagagtgtctgagcgctgcttctgctctgctgaggctggtgacaaattgcctggaaagacctcctgacagaggatgacgggctcgtctgcagcagggccgcttgcagcccaattgcttccaagattaaacctttccaaggcagtctgcactgccccatacacagttgggctgcttggtttaagattatggatgaatgtactgaattggatctcatttaaaaatatataggttttgaagtttgagggctcaggaagaaaatgaaatcctttgtcccaaaccagggcctggttttatcagtggcatgcgtgcgtgtgtgtgtgcgtgtgtgtgtgcatgtgtgttctaaagagaccctagtggcaaggcacagtggcttatgcctgtaatcccagcactctgggacgccaaggcaggaggatcacctgaggtcaggagctcaagaccagcctggccaacatggcgaaaccccgtctctataaaagtacaaaaattagctaggcgtggtagcaggcaactgtaatcccagttactcagaaggctgaggcaggagaatcccttgaatccgggcggcggaggttgtagtgagccaagatcgcaccattgcactccagcctgggtgacaagagcaaaactctatctcaaaaaaaaaaagagagagagagagagaccctagtttagctcttttggaaagcagctgccctgcattgagacacatgtgtcttaagcttgcttctggacgctagcactaaaatagcaatcggactctggatgcctctcacaggcaacttgtccacaaaaccacttccaaatgttttcccaagtgcatgcgtctgacccaggcttctttctcatccgcctcttgtggaaggaagatcgcatcttgagttctaaagatttttaaacaatctcatacctgcagagcaatgtatatttcaagaccattgacattggaaaacattcttgtttaatcaatgactctggtcctgctttagatttctccaaaaatagccagatcccgtgggcacgttgaagctgcagcccattgtgcagaattgcttaatgtgtacctcacctggttttggccttcacacaactgttgctcccttagcaaggggttcatttggttgggttttatgtgcaggaatgctggtgggttgggtgagtattagtatttaagggaaggttttgtttttgttttgttttgtttgtaagagctagggtctcactttgtcacccaggctggagtgcagtggtgcgatcatagctcactgcaacctcaaactcttgggctcaggtgatcctcccacctcaccctccctgagtagatgggactatagggtgtgcatcaccatgccaggctaatactgtttatttgtatttttgtagaggtggggtatcgctttgttgcccaggctggtcttgaactcatgggcctcaagtaatcatcccaccttggcctcccaaagcattgggattacaggcatgagtcaccatgcctggccataggggaagatatttttaaacaagatttgcttttgactagtgtcctgcatttgttaaagaccctagattgctccaggtgttctaaaaataaccaagcccacctgcctgccttctagatatgggctggagggcctgccaggagcattcttggggattgccagtagccccagttagcccaggctgacttacacttcctccctctcttaaccaaaataatgttgaatttttgtgttccttgtcttttaactgaaaagctcctgtttgtttgtttgtttattttctgagacagagtcttgctctcttgcccaggctggagtgcagtggtacgatctcagctcactgcatcctccgcctcccaagttcaagccattatcctgcctcagcctcccgagtagctgggactgcaggtgccctccatcacaccaagctaatttttgtatatttagtagagacagggtttcaccatgttggccaggctggtctcgaactcctgacctcaggtgatccaccgcctcagcctcccaaaagtgctgggattacaggcgtgagccaccgcgcccggccccgtttggtgtttttaatgctgtattgccattatttgcacttattcttttgcaaaatttcagcacctggtggtcaggatgttcctcctggccatgcacatgcaggacacacaacaggttcttgataagcgtgtgctgagcaaaactcactccttccttctggacacattcatcacaggtgtgctcgaagcagcaagagcttgcccctgctcagaagtgcttagttgctaattagatgtttccgcaaaggtactgaaattggaggcatcagtgttcatcctttagctatagcgttggaaaaatgtgattgatttacaactgtgactaaaaaggtgtttagagaactgttctatgtaaaacaagacagtaagctgggcacggtggctcgtgcctgtaatcccagcactttgagaggctgagatgggtgagttgcttgagctcaggagttctagaccagccggggcaacataacgagacccccatctctataaaaatatatattttttaaaaagctgagtatggtggtgcatgcctgcagtcccagctactccagaggctgaggcaggaggatctcttcagcccaggaggtggaggttgcagtgagctgtgcttgcaccactgcactccagcctgggcctcagagtgagaccctgtctcagaaagaaaaaataaatatatatagtgtgtgtgtgtggttgcaacttttgcacatcaccttgagttctgggcaaggggagaggaactgagattggtcactcccttcttgcgtggatggctgtgggatttgggtgagttttttgctccatagtgcttttcaccctgtattttctcataggttttgccccactggggctttgtatagagattggggctctcaggtcccatatggcacttactagcgagagttccgagtggccagtcccctccctgccctggcattggtacaagggggccttgctgttggaccacagtcttccaagagtccagctcccctgttctatcgagtctgaagcaaggtcccacttgggagttacagatcaggctcctttgatgtcagagcatcgcagcggaattctaggccacccggcagtgagtgctctctgcagatctgtgagtggtgctgggccgccctgccacctccatccctagcaccgtatctgtgtgaaaaagctgtgacctgccccttgggtggaagccttccagtccttggaaggggaatctttgctgctgctactgtctgcagagagactctttttatttttatttatttattttttttgatggagtcttgctctgtcacccaggctggagtgcaatggcacaatctcggctcactgcaacctccacctcctgggttcaagcaattctcctgcctctgcctcctgagtagctgggactacaggtgcttgccaccacacccagctaatttttgtatttttagtagagacagggtttcgtgttggccaggctcgtctcaaactcctgacctcaggtgatctgcccgcctcggcctcccaaagtgctgggattacaggcgtgagccaccaagctcggcccagagggactctctagagaggccccttgatcccacaaggggcgggggtctctggccaggcacagcccctccccactaagcccagcacctggtgccgaacacacacacacacacacacacacacacacacacacacacgcccgccccccgctccactgttctgttgtcagttgtgttcgttgttttcttgtaaataaacagtatgacaataaagggaagttacttcttagctgctcagaaggtgaccagagcagggctggagtgccagccttgcattcattgtttgctttattgcaaggctgcttggaattgaaggggatctccgttcgagtctgagctggaggaaggaaggggctcctgtaccatgtatagaacttgggctctccccggggtcaggggcctgggctctggtgcagccccaccacttcatcaggtcaccccaggtggtttcagcctctgatttctcatccctggaatggggtgtttgcagcctcgtaggttgctatggggattgaatgagatatgttcatgagccagtaaggcagccaagatgtcacttacatggaacttacattgcaaccccagttttagaataacataggatattaaatatcaccatctccttgaatactcatagtccgcagtttgcttcatgttataaggtgtttagttctaggctgagcctgtaatcccgccactttgggagactaaggtgggaggattgcttgaggccaggggtttagaaccagcctgggcaacatagtgagacccctgtctctacaaactatatgtatacacgtataaattttataaagatgtttagttgttctgaatttcctaaaaaatacagcttaacttttttgtcttcctttacctgcacctggatgcagtgggaaagattttcccagtagcacaaggtggaccaggtgagctatcctcacccaatggggctgaaagacagggctttgatatcctgccccagagcccggctgttaccacatggtttgatttgcgatgccaagcaggcttccttacgggtccacacacctctggtttttagcttgagattggggcagctgttcctcctctggcccagccaggtataatcaggtacaaaggaaagtgacctagaatgaagaggttgccctgacctggtggtggaattggagcctgggagcacgggtcggatggcttagttcatctgtttggcagtggatcaaatccccctcctcccacatacttgatttatgtggactgggaaagaatgttgggtttcaacataaagaaaacaaatttggctgataactcgtaaatcacaataaactttcattccaagagtgttctgggcttctaagaaatatattcctatctcacatctcagttgatattcacagccaccattgagctagagtcattcccaggtggagaaactgaggcttgggagttatgcctgccttggagagggatggggctaagacttgggctctggtgtcctgaccaccgagcctggttccttccacgtggtctgattcctgggatgtgaagcagccatcctcacagggccacacacctggacaggtacacagtgcagcaagtagagaggcaaagaaacaagggaattgatcaggggtccacacgctttctctaaaagagcctggtgctacatatgttagtcttgacggagaaagaggcaaaatcaggatatcatgtaggcacttatataaccactttaaatgcaaccatttaaaagtgtaaaaaccattcttagctcatgggccataaaaatcccagcagctggctggttttggccggcttgccgcagcttgctgacccctgggagagagcatctgctgctattgcaggcaggggactgcaggtcatccccctgtttgggtcccactcctgcccgtcattcaggctctgtcagcttctacccagaagtacctgggagtcgggggttttgctgtgtcacagagaacttggctctcgatagagtcggaaaggaattctgggaaaactctagagatgcattaaaaaatctccactgggccgggcgcggtggctcacgcctgtaatccctgaggcaggcacattacctgaggccaggagttcgagaccggcctggttttttgttttgttttgttttgttttgttgagacagggtcttgctccatcatccaggctggagtgcagtagcacgatcatagctccactgcagcctcgagctcctgggctcaagcgatgctcccacctcagcctcccaagtagctggaaccacaggtgtgcaccactgcacccgggttaatttttttatttttgcagagacgatagtctccctatctttcccaggctggtctcaaactcctgccctcaagtgatcctcctgcctcagcctcccacagggctggggttatagacgtgagccactgcacctggcctctttcttcttgaggctagttttcctgactgcgtgattcccaaagcttcaccccactgatgctgggttcccctcctctgtctactccacctgctgaggctggggctctcagggacacagtcagcagctcagcctctggaaagacctggaaagatcacatccttctgggaacctgcttctggaggcacaagtagtgtagctcctcttaggccctttcgatgaagtaagagcagctcattagcatcccaggctacaaagcctaaaaccctttgcttttaccaaaaccagagggtctaaagagaaaggtcacgaggagcgagcggccgcgtggatgaggttggccagagaaactggtttgttttggaagccgatggaagatgcgcttggaaggctaaggctgccgaggttgaagtccgtcattctcagtgcagaccctagggaggaagtagcaggaccccagtggggctgcaggcattcagaaagagagctgcctggggtttcccttcagaacctccctccttttaacccgggagtaaagagaaaaagacccgcggggtccactggctcggaagtcggtctctttcagtttggagcctccagttggaaacctgccttttaatggccaggctgatggtctagttactctttgaacagggaagcctcgtcaggctctctgctgaccacgcctcagtgctccctcgaaggacaactctggaatgccagtttttatctcatctcggtagaatggattttttttcttttcttttcttttctttctttgagacagagtctcgcgctatcacccacgctagagtgaaatggcacgatatcggctcactgcaacctccgcctcccgggttcaagcaattctcatgcctcagcctcccgagtaactgggattacaggagcgcgccaccacacctggctaatttttgtatttttagtagagatggagtttcactatgttggccaggctggtctcaggcgatccacccgcttcagcctcccaaagtgctgggattacaggcgtgagccaccgtgcccggccctagaatgaatttttcttttagggaaaataaggttattggtgaatgggtttgggctgtcatcttcagaaactgatttcatctagaacagtttgtgacgggcagatgtggaataaaaccactggatgcatcaggcgtcactgccaagggtgcaaggggctgctccatgctgggcgtgcgagaggagcaagaagccgtccccgcccaccacggtgcaggccgggatgcagcggaaagcccttgcttcttagatttcccacacaaaagtgtatttcttgtagatttcgccagcgcgggcctcctcctctgcttggcagtggctctgcacgagctgccttgggatggatctctcatctttgctgctggcctcatccaaggaacagaccccatgcacggagcctagatgccccgaggtcttcactgatggccctctgaatttttattttgtttgtatttcatttgttactgattgaatttttgagacagggtctcgctctgtagcgcaggctggagtgcaggggcgcgatcctggctcactgcagcctcggcctcctgtacctaagccatggccctctctgactttgaacccctcagttcattctcagatcagaccactcactcactgaggccctcggctcttccacaggtctcagccttttgccccttatagtttttagttgttgcagcctttctgttctcttcccctctcctgttaaggggacatttccaagcaccctggccacagaacctcctcacctcccaccctccgcccctgggtgccagggcctgggttctctgtggaagtcctgccagctccgggtatttcccacgtggatttctcatcatcttcaccaccagatcagttcctggcctgcacccctcctgtctggcttgtggcaggggctgccaccctcacctgggccctaaacttctacaaagccccactctctcctgttcccgtcagtctgcttgccaagtccagtttattttaattctggggaacgttgtcttcctcctcccccctccctcgccaccacccacctctggtgttttttttgttttgttttgttttgttttttttgagatagagtctcactcttgtcacccaggctggagtgcagtggtgcgatctcggctcactgcaacctccgcctcctgggttcaagcgattctactgtctcagcctcctgagtagctgggactacaggcacccgccaccacacccggctaatttttgtatttttagtagaggcaaggtttcaccatgttggtcaggctggtctcgaactcctgacctcaggtgatctacctgccttggcctcccaaagtgctgggattacaggcaccacttctggttctgttaccttcgtccaaacttgtatttcccagctggtatcttccatctccaggctttcccctctggcctgtcctttagcaggagtcaccttcctgaagcagaccctggtctggtctctgcgtactaccttttgcatggttggtggccgtccacccgcctctcaggccatgtctgggttcttctaggggcttcggtgatctgggagcctgtccccgctggccccctctcccatgtcttactccatcagcttcaccttgtttgtatctctggatctcctcttttttccttctgtttgtatcttgtctctttctagaaagcccccccacctctactcgcccctctgtggcaaatatcacccaattcaggtgcccccagcccagcaaagagggattttcattccttgggcccccgttgtaggctagctgcgcctgtctttcggcacatttcatttcctgcctggtatttcggtcgtgtgcgtgtctttattctcctcgtgtaatccctgaggtgcagagtgcgtgtctgtcctcctctgccctctctagagattgggatatgaccagtgttcagcccccaaccaaaagagcctaagaaccccaggtccccagcctgtcctgctctgctgggggcccacatgcctggggacaaggcacctttccttccctgaccttgactaggacaggacatggggtagggcctgaacattgagcaattgtcaaactgcctacttacgatgaacaaaatagcttttcaggaggcgagaccacagcacagtcatggtgaatcctgatgcgcaccccaggtcttttatcaggatttttgtttttcctggtgggcacagatgtaggtggagcagatcagaggcctctcaggttcttgatcactcatggcagttcaggcctgccagtagtgaggtcagagatccatacagcaggggagagaagggaggtacagggaaccctcggccccgcgtgctccagcaggtctgcatgattaacctgaattgcagtgttcagaggctcggcctgccagccacagcggttccagatgaaatgcagcttagaaggcagcatggtgtagtagctttggcgccagccgcacccagagtttggattgtagccagatggcctcaggtgcaatgtataacctctgggaattccagatttcctatttacacgacagggatgattccatacctgaagggctgtttggaagcatctagaagcaagcacagtggagtggctgtcatgacgctgaccgcacaaatgatggtgttaggatccctccacggatgtggccaggtgacacccctcacctaggccgcacagcaccctaatgtacacactgaagaaaggctgcgtggggctgcagagcggctcatttctaagaaggccaaagaaattgctcagtccagaccagggaacccagtttctcttttagaggtgggatcttgctatgttgctcaggctggtctcgaactcctgacctcaagtgatcctcccgccttggcctcccaaagtgttgagattccaggcatgaaccactgcacccaacctgtagcctctttctacaagtaaaataattcaggtgagttcaggcccacgccaggtcttaaaccctggccctctgcccatcttccagcctccaccccttctctctccttacagaatcttctgttcttctgcacaccagcgtggcagacaggttggccaagggccttggacttctttatctctagtacatgttcctgtaaatttaaacctcctcagttgggtaaaagctttggaattactaacattccttttgtgctgcctaacgttcttgccatttaaaagattagcaggcataatttcagtgagccttcgtgactggcgtgcctcacttagcttaatccctggttggtacatgttaaaacctataaagacagcctctccagcacacatggggagcttgaaaatgaaagaaaggttgctctgacctctcagaactgcggacttcttaaaaaagaaagagtgaggtgggcggcctcccttgctgccggtgctagattccatgatatgaaacagcaagggtgcagctgggtgcggtggctcatgcctgtaatcccagcacttcggaggcgggggtgggcagatcacctgaggtcaggagttcgagaccagcctggccaacatggtgaaaccccgtctctactaaataatacaaaaattagccaggcatggtggtgagtgcctgtagccccagctactcaggaggctgaagcaggagaatcacttgaacccagaggtggaggttgcagtgagctgagatcacgccactgtactccagcctgggcaacagaacaagaagactctgtctcaaaaaaaaaaaaaaaaaaaaactgacttggatatgtgcttacataagaaagggagattcaccaagtgaaccatgcatagcatctcttaaatctgtatcatggaattcgtgattgggcctctctttcatatcaggcaacatacatgtgatgtacatacctgtagcttccgggaaagggaaggaagtagagatgacattgtctgttactcgtttgtatgtgtgtgtgcgtatttaagtaaatatgtgtgtgcatagggacatgtcacatgcatgtgtggcacatttataggatgaagaggtgtctaaaagacattgaggaaactcagtgaaggagttctgccggcgggcgtgaggaccacgctaaaagatgccggttgtgctttgtgtctaagctgaaagcatggatatcattttataaaagtaaaattatattggccaggcgtggtggctcatgcctgtagtcccagcacattgggaggccgaggtgggcggatcacctgaggtcgagagtgtgagaccagcctgaccaacatggagaaacccccatctctactaaaaatacaaaaaattagccaggcatggtggcacatgcctgtaatcccagctactcaggaggctgaagcaggagaatcacttgaacctgggaggcggaggttgcagtgagccaagatcatgccattgcactccagcctgggcaacaagagcaaaactccatctcagaaaaataaaaaaaaaaagtaaaattatattgttattgacggtctctttgttcgagtaagccgtctctggatatatcattgtatggtgtattcatgccaaggatttggtgtgagtcttgaagcattcacaccaaattgtggccaagcccagcactgagagcgcagtgggcgttcggaggacacgtttggattttgtgatcctctgcctggcaggagctgctcagcccctacagccccttccccgagaccaccaatgcgtttctcttcagttttgctattctcatacgctggtgatgggattttggagacaaacatggtctcttctgcttgcttgcttgcttatttatttatttttcctcccaggttcaagtgattctcctgcctcagcctcccaagtagctgggattacaggtgtgcgccaccatgcccagctaattttgtgtttttagtagagacgggtttcaccgtgttggccaggctggtcttgaactcctgacctcaggtgacctgcccaccttggcctcccaaagtgctgagattacagacatgagccaccgcgcctggccttctgccttttttggtgaactccctgtgggtgggagaactacccggtggagtcggtacctaaccagggcaggacacggaggtacacccctctcattttcggcagcagggtgagaggatttttattatcttacttagacacttgaatttatttttttattttgagacggaatttcggtcttgtcacccaggctggagtgcaatggtgtgatcgctggtccctgggttcaagtgattctccaacctcagcctcccaagtagctaggattacaggcgcccatcaccacacctggctaatttttgtatttttagtagagacggggtttcaccatgttggccatgctggttgacgcttgaatttatttatttatttcagataattttggactacagaaaggactctttgaaagggtattctaaaataatttcacccaattaggttttaaacatagtctgccatattgttgatttcacaggatttgcttttttaaaaaaatgtattttatttatttagaatttttctttaagagatggggtctcactctgttgcccaggctggagtacagtggtgcgatctcggctcactgcaacctccgcctcccgggttgaagcaattctcatgtctcagcctcccaagtagctgggactataggtgcgtgccaccatgcctggctaatttttgtatttttagtagaaacggggtttcaccatgtaggccaggctggtctcgaactcatgacctcaagtcatgcacctggcttggcctcccaaagtgctaggattataagcgtgagccactgtgcctggccttcagtagcttttaaaggttgtagctgaagattttgtacttgtcacatgggggaatatgataatgaaagcagaagatagactagtcactctacttttcccagcgtcctctctgactggactctttgaaggtactgcccagggtcatgaagagatggccctggctgcttccagaaggtatacattcccgtgtccactctgtgtcctggagagtgggggcggggggagggggttgtccgtctttgtatctctgtctctcagtacaaatttaatgaaggaatgaatcaatgaatgaatgaagcaagcattcccccagagaattcttaaatcatcttagccggtcatggaatttcccagcaagtcagcttttagaatcctgaaaatattttcagtattcatctctttaaggaatatatcaaaagcagtcagcaccaaccacggtttttcagctgattcccaaatgtgtgataagaaacacctaattccttgggggagaaaacttgttcaggttaaattcttgcggtaatccttacggccctgtggtgttcgctaagatgtagcaagaatgtaaatagctaggtactttgatctacctcaaatacttactagtttaaacattctgccattctgccgtcataccaaaaaaaaaaaaaaagcaccatcccagggttatgaatgacgttactgtctttggacatgctgtcttgtgtggctgagacgtagatcaagagaaatttgtaagaaagacaataaggtacaaaaatcgccgaagctaatgtcaagatggagataaatagatctatatttgccatatatggtagtaaaagaaaagtctgtgcaaatttgctcgacatttatggacttctatgattcatctaccagggccagcagctccagccaagagatatagaatgtcttcaactgtatttctttcctaaattgtttcattacaaagaagccatgttgtgtattcagaagaaaattccaggaccgcatgaaagtcactatttgggaacaggcctgagaaagcttgcttagaggaattccaaaagtattcaaaaggcagttattgaccaaacacataataattctctaagcatcaacaattttccatagatccaagctcacatatacagcgtattttctgtggctagtcactccagaaatagagggttctctgctttcttgactgattgactcatatgcaaacgcttctcatttcattttgttatttttttgagaaagggcttgttctgtctcccaggctggagtgcagtggcacagtcacggctcactgcaccctcgacctctctgggctaagccatccttccacctcagcctcccgagtagctgggaccataggcacacaccaccatgcctcgctaatttttgtattttttgtagagacagggtctcgccatgttgcccaagctggtctcgaactcctgggctcaagcaatcctcccacctcagcctcccaaagtgctgggattataggcatgcatcaacatgcccagcctgttttttgttttaatctgttattgagtaaggtgcaatttgtggctccatatacagggacaggttgcaaaacaggtactgagccgtgtgtatccttcaggtccaagcagcttctaaactgtgtctatctctgttcaggtccctggaactctcctgggcagcaagctcacaagagaccgacctctgtggccttcgaagcgggttgctgttagacacaccttttagaagctacattcatagtatctcaaaagacagacataaggggtactcggtatggccaccactcactcccacaacacagccaccatttcccacccagaatttcctgtgaaatgtgctcattttaaaacagcacacatcctgagaattgcaaagttgggcatagagatcaatacaaattagacttctttttagatacgctctacgctctgcagagccctctggggtctccaagggctgggacctgctggataaaactggatgaaactaagttgctgcttctttggtgcccttgaatggactttcttggctgcagtgacgttaggtccgcttcctagccgcgtgctgctctgccatcggggatgctaaagtcggggagggccaggaagcctttctttgcttggaagtttttgtttctccttcgcctgctaggttgggataatccgttgggaagtctctgagcgtctttaaacataaaatctagtttcaaaggtttaaattcccaagttgccccctaagttacatgttgcttaggcttggttgctatctgtatggtataaataattccatttagaaattaagaaattatgggctgcatttttgatgccagtggctctgtagtatcccccaaccaccaaaaaaaaaaaaaaaagaaaaaaagcatctaaaaattgtgaggttaccgcttagctctgtctttctggctgcacatgggttaccaggtgccttgccaagaccctgcctccgtgtccaccatgctttgtgtctgcaagtagatttacccatcgttcattattaattattcctctgagcagctctgtgaagctagtaaatattaataaacaatatgtgctgattatgaacctaagacaaaaggatgtctttttcaagctgcttaattttaggtaaactagttgcacacaagcgatgaataaacgtgaagtcaggcatccaggcggtgaaacaaaatcaaactggaactgcaaaaggagagtgcctgagatctgattttattttatttttgggatggagtctcactctgtcacccaggctggagtgcagtggcgtgatctcggctcactgcaacctccgcctcccaggttcacgcaattctcctgcctcagcctcccaagtagcttggactacaggcacacaccaccatgcccagctaatttttgtattttaagtagagacggggtttcactgtgttggccaggctggtctcgaactcctgacctcaggtgatctacccacttcagcctcccaaattgctggggttacaggtgtgagccaccgcatccagccgaaaggatacagtttatttaaagacaaaggaaaaagaaaaaccataattgtgttcacttagaaacatctcccatttcatactgatgtctttcctggtggtggtgtccaaatgcttatatgtgtgtgagattcattgttaccatgttgggatcagactgtaaacaagctttataaaagttcgtggctcctttcactcatccacccgctatgcatcgtccagatctgagttcacgtgctccttccccaaaggagccttctctcctgtctagggtcaggtctgcctctttttttctttttctttttttggaagcagggtctcaccctgtcaccaggctggagtgtggtggcgcgatcacgactcactgcagccatgacctcctaggctcaagcagtcctcccacctcactcccaagtagctgggattacaggcacatgccactacacgtggctactttttaaaatttttttgtagagatgggatcttgctctgttgcccggggtggtctcgacctcctaggctcaagcgatcctcccttagcctcccaagtagctgggacgacaggctcatgccaccacacccagctaatttttttgatttttagtagagatggggtctggttatgttgcccaggctggtgttgagctccagagctaaagcagtcctctcgccttaacctcccaaagtgctgggattacaggcacatgcccctgtgcccggccaggcttgcctcttaaactcccttcgctccacatgcccttctgcagcaccggccacagataagtgtcatccatgctggtggtgatttgactcatgtctcacctgccacacaacagaggcccaggaggcacagcagcctgtggtctctgctcatgattgaaggagcccctaaaacagggccggaaggcccaaaatagccactcaacaaacatctgtcgcataaatggaagtcacgtgcctcattccaagtctttgctgttcttcaaaaaataatggtactccaaaaaataatgatactccagattacactgagccatgaccacacccctgcactccagcctggacgacagagcgagacctcgttccttacaaagaattatactgagtacctaatatgcaattgcattgctttagtagaattctctcataagtactcccctggtgtcggaatccacattgttcccagttgttctctgttctaaactcatgctgaacattcttgtgcataaatctctgcctacatctctgattattcttacggatagactcctgaaagtactaagaggaaggattaatctgcgttctgattttaaacagcccatttgtctaaatattagcagggcctaagatctggaataaatgacacagtggcaaaagtcggagtcacacgtcctggttggtttcagagagtcctggggtgaaatggtgcctttggggtccatccctgtctagcacaggagtcccctttgcagcagtgtccataaaacgttagcttgggctgggtgtggtggctcatgcctgtaatcccatcactttgggaggccgaggtgggtagatcacctgaggtcaggagtttgagaccagcctggccaacacggtgaaaccttgtctctactaaaaatgcaaaaattagcctgacgtggtagtgggcgcctatactcccagctactcaggagaattgcttgaacctgggaggcggaggttgcagtgagccaagatcgcaccactgcactccggcctgggggacacagagagactccatctcaaaaaaaaaaaaaaaagtgagcttggtgatgagtctgggaagagcatctcttcattcattcagtccacaagtattcactgtgtctgccccgaacctagcaccatcctttggcccaggaatagaacggaggaatgtacatctcctcaaatgtctcctagaaattgagacctcaccattctcgctaagctccctgagggcagggactgtgactgtctcattcactgctcgtagttaatgctcaaatggtttttgaataaattaaaatacaatatgtgggccagtgcggtggctcacgcctgtaacccagcgcttcggtaggccgagatgggtggatcacctgaggtcaggagtttcagatcagcctggccaacatggagaaaccccatctctactaaaaaatacaaaaattagccaggtatggtgacacacacctgtaatcccagctactcaggtggctgaggcatgagaatcgcttgagcctgggaggcggaggttgcagtaagccaagatcacaccactgcactccagcctgggcaacagagcgagactctgtctcagaaaaacatgtggttcctctctttgacaagttccaaatctattgatgtaattgatgtatagatacatcagtaaatcacagatgtattttcaaagttctgaaatgtaactagagatttgtttatttttgagatgaagtcttgctctgtcacccaggctggagtgcagtggcatgattatagctcactgtagcctcaacctcctgggctcaagtgatcctcccacctcacccttccgagtagctcgcactataggcacttgccaccatgcctgggtaatttttttagaaactttttgtagagcaggagtgtccctatcttgcctagactggtcttgaactcctggcctcaagcaatcctcctgtctgggcctcccaacgtgcagggattacaggtgtgagccactgtgcccagtcagaggtttcgacatgagcagttattcagaaagggacctggaagaatattttgaaatcagacctagagtcaaatcagacttatttaagagaattaaccaatggagcctgaatttggcttctcccatttcctaccactgatcccctggccatgaggacagtcctgcaggaaattcctgtgccaggtgggctagcccaggacacatggctttggagactaggcagggaagatccagcccagggtactggagctggcgcttgcatgcccctctcactggggtgtctgatccccagatgccaacgaggctctggctgtcctgtctgagctgcccctgaggccacacacaggatctcagagtggacaaacagcctttcccttgacaatgagcagttctcagctctgagaccagaagaagccttagtgcaaccatttctcaaagtttcagtctcttaaaattgaggactccggagagcttgagtgcgtgcgtgcgtgcgtgcgctgtatctctcagtattgactgtgttagacatgaaagctgaggagtctgcaaagcacaggaacacacaaacacacgagccgctggtgtcagagtgaggctatcatcacacatcgcaggcatctggaaaactccactgtacacttgcgggagaaggcgaggaaaaggcaagtaacaagaatagttttgaccttgtggatccatgaaaggatctggggagccgggagtccccagaccctgctttgaggatcgttggcttagtggcattggcatccaggctccaccataatcctgagccgtggccacgtgctgccagatcacggcctctgtgcagttcgaatctgcccttcttcttagtcctttgcaccatcctcagcctttatcctcctcggtccacattcaggcattgccacttagataaccgcccccgcgcccccctcccaccccacttttcaacatcagacaagtctttttttgtttgtttgttttttgagacatagtctcattctgttgcccaggctggagtgcagtggcacaatctcggctcactgcagcctctgcctcccgggttcaagcaattctgcctcggcctttggagtagctgggattaaaggcacatgccaccacgcctggctaatttttctatttttagtagagttggggtttcaccatgttggcgaggctggtcttgaactcctgccctcatgtgatccacctgccttggcctcccaaagtgctgggattacaggtatgagccaccatgcccggtctcatcatcagacaagtcttgcagatcccctcttgatcaggaactcaggggtccccacctgcagcttcagggtacccctcgctgcttaccagcaggcaccctatgttgaaatcctgcaccctcatctcagttcccaatcccaccagtcccccaaagccagcccttcccgtggtggagttgtaccacgtaccacgcaaaagccacagcatcagcattggagactctgccaggacacggaacgtgttttaaatggcacaaagacatttaaatgggaagaaattatagcaggagtgagtttatccctttcaagataatcttatttaataaccaaaaaactcacaaagatgtgcattttatccgactacaaaagcagcgtggcgggttatatattgtggtaattacatgtttggggtttcattcctcctttaaaccagatttcttttatttcagaaaatcagccattgtagaaaaagactattcatttatttcattgctgggtggcctatacactgtaaaaataggtcaagaacagtaatctaaattgactgctgataaataattaaagctaatggaatttttctcaaacctgtgaactaaaatctttgagaaattgccaggacatacttactgtctgctgttgtatagaaagatattttttatttaatacttgagtttcaatgccatttaaaattacccttttctatcacaaggactggaaggaatatgtgttcatctataaaagtaaccaaaggaacgatgccgtgttgatggttatatggttcatcttcagatgagatgggaagtgacggtttcagtatcctggaacaaaagaaacatcatttttcactgaactggattttaagttgaggtctacagtccacatatcatataatatatattgtcttgtttttaaagactccatacctggtctgagctcttgtatacattgataagggaaacttaacagctatctaacgtgacatccaggaaaataaatactaagaacattttttctttcattagtaattactgttctctcattgctgctaccaggaccttataaaaagacattggggtcaggcgtggtggctcacgcctgtaatcccaacactttaggaggccaaggcaggtggatcccttgaggtcaggagttcaagaccagcctggccaacatggtgaaaccccgtctctactaaaaatacaaaaattagctgggcatggtggcgggcgcctgtaatcccagctacttgggaagctgaggcaggagaattgcttgaacccaggaggcagaggttgcagtgagctgagatcgcgccactgcactccagcctgggtgacaagagcaaaactcggtttggaaaaaaaaaaaaaaaagaaattacaaagtgagctaagaccagaggagaggggagaggcaagagcggagaattaccccagatgagggagatctggaacagaaggtgacaacaggccaagccacagggccaggtccctaagggtccccacctctagcaccattggcaacaaccttgtgagagtcagaatcaagtctttcagaagtgacccagttcagcccctcactacccccaccctgccctagtgctcttggaaagactacattgtctccgaaggagaaagggtcccacccctgaactgtcactgtacaggatggggtaccaccaagagatgttgtacctcttaaatgcagtcagggttatttcccagaaaagtatccaagttactgtaggatgaaaaagacatccagaaaaacctggattatcagatttttttttcccccatttggagacagggtcttgctctgtcacccaggctggattacagtggcacagtcatagctcactgccatcccaaactcctaggctcaagccatcctccacctcagcctccaaaatagataggactacaagcctgcaccaccatactcactaatttttgtatttttttctagagacgggatttcaccacgttgcccaagctggtcccgaatgcctgggctcaagcaatcctcctgccttggcctcccaaagtgctgggattacagttgtgagctaccagatacttttttttctcttttttttttttttttttttttggatggagtttcctgggttgaagcgattctcctgcctcagccttctgagtagctgggattataggcatgcaccaccatgcccacctaatttcgtattttttgttagtagagatggggtttctccatgttggtcagactggtctccaactcctgacctcaggtgatctgcccgcttcagcctctcgaagtgctgggaatacaggtgtgagccaccacacccggcccagatattttaaaaacagaaatgacttgatgactttggagatgtgtttgtaattcacagcctccttctatgtgtgcattgtgtttgtgctgattccagtgagcctctcgctcctgcagacagaggtgaacctccatgcagcagctcagcgtgtcaccagctctgggtccctggcacgcgactctgggatatggggagtggaagagagctcatgggaattgggagcacgaggccctaagatggagcagagccttccagagagggctcgggagtgtgtgtgttacgactcccgctcgtacgttacaggtgcaattgaacactgcatgacgattttgtctctattttgcttttacatcagaatggtttcctccagcaattggcattacctagaaaattccttaatagcattttgctgttcagttctctgacctaaaaactgagttgtgaatcagcagtttcgagaataatggaaatacggccagacacagtagcacacgcctgtaatcccagcactctgggaggctgatgtgggtggatcacttgagcctaggagtttgaaatcagcctgggcaacatggcgaaaccccgtctctacaaaaaatgcaaaaatttgccggacatggtggcgcatgcctctagttccagctgctcggggtgctgagatgggaggattgctcgtgcccgggaggtcacgactgcagtgagctatgattgagccactgcactccagcctggaagagcgagacactgtctcaaaaaaaaaaaaaaagaaaagaaaaagaaaagaatggaaatccttccacatagaaacctctctgtgtaaacatcatttatttgctgtgtactcaaaggagaggaggttgacatgagctattttggcttttgccaaaaggcatatgattggaattatctcaagaacatcactttctgtgcattaagatgtttgttgctttttgcccaatagatgggatgggatggaaacaaggtgaaaacatcactgacaaacctgaattaagtatataactgaattaagtgtgtaacgtgtaacttgaagtaattaagttttaaaacatggccgggtgcagtggctcaagcctgtaatcccagcactttgggaggccgaggtgggcagattacttgaggtcaggagttcgagaccagcctggccaacatggtgaaaacttgtctctactaaaagtacaaaaattagcagggcggggtggctcgcacctatagtctcagctacttgggaggctgaagcaggagaatcgcttgaacctggggggtggaggttgcagtgagccgaggtcacgtcactgcactccagcctgggtgacagagcgagactccatccccctccccgcaaaaaagtttttaaacgtgttcactgcctccttatcatttgttccactgtggttttggccagcctgaaccccactttttccagtttatgaccacaaagaaggattgtgcgggtgtgcatgaggaccagtaagtggcagagtctgcattttctggtgctgtccagacagcaaagagtgctgtgttctagaaagacagtaaatcgtatcatgtccttgctaaccgacgatggagaattctgtgggtcagaattgagcatcttttttgagacagagtctctctctgttacccaggctggagtgtaatggcatgatcttggctcacttgcagcctcaaccacccgggttgaggtggggagcctcccaatgtgctgggactataggcgtgagccgccgtgcctggccagaattgaacatctttgtatctttcttcttagtttagtacaaaactgaataatatttgcaggcagcagaattggatcgggaatttctcaaactgccaaagatgaaattagaatgagtgatttttggctggcagcttgaagtacatatatatcagtttgtgtatgatacgtgtgagtatgtagtggtttttccctcttcaactgtctttaaatatgtgtgcgtgcgtgagtgtgtgtacaaacacacgtagctttaatatcaaaaaggttatttttgtaggtctgttaggagacatgaatatgctcaaaagggaaaaaaatacatggatagggtgagaggagtttgctttatttaaggacatgataaaaggcatagcccttctgcctttctggaatgctgtaacagaatatagaaataattgtatcatctcctgtacttctcagagctggtgtttgcgtgaggctggccctgtgccaggttggcagggttgggggtaacccaggagcatgcctgctaaggcacactgccattcagggcctggccttgcccctgcgccccagccccctgctctcctccatccagctctgccctcttccatttctctgctacagtctgaaatctctcagccacaccagctttctcattccatgacctcatctgacttgtctccttcccctctgaatctgagcccttgttaagcctttttttgttttttctttgagacagagtctcactctgtcacccaggctagagggcattggtgcagtctcagctcactgcagcctctgcctccgcggtttaagcgatcctcccacctcagcctcctgagtaacctggactacaggcatgcaccaccacgcccagcttatttttatattttgagtagagatggggtttcgtcatgctggccaggctggtctcaaactcctgacctcaggtgatccacttgcctcagcctcccaaagtgctgggattacaggtgtgagccagcgtgcccagccatagctattcttccattcattccctcatgcaccctttccatgtcttttgagtccccactgtgtgccaggccccatggtcgttttccctggaccctgctgggatcatagtaatcttcccccatcattctttacgccttccacactcttttcccttgttaccctttgtgttatatgttgtcctctacctttctgaaaagcacagtgggtgaaatgcggtgatgtgttagcttcctgttgctgctgtcgcaacctgccatgcgccgagtggcttaaaacaacagaaatttatcatgtgacagtgctcgagttcaggagtccaaagtgggatggattccccaggctggaatcaaggtgtcagccagagttgtgttcctattagaagctctgggggagaatcagtttcctggcagtttccagcctctcgcgctgccggcattcctatagcattccgacctctgcgtcggtcctcagatctcctctgactctgagcctcctgcctgtctcttactaggagcactgggattacactgggcccacctggataatccagggtcatctcctgactcatgatccctgacataatcccatctgcaaaagccccttttaccattgcaatctaacacattcacaggcgccagctatgaggacgtggttatctctggcggactattattggtgctgaccacagatagccttatttatataaaaagagattggtggccaggcatggtggctcacgcctgtaatccacagcacttcaggagaccaaggcaggcatatcgcttgaacctgggagttcaagaccagcctgggcaacatagtgaaatcctgtctctacgaaaaatacaaaaactagccgggtgtggtggcgcatgcctgtggtcccagctacatgggaagttgaggtgagaggatcccttgaacccgggaggtggaggttacagtgagccgagatcatgccactgtactccagcctgggtgacagagccagaccccgtcttaggtgggaaaaaaaaaagattggtaaagaatctgattattttttgtcctggagcctggtgtaaaaaaatagaaaatcatctagttgaggaagtaacaggattgacttctccaaggaaataatggtatcacgtttagaaatgcatcctttggaacagtatatagttaaaagggaaattataatgcttcttgaccaaatgtttctacaggatcacaatacaaaataacgtgggctgtgatgatatttgtcaaaaaacttgtggtacagtggccaggtgcagtggttcacacctgtaatcctagcactgtgggagatcaagacaggcagatcgcttgagtccaggaattcaagaccagcctgggcaacatagcaagacccttatctctacaaaaaaataagaaaattagcaaggcatgatggtgtgcgcctgtagtcccagctacttgggaggctgaggtgggaggatcgcttgaacccaggaagttgaggctgcagtgagctatgatcacaccactacactctaacctggatgacagagcaagaccctgtctcaaaaaaacaaaagcttgctgtacaggcctgtcctgtaggtccctctgcaatgatggaaaaattctgtgtctgcattgttggaagcagtagccaccagcaacgggtggctaccgaatccttgaactgtggctagggtaactaagaaactgaattttccaaatttatttaactttaagttatatttaaatataaataagcacatatggctgtatgtgttgaataagaagactttttcatctgggatcttgataggtcttacttaggaagcctctgataaaataatttgcagagttttatttctaatggcaaggtcagtagctttcctcagattctcagaaggcttcatcaactaaaatgtaggcctagcccggtggctcatgcctgtaatcccagcactttgggaggctgaggtgggcggatcacctacggtcaggagtttgagaacagcctagccaacatggtgaaaccccgtctctactaaaaatacaaaaattagccaggcatggtggtgggcacctgtagtcccagctactcaggaggttgaggcaggagaatcacttgaacctgggaggtgtaggttgcagtaagccgagatctcgccactgcactccagcctaggcaacagtgagactccgtctttaaaaaaaaaaaaaaaaaaaaaaaaaacatagtttcaatgcctaaactttcagtaaataagatattatcttagtcgagtcttttcaaagtttttgaagcactttctcagttacttcattttaaataaaatgctctgaacaagatcataagcatgcacctatgggatgtcctggtgtttcgaaatgggcactggtggcatgggataaaatttattgtgactctgtcagatgtggattcaaaacaggctgtatctccgacttaacagtgcattaaaatggcagctagggccggccatggtggctcatgcctgtaatcccagcactttgggagatgaaggtgggcggatcacctgagattaggagttccagaccaccttggccaacatggcaaaaacccatctctactacaaatacaaacattagccgggcgcctgtagtcccacttactcgggaggctgaggtgagagaatcactcaaacccagaaggcagaggttgcagtgagctgagatcttgccactgcactccagattaggcgacagagcgagactccatctcaaaaaaaaagaagaggcagctaaaatacagtgcagtggcccaggtccatttcagatagaaacagccaggcaaaccccccattctagtctattttattctaagcagattatctcacttagactgacatcagcaaaagctttagtctgtagcacattcaaaatgaggtatatgtgaccaggagttagtagaaataaaacatcgttgtaggccaggtgcggtggctcacacctgtaatcccagcactttgggatgctagggtgggcacatctcttaagcccaggagtttgaccctcgcctggacgacatgatgaaaccctgtctctacaaaaaaatacaaaaattaaccaggcatggtggcgtacgcctgtagtctcagctacttggtaggctgaggtgggaggatgactctagcccaggaggcagaggttgcagtgagccagggttgtgccactgtgctccagcctggtcaacagaatgagactctgtcttcaacaacaagaacaacaaagaaccacctcgttgtattcttaaataagtttaaatcctgaagcgccagttggcgttattgatgttttaggagtgcaggaatgggtgaggtcccaggcttgctttagatagtgataattagcactgactgccacgctgtttttaggaggccttaaccaatgtttcccttctttctccttctcaaatggctgcttcctgacctccgcctcctgctccaggatttgcgcaagcaggtagcgccgctgctgaagagtttccaaggagaggtaagcttttctattcattttctatcctgagccacccttcgtggctaattggtctttttattcacattaaagaaatgctccgggcaaaaggtgctgcccagatggtgccttcccggctgctccgacccagcgtcatgcagattttgcgctctgtgatgtaattttccattgggtccttggtgaaagccctcctggaaaaggaagctatgctcagaatacacagagctgtggtggattgccagcagaagtgccccgtgtgtggttgcaacaggcaggttgttggcgctacggccttcaggagcccatgcatcccctctaggaagtcgccttgtccccctgagctggtctggggctgccactgccatgagtgtgtgccataagtgtggtgctttgctgagaggctggcgggggcacagggaggccacttgatcacaggcttgaaacacagagcatctagcagaagccacgaggagcaagcctaggctcagtagaaggaagtggtttctaacggatccttccagagaaggacggagccatctggcagacggcacgtgggtggcaagtcacctgggacatccgccctggctacctgttagcgggaacagcagccatagaggggactgggctccacgtgagtgacactctttgccagccctttgtgtgaagattcagtgatgtttagaaaaccagaaattatattattcttgcggatttattgaatctcacctctttagcttctcccgacggaaaaacagaaagtggaatcatagcaggctgataaggaaaggaaacgagacatttccaaagcccctgaaagagcccatattggtacagtcttagggatttttttttttttttttttttggcgacagagtcttgccctgtcactcaggctacagtccagtggtgcaatctagtctcactgcaacctccgtctcccaggttcaagtgattctcctgtctcagcctccccagcaaatgagattgcaggtgtgcaccaccacacccagctaatttctctatttttagtagagatgcagtttcaccatgttggccaggctggtctcgatctcctgacctcaggtgatccacctgctttgacctcccaaagtgctgggattacagatgtgagccactgtgcctggcagggattttattttcttgcaactgctaagtcacagggaacacatgggggaagggacaggagagatatggccgtgagatacaggagagatatggccgtgagatacagtaggttcctcttgggacacaggtgatgtgggccttatatatggaaggctgggttcctggtcccagagctctagagcaagttgtcgggcttccatttgggaaattcatcaactgggagcgagagcagggagtgagtgaatgaaggaggccagggcgattgtagccaaagacagagaggcgatttcaggacatcaaaagggaccagcgtagaaagaagacacagcagttggtgatggctggaaattttcgagggcagaacagtacccctctcttcttatgatcttcttcctgcctcattcagcccccatgcacgtagcttggtccggccagcaggacacctgcatcccagggcttggatggacttgaacagtctttttctcagaacttcatctccaagcccgtagttgatgagtgaggctgttacctgacacctacccacatttgatcttacctgttctgttacctgtccagcggcttttgggagacccactggcttcctagttctctcgctcaaagagttcagtgtgctttctaggtgtttgcttgtttttctttcttattgaaaaatttcaaagctgtgtaaaaatggaaagattagtacagtgaatacctgtatgcttttttttttttttgagacagattttcactcttgttgcccaggctggagtgcaatggcacaatctcagctcgctgcaacctccgcctcctggatttaagcaattctcctgcctcagcctcccaagtagctgggattacaggcatgtgccaccacgctcagctgagttttgtatttttagtagagacggggtttcatcatactggtcaggctggtctctcattcctgacctcaggtgatccgcccgcttcgacctcccaaagtgctgggattacaggcgtgagccactgcgcccggcccacctatatgctctttacccagatccacagttgctaacatttcaccccatgtacctcccccctcccctccccgcccaccacttttgctgaacattcagaagtaagttgcagaagcaggcactgtgtccctcaaacacacgtggaaggctcccgaagttaaggaattattagcattctcctacattaccacaataaccacaaatatcacacctgggaaaattcacagtaattccaggtcatctcatatttgatccaaaatcaaatttttccaattatccccaagatgtcttttataacggccctcctcgcaactgaggtccagtcaggttcacacattacatttggaaatctgtctatctaattttctattttaaaaagtgttttttttttttgagacagggtctcgctcggtaacccaggctgcagtgcagtggtgccatcatggttcactgcagcctccacctcctgggctcagcaatcttcttgccttagcactcccctgcccccaccgccagatagctgggactatacatgtgcaccaccacatccggctaatttatttttatttttagtagagacgaggtttcaatacattgcccaggcttgtatcgacatcccgggctcaagccatcctcccaccttggcttcccagagtgccttgattacagacatgagccactgtacccggcccctgcattatctcttttaatgtaggacatcctctccatctccatcaccttcatttctttttatttttattttttctagacagggtcttgctctgtcccccaggctgggatgaagtggcacaatctcagctcaccacaacctccacctcccaggttcaagcaattcttctgcctcagcctcccaagtagctgggattacaggcatgcaccacctcgcccagctaatttttgtatttttagtagagatgggatttcaccatgttgatcaggctggtctcaaactcctgacctcaagtgatctgcctgcctcagcctcccagagtgagtgctgggattacaggcatgagccaccgcgcctggcctgatttttttgtttgtttgtttgtttgcttttttgaagagtcttagcaaattatcttgtagattagcccacattctcagtaggataatgggtttgattcctgataccttaaatttgaaatacccaagaaacatctaggctaagcttccatttgcctatttttttttaaaggccatatgaaagctaatcataaataaatacataaaattatcatagattttgaacccacaaaagaaaggtaattttttggcaccattaattaatatttatcaagcctccgctaatttataaataaattttattatgtatacttaaggtatacaacatgatgctatgggatacatacagacagtaaaatggttatacggggaagcaaattaacatatgcatcgtctcccttagttactctttttcatgtgtgtggcaggagcagctaagatctcatttagcagaaatccctcatattgcaattatatttactatagtccttgtttgcacattaaatctctagacactcccagcatcatccctcccaaaatgtgacatttatattaaataatttgtacttttttttttttttgagatggggtctggctctatcacccagggtggagagcagggtggcatgatctcggctcactgcaacctctgcctccctggctcaagcgatttgcccacctcagcctcccaagtagctaggaccacaggctcttgccaccatgcctgcctaaatttttgtattttttggtagaggtgggagtttcaccatgttggccaggctggtcttgaactcctgagctccagtgatccgcccgcctcagcctcccagagggctgggattacaggcatgggccaccacgcctggcctggaagtggtttttaaaatattttacttccatcctttcattatgatgtgttcctattaaaaaggtgatcatgtgtggaatcccagcagtttgggaggacaaggcaggaggatcgcttgagcccaggagatcgagaccagcctggtcaatatagtgagaccccgtctcagtctcatgcctataatcccagcactttgggaggctgaggcgggtggatcacctgaggtcaagagttcgagaccagcctggccaacatgatgaaaccccgtctaatagactaaacatacaaaaattaggcgggcatgatggcatgtgcctgtaatcacagctacctgggaggctgaggcatgagaatcagttgaactcgggaggcagaggttgcagtgagccaagcactctagagccactgtactctagcctgggtgacagagtgagactccgtctaaataaataaataaataaataaataaaagtttcagataatgaaatgattacttataattattataacaaaatcataaaatgtaactcacactgaaattagatatcgattgattgattatgatacctaattttgggtgtttcacaagcccagcaaattgatgggtggtgtgggggaggtgtacccttaatatgaagtccaatttaaagcttattctagcccaacaatttagacaatccctttagtaaagtaatgcacataccctctaggaaaatgctgtctttccactagtctggccaatccttgcttctctccctgagaaggggcgtgttatggaaggttgaggggatgaggggctggctcagagaacctcttggtagtgggggacaagtgtcctcagggaggaaaatcctcttaagaaataacttgagtgctcgtattagagaataaatgaaaaacaatctatgaactaagcatcggctttataaaattacagtaggctggtatgatggctcacgcctgtagtcccagcactttgggaggccaagccaggaggatcatctgaggccaggagtttgagaccagcctggcctaacctagcaagactccatctcaattaaataaataaacaaacaaataaatgtacaacagaataagttcaaatagaatgaaagaaatgacaaatataataataaacataagaatagaaatgaatgaaaaaaacaaagagccaggagagaaacattgcaaaagtcatttatttgaaaataccactgcaactgacaaaccactgtactcatcaagacaaaaaatgttaggaataaaattggggatgacattgcagctgctgcagagattaaaaagataaagggaatgttataagcaactttctgccaataaatactgaagtcgaaaaagttccaaaattctgtaactaccaaaattgattaaagaagaaacagacaacttgaatagctttgtaactattactgaaatatttccataaggtctagacagtttccaagagagttttatcaatcattcatgaaatagagagttctcatacttagcagactccttcagaaaatagaaagagcgagcacttcttaactccttttatgaggctaatataaccttgataccaaaacaagacaagaacagtacaagaaaggaaaattaaaagtcagtcttattggccacgcatggtggcttacgtctctaatctcagcactttgggaggctgaggcaggcagatcactcgaggttgggagatcgagaccagcctggccaacatggtgcaaccccatctctactaaaaatataaaaattagccgggagtggtggcaggcacctgtaatcccggctacttgggaggctgaggcaggagaatcgcttaaacccagcaggcggaggttgcggtgagctgagatcatgccactggactccagcccaggtgacagagcgagactccatctcaaaaaaaaaaaaaaaaaaaaaagtcagtcttattattgaataaatacacagaagtcttttcaaaggtattagtaaattaagtccatcaagcttggtatatcccaagaaggctgttttgtttaaaatgttcaaaacttattaacataaatccatgtcattagcagattaaaggaggaaacaatttcagtagttatatgaaaagattttgataaaatttaaatccattcatgattaaaaactaccaacaggctaggcatggtggtcaggagtttgagaccagcctggacaatgtggtggaaccctgtctctactaaaaatacaaaaacaggccgggcactgtggctcacacctgtaatcccagcactttgggaggccgaggtgggcggatcacaagttcaggagatcgagaccatcctggccaacatggtgaaaccccagctctactaaaaatacaaaaattagctggacgtggtggcatatgcccgtaatcctagctactcagaaggctgaggcaggagaatcacttgaaccagtgagtcagaggttgcagtgagccgggatcgtgccactgcactccagcctggtgacagagagagactccgtctcaaaaaaaaaaaaaaaaatacaaaaacaaaaaattagctgggtgtggtgggtgcaggcctgtacacctagctatgcaggaggctgaagcaggagaatcacttgaacccaggaggcagaggttacagtgagccgagatcgcgccaccgcactctagcctgggcaacagatcaagattccatctcaaaaacaaacaaacaaacaaaaaaccctactaacaaactaggaatagagggaaacatcttaggaatagagggaaacttctttaatgtggtaaaaggtatttatcagaaacatacattaatcatcagacccagtggtggtaaaaaaaaaaaaaaaaaaaattcccagaaaaccaggaacaagacaagaatacctactattgctactttaattaacactgtactgcaaatcttagctagcagagaagacaaaaagaaataaagtacagatagctcttgacttacgatggtgcaactttaggatgatgcaaagaaactgtactttgagtacccatacaaccatgccgtttgtcagtttcagtacagtattcaataaattacatgagctggtgaatacctgatgataaaataggctttgtcttggataattttccccaactataagctaatgtaagtcttctgaatatatttaaagtaggctaagctaagctatgatgtttgccaggttagtttattaaatacatttttgactataatattttcagcctacagtataagtattgcaacagaagaaatcaaactgtcatttttcaagtgagcctcaattatttaaccaggttactagatacaaaatcaatatacaaaagtaattatatacccctgtatcagcagcaaacttaaaaagtcatttttaaaaaggatactactggagatagccagccaaaaaaaaaaaaaaaaaactatagctagaaatgaatgtaacaatacaagggaaatctttctagagaaagatgtaacatttatattgaaggatattaaaggagagttaaatggagagagagaaagtatacaaggagagaaatttccactactattgaagcgatcacttttctccagattgatcacagaatcagtcattgtagttccagtaaaaatcccaacaaaattttttttgttttgagacagagtctcgctctgtcacccaggctggaatacagtggcaccatttcagctcactgcaacctccacctcccggattcaaggttatctcctatttgatctaaaatcaaatttttctggttatccctaagatttcttttgtaacggccctccctgcagctgaggtccaatcaggttcacatattacatttgtgtaatcccaagtagctgggattacaggcgcctgccaccacacccagctaatttttgtgtttttagtaaagacggtttcgccaggctggtctcaaactcctgacctcaggcgatcagactgcctctgcctcccaaagtgctgggattacagtcatgagccaccgagcccggccccagcaagaatcttaatgaaacttttgaaaagctgattccagaatttttatacatatgcaagaacaaatggtaaataatagtgaagataatactgaaccactccaagttagaggaattgccctaccagattattaaagctgcagtagttggcagagaatgagataaataaaccaaaggaacacaataaagaaatcagaatctggccgagcgcgttggctcttacccgtaatcccagcactttgggaggccaaggcaggaggatcacttgaggtcaggagttccatacaccagcctgaccaatatggtgaaacttcgtctctactaaaaatacaaaaatcagcctggtgtggtcacgtgctcctgtagtcccagctacttgaaaggctgaggcaggagaattgcttgaacccgggaagcagaggtagcagtgagccgagattgtgccactgcagtccagcctggcccacagagtgagactccatctcaaaaaaacaagcaaacaaacaaaaaaaaaaaaaaacaccggaatctggcctatgcatatatatagaagctgaataaattgcaaagatggtatggatcagtgaggaaaggggggacttttcatggtcctctgacgattggcaaatccttatagattaaacgaagttgagaccgagtgcactggctgctatctgtaatcccagcactttgggaggctgaagcaagcagttcccttgagccctcgtgttagagactaacctgggcaacatggtgaaaccctgtctgtacaaaaacttacaaaaattagctgggtgtgatggcacacgcctgtagtcccagccacttggaaggctgaggtgggatgattgcttgagcccacaagttggagacttcagtgagctgttgatcgcgtgccactgcactacagcctggctgacagagcaagatcctgtctcaaacagacaggcaaacaattaactagagttggagccctaccttacaccgtgtggaaacacaaattacaaggagagtcttagatcaaagctttaaactttatagaataaaatataaaagatgatgactttgggctgggtagaatttctttcttttcttttctttttttttttttttgagacggagttttgttcttgttgcccaggctggaatgcaatggcacgatcttggctcaccacaacctctgcctcccgggttcaagtgattctcctgcctcagcctccagagtagctgggattacaagcatgcgccaccacgcccagctaattttgtatttttagtagagacagggtttctctgtgttggtcaggctggtctcgaactcccaacctcatgtgatccacccacctcggcttcccaaaatgctgggattacaggtgtgagccaccacgcccggccctgggctgggtagaatttcttaaacagaaaaccataaaagagattgttgcagtaaactaccttaaaatttttaaataggagcttttttcatggaaagataccctaaagaaagtggaaacatggccgggtgtggtggctcatgcctgtaatctcagcactttgggaggctgaggcaggcggatcacttgatgtcaggagtttgagaccagtctgggcaacatggtgaaaccctatctctgctgaaaatacaaaacttagctgggcatggtggcacatgcctgtagtctcagctactcgggagactgaggcacgagagttgcttgaacctgggaggtggaggctgcagtgagctgaaagcattgcagtccagcctgggcgacagagtgagactctgtctcaaaaaaaaaaaaagcagaaagataaggccagtacactgctagctccatggtatgttcatgtgaactagaaaaaaggtttgccgttctcaatacttttcacatcacctgttggaaacttgccataataaagattcatacttacctcagtgtttaccgtgatagattcagacatccagaatgtgaagcatactgtctagggctgtgcatcccaccgttgtatgtggggtaaccttggccatgatttacaaatctggaagaggtagttgtcacacctgtaattaacaatgttcacaagatattcaaaatgctcgcatgtcaatggggggagaaacccagtaaggaaatgagtacaagtcatgagcataattgtcagaacattggaatggtcagtagctatatgaaaagatgtctaggttgcataataaccagggatatgcagattaaaataactcatctgcaagttattcctcctgaccaagttggctaaaattaaaaagtcaagttaggagcataagttgatttaaactttttgaaagccaatttggcatctggtgataaagactcacctgtaccttgacgcggcagtttcactcctaaatatatacgctaaagaaacaagcatggcgggtgcggtggctcatgcctgtcatcctagtactttggcaggcagaggtgggagtggcgcttgagcccagaagtttgagaccagctgagcaacatagtgagacctccatcttgacaaaaaaatttaaaaagttacccaagcatggtggcacatgcctgtagtcccagctactcaggaggctgaggcaggaggatcacttgagcctgggagttggaggctttgatagcaacactgcaccccagcctaggagacagagccagaccctattttaaaagaaaattaaatagataaataaacttatttgccctggaaaaccagttcagaaattttgaaaatagttaacatatgaaaacaacccagccggccatcaacaggaaaaagaatatgataaaactttgttgtaacaaaagattaataaagaaaagcatatggatttatttgctgaaagttacgagctctgtatacccagggcctctccttcacgagcactaaataagtgtttattggatgggtggatggaagcatcgtcctcatcttacagataaaaggactaaacccgagagaggattccaagtcacacaggtcataatggcaggactggcctcgatcctggggccgtctggcatcccagaagtgctaaggttggtgtgctctgatactgcttgagcggggaggaagcagtgccttcagcccctccctgatctcagccaacctttccagtctttgactgacactttgagaggccgagacaggcggctcacttgagcctgggagctccagaccagccttggcaacgtagtgaaactccatctctacaaaaaaatgcaaacgttagccaagtgcggtatcatacacctgtagtcccagctacttgggaggctgatttgggaggatcatttgagcccaggaggttgaggctgcagtaacctatgatcacactgttgcactccagtctgggcaacagagcgagaccctgtctctatttcaaaaaaaaaaaaaaaaaaagattgatgttcatcttgcatacagtgctctgcaaaccctgcctgaagcccccttcccttctaaccagcccctcctagacaaattctggagcttggtgcattgtctcgtgtacatccataactgtgtccatgcgctttgctacaaccacgatctgcatcgttggaaggagtggagcccaggttaactgtgaatttcatcacagtatcacctgctgacatggcctgagggagggaccaaggaatgatctgaaacttccctttgtgctgaatgtctcccttacatgcagcgcgctggccacgttcagagctgcatgcaggacgtgctctcggaggctgggttttactctctggtcttcattcaacgcaaccttttcgggagcctcctgcttccagctatgggccaaacagttgctaaagatgtctcattgaatacagtcaactaggatcctgctattctaatgaagggaaactgatgataaacacaaaaggcaatgttagatggcgccaggcactgcgagggagacacactgggtcttggggtagagcgggaagaggtggtagtgacttcttcagtcatccagggaggcctctccagggaggatgacggaacatcagaggaaagaagcaaggagaaccagccacactcagagctgggaaagagcagcaggaagatgggggcagtgagtgccagggctctgcagggatgggcttgcctggcagggagcaataccaaggaagttagtagggcccgggtcatgccagggccttgtaggcagaacccttaagtctctttgtagggaccctttggtctcccctttgaactaggccctttcaaagacgtacagtagaaagcaaattccccatgggcaccggcaggatgatttgacagattctaatcaaataattggggaaataaagttgggtgaactacagcagtctatgaatgagttaaaagtgactacgagtctgctgcccatcttgcagcccatatctgttgagctgtaacatatttaagcattcagatctaaaggccattgctaaataaagccagggcgtccatgtggttcgctccaaagagcatttcacagggagccagtccaggcgctgccgcccaccacctctgtgaccttgggtgagtctcggggcctctttctgcccgactttgctcatctgtaaaacgagtgggttacccagatcctcccccaaggagctccgtagctctgaaacctcatgagactcactggagcagtactttggttgactatcgctagcagaaccgaaaaggacattctccagcaatgtaaatctgttcaaaaatgggatgagctggctgggcacagtggctcatgcctgtaataccagcactttgggaggctgaggcgggtggatcacaaggtcaggagttcaagaccagcctggccaacatagtgaaaccctgtctctactaaaaatacaaaaaaaaaacaaaaataaaaaaattagccaggcatggtggtggcaccagctacttgggaggttgaaacaggagaattgcttggacgaccacctgccagggagattgtcacctcttatccattctttttttttttttttttttttttttttgaaatagagtctctctgtgtcacccaggctggagtgcagtggctcaccataatctctgcttcctgggttcaagcgattctcctgccttagcctcctgagtagctgggatttcaggtgtgcgccaccatgtccggctaattttgtattattagaagagatggggttttaccatgttgttcaggctggtcttgaactcctggcctcaagtgatcaacccgccttggcctcccgaaatgctgagattacaagcatgagccaccatgcccttgccttatccatccttctaaatgccagatcctccaagtcttcccaaaatacccagccagaaacagattcttcctcttctcatctctaatagggcttcatttatatctcccttttgattttttttttttttttttttgagatggagtcttgttctgtcacccaggctggagtgcagtggatgatctcggctcactgcaacctccacctcccgggttcaagcgattctcctgcctcagcctcccaagtagctgggactacaggtgcacaccactatgcctggctaattttttgtatttttagtagagacgggattttgccatgttggccaggctggtgtcaaactcctagctcaggtgatccgcctagtggttaggatttggcgctatctctcccttttggttttgagcctaaagacattctgcccttatagtttgcttaccaaggccttatgcttctaaaatgtagaagggaggatgtgtgtgtgagtgtgagtgagtgtgtgagtgtgtgtgtgtgtgtatgtgtctttgtacctgtttctgtccccatcttaccagtacttgcctaaatactgcattaagcatcatgggtgaaataggattagagaaggttggaccagatcagtggctcccaaagctgctgctgggttggaccagtgctgcactggccctatgagaattgctcacatgtttccagaaatacagctccccaggctcctaccctgacattccggtgtagaaggcctggggtggaaccttagaatctgtcatttttcaaagcccacctctgatgctcatgcactgctagttgtaggaaccactgggctcggttccctgaaagagctctttctcctggtaacaagttctgtgactctctctgcccactcagtcttcttagattggcatgttagaagctccatgacttgcctttgaaatatttttccagcttcaaagtcctggacttctactctggccgaactggcctgtgtattatgagtcacctgaacatactttttgatttcctgaaggctctgttattgttaagacccttttgctgttccctacctataaaactcatttccatcctttagggctgaaccgaaaagtctatctcctttgatcattttcctgaccatctcaacctatttctaactttttccctctttttttatcctcagctctattaaagtatcattaacaaagaaaagttgtatatatttatagtgtataatgtgatggtttggggtttttattttttgagacaggatctccctctgtcacccaggctggagtgcagtggcataatcagggctcactgcagccttgacctcccgggctcaagcaatcttcctgcttcagcctcccaagcagttaggactataggctcctggccaggctaattttatattttttcgattttagtaaagccgaagtctggctgcgttgcccaggctggtcttgaactccagcagcacagtctcagctcactgcaacctccacctcctgggttcaagcctcagcctcctgattagcagggactgtggacgtgtgccaccacgcctggctaatttttttattttttgtagagacgaggttttgccacgttggctaggctggtcttgaactcctgacctcaagcgatcctcccacctcattctcccaaagtggtgggattacaggcgtgatccaccacacccagcccaatgtgatgttttgatacatgcatacattacgaagtgatttccacaatctgacaacatacccattagctcactgtgtgtgtgtgtgtgtgtgtgtgtgtgtgtgtgtgtgtgtgtgtgttgagaacacttgagatctactgccttagcaaatgtcatatatatgattacaagattattaactatagtcaccatgctgtaccttggaaaagaaaacctacttttcttgcttaagtaaaacttttacccttttcaaggactgggggaccttgagtatgtgcagattttggtacacgcagggggtcctagcaccaatctcctgcgtgtaccaagggatgaccgtgtgtatagaaaatcacatgtttattacccatgtatttgttgttggatgcttagtctgtttccatatctttctattgtaaatagtgccgcagtatacatgagtgtgcagataactcttaacaatactgatttcaatccctttgtggtgttgctggatcgtattaattttggggggaacctccgtactgtttcccataatggctgtaccaatttacattcccaccaacagtgtacaaagatgcccatttctccatgtctcactagcactcgtgtgtctttttggtaatagcccttctaacaggtatcaggtgatacctcatcgtggttttgagtcaaattttccagatgattaaagatgttgagcagcttttcatatacctgtcagccgtttgcatgtctttttttagagagagacagggtctcactctgttgtgcagactggcgtgcggtggtgcgatcatggctcactgtagccttgaactcctggcctcaggtgatcctcctgtcttggcctcccaaagtttttgggattacgtgagccactgcgccaggccttatgtgttttcttttgagatccttagcccattttccgtttttttgttttttttggaaagagtcttgctctgtcgcccaggctggagaggctggagtgcagtggtgccatcttggctcactgcaacctccacctcctaggttccagcgattctcctgcctcagcctcccaagtagctggggttacaggtgtgtgccaccacacccagcaaatttttgtatttttagtagagatggggtttcactatgttgtccaggctggtctcgaactcctgacctcaggtgatctgcctgccttggcctcccaaagtgccgggattacaggtgtgagccactgcgcccggccaccttagcccattttctaaacagggtgcctgttttcttgttattgcattaacttttcccctctttccagcctgctcttaagattgtacatgctttgagggcccgtatcttgtcttagatgctttatctattctttgccttatggaagtggttacataaaacattcttagctgaatttccccctgcttctcgccttctccttgttaatgagtacttattgagtgtgatgtgcgagcatctactttggttcctagacgcccacaagcaaaataggtcagtgccctgctgggagtagggaggggttgtcagggtcttctttgggtttgtggccagacaggcgactgtggagcagaccaggcactctggggacaggatgatgcgttctggctggaagatacagggaggcttcccagggaccctaacacagcctgctgccctggacctttgctggggaactgacttctcagccagtatgtctgtccgcaggctcttgggccttctgcagtggtggaggtgacagtggtgttagccgtggtggtcactgtggtgatgtggctgctgtactgtcattatcttatggcaaaacccgcaagcctgacacacacagtgtctccctgtaagttcgcgccatgatggctcaattagggacccgtcggactgcggctcaacatccaggccagctgcataattgaaagcacattttctcctccaaagctgcagctggtttggttctgctcatgcagaaagggatctaaccttgcataacataggaaatgaacagttgagagagaagccaaattcaatttcagtcagatatgttgaggctaagtccatgatctatggaagccggggcaggagccgtgcgcctgtggaaaggggcgctctcagcagtctattaatcacggccgcccgcccggcgctgccgccactgccgggtgccactgcgcccgcgcgccccctccgatgtgggctggagcgcagccaagcactccagaagttaacctcttaaagacccggagctgctttctgttgaataaatgtaattttgtggtcagaaataaatgcttgtgatatagcaggagctttgaaaacaacggcaagctggagcgattacaaattgctccatgttgtacaagtcaacagcagacatcaaaattccacgtggagggcaaattgatttcggcccagagctctgcagctattcaataaaagtcctattaaaccattgtatgtaatgaacaatccagagcaaatctaatattttcagtggataattatttttaacatcctctcggtaactgctggtagatttcttggatgtttacagctcgaactcgggcagagtgggccttcccagctgtcatttggcatctccgccaggggacccgctccagggacccagctgcgtacatggctcctgaacatggggctctggccttggggttcaggttgccaaggaagggtgcatggggtttctgaatctcccagtgcctgggatgtagtaggtgcctgggaaatgtttgttgaattgagctgaactgagttgaaatgcacaagaggaagctctaagaaccccagaatgacttaggaaaatgatattgtggcaaagttgactcaaaacctgaggctgaagagaccagtgggttgcaggtaaggaaattgaggtcccttgtgatagaccaatgtcagcccctatgggagtcgggacagagctggcaccccgggaaaccccaggacttacccaattcacttcccgtttttggagatggactcttgctttgtcacccaggctggagtgtagggatgcgattgcagctcactgccacctccgcctcccaggttcaagtgattctcctgcctcagcctctgaagtagctgggattacaggcacgcaccaccacacctggctaatttttatatgtttagtagagacagggtttcgtcacgttagccaggctggtctcgaactcctcacttcaagtgatccacctgcctcagtctccctaactgctgggattacaggcgtaagccactgtgcccagcccccatttcactcctgttctgttttggtttggtttggatttttttttttttttttttttttttttgagacagtctcactctgtcacccaggctggagtgcagttgcacgatcacagctcactgcagcctggacctcctgggctcaagcagccctccagcctcagcctcctgagtggctgggactacaggtacacaccactacacccagctaatttttgcattttttttttgaagagatgagggcttgctacgttgcccaagacggtcttgaactcctggcctcaagcagtcctcccacaaaggcctcccaaagtgttgggattacaggcatgagccaccacacccagctcacttctgttcttgacagcttgcgaagtgcattctttgtcagggaggccacactgggagagtcgccaaagcgatcttgttgctcatctagtgttcccacccccaggatgctcccctaccttgctcatgacagggctgtaaccctgtccccttccagaccaagagcttctcagggaaggtctgttcattcattgattcattaaatatttgtggagcatgtatgccaggctagaccagaactagaccctggttagtggtggtaggtgaatgaatgtagccgttgccttcatgaagcttaacagtttagcaagatctgtatccccatgtggcacagtgcttggcgctctgttaagtgatggtggatgggtggatggattggtggatgaatgggtggatggtgggtgtgtgggtggatggatgatttgttagataaatgggaatggatagatggttgattgcatggagggagggtgaataggggatagatggatggatgattggatagaaggatggatggatagatgattggatagagggatggatggctggatgattggataaagggatagatggatgggtgataggatagagctatggatggatgaagggagagatggagggagggagggaaggagggagggagagatggatggatggataactggatagagggatggatggatgattagtctagaggtagggagggagggagggatggatggatggatggatgattagaaagcagtatgtgtctgtaagaatagattgactcttactcattttcgtctcctggagtaaaatcatccaacttgtaatgctcagtcatacagtatttatttgactatcgtggaatttaaatttctagggtattttattttctgcagatctcccttcccttggaaaaactcaatatggatgttaattaggttttactaaagttccatcaatttaatgcagtcgttctttaaatgaaactgacaccaaggaccacatggccaaaggaagcccacgttcctgtgtgtggttctgaggagggagcataggatgcagtttgataacagctgagagccctgaggagtttgttgctggatgtggagtattccatgtctcgtccctcccccagtctttttccagttgtgtcacaactccctttgctaataatattttgcacagcattttacgtctacaaagcaccatttccatgatgtcgctcacccttcgacaccaccctgtgctgggggcatcatcatcattctgagttaccaacaggaggggtagcagacagtccaaggggcaaggcagggactcccagctccaggctccagcctctcctcccctccaccctctcctggtcctgtcctgaaatctttggctcccttgaaacttgttatgcccgggcaaatgccaccctcgtgccactgtattcccaccacctccaatgagtgtcccccacctgatggggtcacacacttgtccagccacctgcacagaaaagcctcatggacacagccctgtgaggtcagaaatagaccgaacagggtcactcggttggaaggcgtggtagtgttagaacccaggtgtttgaactcggtctaatattcattccactctttcacacacacgtaagggcacatgaccactattaatcaaattttcaaaaaaaaatcagctgggcacaatggctcatgcctgtaatcccagcaatttgggaggccaaggcgggtggattacctgaggtcaggagtttgagaccagcctggccagcatggtgaaaccccgtctctactaaaaatacaaaaattagctatgcatggtggcacacgcctgtcatcccagctactcgagaggctgaggcaggggaatcacttgaacctgggaggcagaggttgccatgaactgagattgcgccactgcactccagcctgggcaacagagcgagactccatctcaaaaataaataaataaagggaatttgacataaaatcgttaatgttgactgtttcagcctgggtgacagagcgagactctatctcaaaaaaacaaacaaacaaacatgagctccatgtctgtttcatctgttcccctctaagtataaacttcctgagccttctaagtccagccaggtgggccagcggtcaccgagatccttcctcgctgggggatggaataggcctcccctgctttgctgctgttctttggccttgtcccctgcctcttttcttggaccacctacaaggacctagggggacacagtactgggggcaggagctgggaaaggcctgccatggttcactgatagtaagaaatagagactcactcggagaaatttcctctgaaatacagcagactcagcgcagccctttgggcagatgaaggaggctgagaagagcatcccttcagcaacagctgcgtgccagaagcttcgttccgttctgccatttcatctgcacagcagctcagcccggaggggagaggagtaaatgggcccagagagatcaagtaacttccttggagcttgtcagccttgagctgaaacttggactctgatgtcgaactccgaagcccatgcttattctgtaaagcctgaagagtgtcttataattgatttagaagtaggagaagagggggaacctgtgagattacactgtcttccagcataacaagaaaagagaaaccagttggatgcggtggctcacacctgtaatcccaggtgtgatggagaggccgaggcaggaggatcacttgagcccaggagtttgagtccagctggggcaacatagtgagatcccatctctaccaaaaaaaacaaaaacaaaaaaagaaaaacggaaacccatgaaatgatccatgggtacataggaagggagagaaactggttcctagggctgtgggaggaatgaccgcaggcctgccctgggaaaaagctttgcttttcagggagccccttgatgtttggggacttaggagagcaagtctggccctgagatgtgggaccaggcatccccacagagcacacatcagcagataagggctgccgctctaggaacagtcttgtcccagcgcaggcacgaggagggctcaggaatctggctgggagcattcctgccgtccctactgaggagctgccactgtggaccagaacacccccctgataggagcagactcccggggtgtagacactgcttcccttttcacaccgtctcctgaattttctcctgggttcctgcttaaaggagcggagaaaaccaaactgacaaatcactgatcttggagtcagatctggatttgaatcctgacatcatcatttgccagcgtgaccttgaatatctcatgtccgcttctctgtcccatccatataacaggaaatctctctcgcagagcagcgacgttatatgcacatgtttaaagatgatggcataaaagcagtgctggatgggagctggtagctagttattgattataggatcctctaggtcctttaacttcttcaatagccgtagtccccaggatttaaccttctggggctttccctgtatctctgtcccatccacactccagagtaacctcatctgggccgtttggggctggtggttccaaatttttgcctctggcctgggcccgtcatccaacgccaggcctccctggggctcccactgtgggtacctcgctaactaataatcttcatttcccatgtaaacacaggcacctgcgtatgccccatttcgggagaggtaaccagcccctagttgccctggccagaactctgggagaagctatgttcagtattagaccctgtgaattctttttattattattattattattattattatttactgttgtgttgggctctcgctctgctgcccaggctggagtgcatttgtgtgatcatagctcactgcagcctcaaattcccgggctcaagtgatcctcccgcctcaacctctcgagtagctgggactatgggcacatgccaccactccctgctaagaccctgtgaattctatttccctaacctcgctggaatcagctccctccttcccagcagttggctttctccctctctttcctggtctggtctgtctaccaccagttgccatcctgtcctgagtgatcgcttcatttcccaccctgattgacatcctcagggattccccttcagcataagctgcccccaccccgggcgtggtcccttgcacctccctccacaggctggcccctgcctgcctcctcacctcacgtatccccagtcacctcctctgctccaaggcacggcaggtccctgcccttctctgagcaggccactttgtttgaacacgtctctgtgtctttgaatagccctcctctccccactgaagccttctgcctcccaccacgaataaagatgatctttgtcttctttaaaacttgccctaagtttgcaaaacacaggatgtagagcagcatctaatagactatcatttgtgtttgaaaaaaaaaaaaatagggccgggcgcagtggctcatgcctgtaatcccaacactttgagagactgacgcgggcgtatcacctgagctcaggagtttgagaccagcctggccaacatgttgaaagcccgtctttaccaaaatacagaaaattagccaggcatgatggtgcgcaactgtagtcccagctacttagggtaggaaaatcagaggcagcagaatcgtttgaacctgggaggcagaggttgcagtgagccaagatcgtgcctctgcactccagcctgggtgacagagcgagactctgtctcaaaaaaaaaaaaaaaggaacacagtgcatgtctataggtgcttgtaaatgcataaatacctctgggaggatgcccaagactatctttacctccagaccaggcagctggatgacaggtggatgtggatgggaggaagacctacttttcactgtcaactttgttttcgctttgcttttctttttacaattaaatgacttttagtgtattcaccaagtcatgcagccatcaccctaattccagaacattttcgtcagctcaaaaagaaacctcatactggccgggcgcggtggctcacatctgtaatcccagcactttgggaggccaagtcaggcaggtcacttgaggtcaggagtttgagaacagcctggccaacatggcgaaaccccgtctctactaaaaaaacgaagtacaaaaaaattagccaagcgtggtggtgggcgcctgtaatcccagctactcaggagactgaggcaggagaatcacttgaacctgggaggcagaggttgcagtaagccgagattgcaccactgcactccagcctgggtaacagagtgagactccatctaaaaagaaagaaagaaacgtaatacccattagtggtcactcctcatttatcccaaccccaacccttggcaaccatgaatcccccttctgtagatttggccattccccccatgtctctgtagatttggccattcttaacatttcatatcaatgagatcaaataatatattagttttttgttcccggcttcttttacttaaccatggtttcgatattcatctatgctgtagcatataccagtacttgctttcattctttttatggctgaataatattccattgtatggatgtcccatgttttatttatccaattatcagctgatggccatttggagttttgtttccccactttttggctattatgaataatgcttctatgaacatccatatacataagtttttgtgcaggtaaacacttttgtctttcttgcctacctaggagtagaattgctgagtaatagggtaactctatttttaacattttgaggaatggccaaactgttttccaaggtggctgtgtaattttacatttctgtcagcaatgtaggagggttccagttcagtttctcgacatcctttctaacacttagtatcatcttttttttgggagacagggtctcgctctcttgcccaggctggaatgcggtagtgtgatctcggctcagtgcaacctctgcctcgcaggttcaagcgattctcctgcctcggcctcctgagtagctgggattacaggcacgtgccaccatgcccagctaatttttttgtatttttagtggagacagggtttcaccatgttggccaggctggtctcgaactcctgacctcaggtgatctgcccgcctcggcctcctaaagtgctgggattataggcgtgagccaccgcagccggccccattatatgtctttttgatgctagtcatcccagtggatgttgtggtatctcattgtggttttgatttgcatttccctaatgagtattggcattgagcatcttttcatgtgcctattggccatttgtatctttggagaaacatctattcatatcctttgcccatattctaattcagttacttttattaaatatttttaatttttgtggggatgtatatatatatttatggggtggagcacatgagatgttttgatacaggcatgctacgtgtaataatctcatatggaaatggagtatccatcacctgaagcatttatcctttgtgttacaaataatccgattatacttctttaattgcttttaaatgtacaattaagttattgactgtaatcaccctgtcgtgctatcaaataataggtcttaattcattcctcctggcttttttggtacccattaaccataccacctttccagccccactacccctcccagcctctggtaaccatccttctactttctatgtccaagagttaaaaattgtttttatgtttatatcccacaaatatgtcagaatatgagatgtttgtctttctatgcctggctaattgtttttttatttaatgagttgtaagagggcttatatattctggagtatcttttcaaaacttccattctgtgggttgtcttctcacttttttttttttttttttttttgagacagagtctcaccctgttgcccagggtggctgcagtgtcacgatctcggctcactgcaacctgtgcctcccaggtttgagccattctcctgcctcagactcctgagtagctgggatcacagttgtgtgtgccaccatgcccagctaatttttgtatttttagtagaaacagagtttcgccatgttggccaggctggtcccgaactcctgacctcaggtgatccacctgcctcagcctcccaaagtgctgggattacaggtgtaagccactgcacccagcctctcttttcagtttcttggtagcgtctttagaagcgcagaagttttatatttgatgaaatccaatttgtcgatttttcttctggtatttgtgcttttggcatcatacctaagaaaccattgcctaatccaaggtcataaaggtttacacctgtgttttcttttaagaggttttatagttttagctcatatattttggtctttgatttattttgagttaatttttgcatatggtgtgaggtagggatcaaactttgctcttttgcatgtggatatctggtcgtcccagcaacatttgttgaaacactgttcttttacccttgaattgtcatgtcactcttgtcaaaaatcagttgatcataatatgagggttcctttctgggctgtattgatctgtgtgtttatccttatgcccctaccagttcaggtcaatgtagttttgtatttagtattgaaattgggaagtgtgactcctccaaccttgtttcctttttcaaaattattttggttatttggggtcattgcattttcatatgaatcttagaatcaacttgtcaatttctgcaaagaagccagctgggtctaggcacaggggctcttgtctgtgattctaacactttgggaggccaagacgggaggatcacttgaacctaataattcaagaccagcctggacaatataatgagatctcatctctacaagaaaaaagttaaagattagccaagcatggtggcgcgttcctgtagtctcagttactccggaggctgtggcaggaggatcacttcagcctgggaattggaggttgcagtgagctgaggttgtgacagtgcactccaaccagagtgacagagtgagaccctgtctccaaaaaaaaaaaagccagctggaattttgataggcattaccttgaatgtgtaaatcaacttcgtgactattgccatcttaaaaatattaagtcttccaatccataagcattggccatctttccatttagtttagtgtctttcagcagtgttttgtggtttttagagcacaagttttgtatttcttttgccaaatttattcgtaagtattttatactttttgtgatgctattataaatggattttttttttttactttcactttcagatcatttattgcaaacatgtagaaagacaaatgtttttttacagggatactttgttgcattgagctccacttttttatgctttgaagatagtgtgtttcttcaaaaatggaagtctgtagcaaccctgagtcaaacaagtgtgtcagcattatttttccaactgcaggtgctcacttcctttctctttgtcacactttggtaattcccacaatatttccaattattcactattattatatctgatatggtgatctgcagtcagggagctttgatattactatcataattgtttggggacaccacaaactgtgccccatataagatggcagacttaattgataaatattgtgtgtgttctgactactccaccaaccagctgtttcccatctcttcctgtctttgggtttccctatttcttgagacacaacaatattgaaattaggcaaattaataatcctgcaatggcctattaagtgaaaggaacagtcacatgtctttcactttaagtcaaaagctagaaatgattaagctcagtgagaaaggcgtgttgaaagctgaggtaggttaaaagctggacttcttgcaccagttagcccagtcattagtgcaaaggaaaagttcatcaaggatatgaaaagtgctgctccagtgaacacatgaatgataagaaagccttatttctgatagggagaaaattttggtgatctgcatagacgatcaaaccagccacaacattctcttaagccaaagtctaattctcttaattgggtcttaattgtctcaagccaaagccctgactcttcaattctatgaaggctgacagaggtggggaagctaccgaataaaagttggaagctagcggaggttgattcatgatgtttaaggaaagaatttatctccataatacaaaagtgcaaagtaaagcagcaaatgctttggtggaagctgcagcaagttatccaggagatctagctaagataatcaacgaagatgatggcgctacacaacagattttcaatgtaggtaaaataaccttctcttggaagaagatataatctaggacttgcataggtaaagagaagtcagtgtcttgtctttaaagcttccaaatgcaggccgactctcgttaggggataatgcagctggtgacttgaagttgaagccattgctcatttaccattcggaaaaatcctagggccttcagaattaagctacacctactctgcctgtgcactagaaatggaatcataaagcctagatcacagcatctgtttatagcatgttttactgaatattttaagcacactgttgagacctactgcccagaataaaaaaaggttcttttcttttctgagacagtcttgctcttgtcacccaggctgaagtgcaatggcatgacttcagcacactgcaacctctgcttcccaaattcaagtgattcttctgccttagcctcctgagtagctgggattacaggctcccaccaccatgctcggctactttttgtatttttagaagagatggggtttcactatgttggccaggccagtcttgaactcctgacctcgtgatccgcctgcctcagcctcccaaagtactgggattacaggcatgagccaccacactcggctgataaaaagattttttgttttttgttttttgttttctggttttttttttttgagacagagtctcgctctgtcacccaggctggagtctagtggtgcgatctcggctcactgcaacctctgcctcctgggttcaagtgattctcctgcctcagcctcccgagtagctgggattacaggtgtgtgctaccacgcctggctaattttttgtatttttattagagatggagtttcactgtgttagccaggatggtctcgatctcctgacctcgtgatccgcccgccgcagcctcccaaagtgctgggattacaggcatgagccaccgcgcctagccgaaaggttcttttcaaaatatgactgctcattgacagtgcacctggtcaacaagagctctggtggagatgtacaagatgaatgttgtttccatgcctgctaacacaacctgcattctacagcacatggatcagggagtaattctgacactcaagtcttattttttaagaaatacattttgtaaggctatagctgccatagatggtgattcctctgatagatctaggcaaattaaatagaaatcctttccttctggaaaggagtcaccattttagattccatgaagaacatttgtgattcatgggagggggttgaaatagcaacatgaacaggagtttggaagaaatggattccaaccctcatggatgactttgaggggttcaaggcttcagtggaggaaggaactgcagatgcgggggaaatagcaagagaactagaattagaaatggagcctgaagatgtgactgaattgctgcaacctcatgatcaaacttgaatggatgaggggttgcttcttatgatgagcaaagaaagtggtttcttgagatggaaactactcttggtgaagatgctgtgaatattgttgaaatgacaacaaaggatttagaatattccataaactgagttgataaagcagtgactgggtttgagaggattgactcctattttttaagaagttctactgtgggtaaaaatctatcaaacagcaatgcatgatacacagaaatcttgtgttaacgaaagagtcaatcaagctagccaatttcattgttgccttaacaaattgccacagtcaccccaagcttcagtaaccacaaccctgatcagtctagcagccatccaacaccaaggcaagactctccaccagcaaaaagattacaactccctgaaagctcagataatcgttagcatattttggcaataaagcattttttaattaagatatgtacatttttgagacatagagctattacatacttaatagactatgatacaaacataacttttatattcactggaaaatcaaaaaatttatgtgacttgcttcattgcaatatttgctctttttgtcatatttgccttttttgttctatttttgagacagtctccgtcactcaggctggagtacagtggcacaatctcggctcactgcaacctccacctccagggttcaagcgattctcatgcctcagcctcccgagtagctggaattagcaggcatgtgccactacacctggctaatttttttttttttgtatttttagtagagacagggtttcacgatggtggccaggctggtctcaaactcctgacctcaggtgatctgcctttctcagcctcccaaagtgctaggattacaagtgtgagccaccgtacctggtctgtttttactttcttatggtggtctggaaccaaacctgcattatctttgaggtatacccgtatattgatcttgcattgtgaaagtcttgctgaatgtgtatgtttttatacatctacaatttttttattgtacacatatattatctactcacaacaatggtgatgtgaaaatctcaggtaggcatttatcccctaggaagcctgccccactcccccaccgggatttacccgagggaggtaggagaggggagcattaccccatcttaaactttttgggagcagcagtaggaatctgtgtctcccataggctggaatagaacatagcctagcacatcttagcctccttaaatgactttattgacagaatgaaggaagaagtgaagcgggggtgagcaagcagccagcacctccttcctctgaagagcctgctgcaggcaggtttccctgttgtctaagctgtgatctgctgtcctggagcatttacctgctcatgctggttttgcactgtggggagagagaagacagctaatctttcttccccaagacagcctttcagatagatgttgacagccagaatggcagatgtacttggaagggctttgtaaactcaaggagaatagagatgcttgttgctgtttttatcatcttggcttttaatcttgtgctgtcccctgccacaaatctcctctatggatcccacaccctttctccaagccagcggcttcttcggggcctctctagttttcctcttagaaactttactaagtgggaccgggtacagtggctcacacctgtaatcccagcactttgggaggccaaggcgggtggatcacttgaggtcaggagttcgagaccagcctggccaacgtggtgaaaccccatctactaaaaatacaaaaattagctgggcgtggtggcaggtgcctgtagtcccagctactcgggaggctaaggcaggagaatcacttgaacccgggaggtggaggttgcagtgagctgagatcgtgccacctcactccagcctgagtgacagagtgagacttcatctcaaaaaaaaaaaaaaaaaaaaatttaaaaccctcaagatttggcctgcgtacgtgtctgttttggacagcatccgactcagtcttagctgacttctagtgtttaatgtggcccttcaaaccatgctttgctcttgaaaacattctacagccagacttcgagtgagacaaaactaccctatcatatccctgcagttttgttgatttttattgtcctatagtccgacagagctcatcgatttgaaaattcttttaatggcctgtgtttatttctaaatcattagcttgtaaactcccagggcatagaggctagtggattgttcttgaatatgccgtcttcactgtggtcttaaatgttgcttaggggccaggcgcagtggctcacgcctgtaatcccagcactttgggaggccgaggtgggcggatcatgaggtcaggggatcgagaccatcctggctaacatggtgaaaccctgtctttactaaaaaaatacaaaaaaagtagctgggcgtggtagtgggcgcctgtagtcctagctacttgggaggctcaggcgggagaatggtgtgaacctgggaggcggagcttgcagtgagccgagatcacaccactgcactccagcctgggagacagagcgagactctgtctcaaaaaaaaaaaatgttgcttagggtcctggtcctccaggactttccacatcttggcttcctgcttgatttgatcacgacggggaataacctatggtgtggtggaaagaaaggtgctgactttggatttattagcgaaggttagtgctgttgacccggtttctatccagatggtgtcagatacttaatgtaggaggttcccacatttataatcacaacagctcaacaaggagggagttactaccctcacttaatggacgaagagatcaaggcttcagtatatatatacacacacacatatatacatatatatatatacacacacacaaataaacacacacacacacacacacacacacacacacacactttgctgcccagtcctggagtgcagtggcatggtcttgggtcactgcaacctccaccttctgggttcaagcaattctcctgcctcagcctcccaaatagctgggattacaggtgcctgccaccacacctggctgattttttgtatttttagtagagatggggtttcaccatgttggccaggctggtcttgaattcctgaccttgtgatctgcccacctcagcctccaaaagcactgcgattacaggtgtgaaccaccgcgcctggccttttttttttttttttttttttggagacagactctcactgtgtctcactctagcccaggctagagtgcagtggcatgatctcagctcactgcaacctccgcctccagggttccagtgattctcctgccccagcctccccagtagctgggattacaggtgtccaccaccatgcctggctaatttttgtattttcaatagagacaggtttcaccatgttggccaggctggtctcgaactcctgacctcaggtgatccatctgctttggcctcccaaagtgctgggatttacaggcgtgagtcactgtgcccagccaaagacttcagcatttaagtaacctgcctcccggtcacccagccagtgtgtgctggaactaggattcaaacccaagtctgtcttttgatcaaaccacacactctttccattgaccatgtggcccccagccccagtgcgcaatgctggatgttatcatatccctaggaggggccaggagccagggtccaagtaacttggtgggtttctgcgtctgagaaatgaagctggtgagacggcggttccttcactgttttccaagggctgccacggctttgatcttgacagcaaccaagatgtatctccccactttgcagatgaaaaaactgaggcccagagaggttaattcaatggttcaggcagagcacctgttttatgttggagctggaaatcaaaccctcatgtgccaacagcatgcccaggcccttggctgtgtgtggcgtggacttgcctaccacatgggcatggccaggcccctgtggtgcagtggagagatgagccttttttatttcaaaatacacagcacttcttggccggtcacagtggctcatgcctgtaatcccagcacttcggaaggctgaggcgggtagatcacttgagctcaggagtgagccactgtgcccggcactgtatgttactctcttagagatatggccaactcgtgagatctgtaaccatcagcttttactagattatgctgcagtaacaaacaaactgctacaaatctcagtggcctgtggcaaccaaagatcatttcttgttcatgtgtcatgttgactagggctggctgtgactgtgccccagccccgtgggtggtcctcattctaggatctcagtggaggaagtaggtcctataaggtccttgcagcagagggagggagcacactggctcttaaatcttaatgctcagataagacaccatcacttacataccattggccaaagcatttcgtgtggctatgcctgacatcactgaggagggaaagcacccagggggaagttgctgttacaccacaagtcacgtggcagtgggcagcgatgtgtgacgcctcctccagggagcctagatggtagttgggagcggcagcagcatattccatgtgactccgggaacccacagcacagccgtgctggcactcacatggttgggcactttctcaccccttccatatctcagagatctggtggatttctatgaaacttgttttctaaacctagactgagtttttatactatcataagcggatactgattgagagctagattaaaataccttcctatagacatttgtctttctcttattttatttgagacagggtctcactgtcacccaggctggagtgcagtggtgcaatcatagctcattggagccttgacctcctgagctcaagggatcctcccaaagaggtgggaccacaggcatacaccaccacacccacccagccaattttttattttttgtagagacaggatcttgctacactgcccaggttgatctcgaactcctgcactcaaacgatcctcccaccttggcctcccaaagtgctgggattataggcgtgagccactgcactacacatttgtctttaaatgtaacacttagccgggtgcggtggctcatgcctgtaatcccagcactttgggaggccgaggcgggcggatcacctgaggtcgggagttcaagaccagcctggccaacatggagaaaccccgtctctattaaaaatacgaaaattagctgggcatggtggcaggcacctgtaatcccagctactcgggaagctgatacagaagaatctcttgaacctgggcggggaggttgcagtgagccaagatcgcaccattgcactccagcctgggtgacagagcgagattccgtctctaaataaataaataaatgtaacactacattaaaaaaaaaaaaactcagccttatgaaagtgatgttgctgaaaacataaccgtggaatccagtagcggccattagtgcagatgtgcgggtcactgcaggaagacagctggagagcgctgttgggtgtgtacagtggagaaagacacctcccaggagctactgccagccaagtggctgtcatcatctcacagcacacaaaacagatgcttactacacagagaactctttacatattaagtatttccttttctttttttttttttttttttttttgagacggagtctcactctgtcgcccaggctgaagtgcaatggcacgatcttggctcactgcaagcgcggcctcccgagttcacgccattctcctgcctcagcctcccaagtagctggaattacaggcgcctgccaccacacccagctaatttttatagttttagtcaagagagacgaggtttcaccatgttggccaggctggtctcgaactcctgacctcaagtgatccacccaccttggcctcccaaagtgctgggattacaggcgtgagccaccgtgccttgtcaagaaccctttacatattgagcattttcataaatatttaaacctggattcctgaacccttgggtcacatctgcagaccatgcagttggccattgcggaagatattaaaagcatattaaacacccactgcgtgcccgtggtcgggaggaaaaacagttgatgctacagcttagttttccaggaattcagtatccctgagtcaggcagccttatctgtcatcctagaactccaggacagccccaggtggtggtgggaggggccgcggctgggagatggagctgctctgagcctgcagatcagggtagcattcctgggaggcgccttccaggcggaggggaaattgctcatgtgttctgggaactgggagtgactgggtgtggcaggagtgtgaggcatggcaggaggtgagcctgaaaaagaggctgatccctcagagcaggacaggttttacccaaggctgcaggccagtgtctaaccgtctctagatccgtcctggtttagcttcttccaaatagttttgtgtctgtgtgagagtgtgtgtgaaacggagttttgctgtgttgcccaggttggtcttgaactcctgggctcaagcgactctcccaccttggcctcccaaagtgctgggattacaggcatgagcaacggtgccggctctaaatggttttaagggcacggtacctacctcaagctaacgtgcaggcaggcacgaggtagctggaattctagcctaggattctctcttcagcaattcttgccttaagacctcaccttagacgtttgctcattcacagatccctccccttctcagagggagctgtgttaccaagccttggcttgtacctccaaggcatgcagtggatgggctgagctccctgcagggagtcaggcgggtgtgtggggggcatgaaggtgagcaggacactgtcccttcctccctccctcccacggatgctcttcctggctggtagccatgtggacacctggggggaagctgttctgtgtggcagagtcactgtgttgtgtctggtactggggcccttgccagggtaggtcagtgactcgtccaggccctggaggctgctgctgtcccctcctcgtgcagaggaggtggggctggcagtcaaagcccaggctccctccctccctctagactcagaacagcccaggaacccagctcgaggtctggaggaagtgatgtgtgcattgggtcttgcagcatagataggttttgagtggacggagaggttagcgaagggtgttccaagtaagcaaagcacggaactaggaagtcactggctgcagcagggaagtcacacaaagggacaacctaccacagactgggtgagctgcagagggaggatggactaaactccaacttcagggtcattctggttgtttttttttaagacagggtctcacttggtcatccaggctggagtgcagtggctcaatcatagctcactccagccttgaacccctgggcccaagcgatcctcccacctcagcctccgaggagctgggactacaggcgtgtaccaccgtgcctgtctaatttgtatttttttgtagagatagggtctcactatgctgcccaagctggtcttgaattcctaggctcaagccctcctcccacctcagtttcccaaagtgctgggattacaggtgcatgccaccatgcccagctaatttttatttttggtagagatagggtctcactctgctgcccaggctggtcttgaactcctgcctccatttcctaaattgttgggattacaggcctgagccactgcgcccagccttgaggcccattcttgtctgcggagcggaggggactttatcatttagaaaaggatcttttaagtcatctcttttaagaaacctcatggtccatttgcatactgaattcattaaactcatcggcctgaccgtgttcctcaggactgggctggaatttccctgtgttagtggaagagggcacggggagaggactgagagtcttggtccctgtgatacagctctgatgagtggaggaacactggggtttttggtttttatgccggtttagataaaatgacatggatacacgtggagtggttttttttttgttttgttctgagatggagtctcgctctgtcgccaggctggagtgcagtggcgtgatctcggctcactgcaacctccgcctcctgggttcaagcaattctcctgtctcagcctcctgagtagctggcattacaggcgcctgccaccatgcccagctaatttttgtatttttagtagagacagggtttcaccatgttgaccaggctggtctgcatctcctgaccttgtgatccacctgccttggcctcccaaagtgctgggattacatgtgtcagccaccacgcccggctcagtggagtggttttaaaaccccgatgtccacggggctggttccttctgctggctgtaggggagaatctactgtgtccctgtcccagcttctggtggtttcctggtcatcttcttctttgtagatcatcagcccagtctctccttcatcgctctgtgacatcctacctgtctacatgtctgtttctgtgtccaggtttctcctccttattggatccaactggacgagggcccaggctaatgaccttgccttaccttgatcacctgcagagaccctagctccaaataaggtcaccttcacaggtattgggggtcaggacttcatcatctttcaagagacacaattcaacccattatagccccgaagtgtgccgtgcaaattaccaaaccccacatcctggggaataacccaaacaggagacaggaggacagagttcaggatccttccagatcccagcccttgcctccaggagacgcagccacccggtaccctgagtcggaatacctcggaagtgaggggccctccctaggcagatcctaagccagaaagagaagcctctgtgtggccatcaagcggtacggacagcagccagggcgtctgcccagcttcctggacagactctgctacccacctgcctctcttagaagagccccaggttgcgttccaattcatctggagaagcaactccaaatccgttgcttactctagacatctataatatgtgggcttaggtacagttgaaacagtgccatttagacagttcccaaaatttgtaatagatactgagaaagatacatgatacgacagggaaagaaaacacaacacactatcttacgtataggctgatttcaagtacgtacatacacacacgcgttttaagcagcttgattgagatataattcacataccatataattcacccatttaaagtctggagttcattgacttttaggatattcacaaagttgcacagctgtcaccacagacaattgtaaaatgttttcatcaccccaaaaggaaatcccacacccttcagttggcatccaccagcccctccttcccacccacccccagtctgagaccactcttaatgtataatacatctgtctcttgtttgcctgtgtgtctgcatttcatgtaacttttttttttttttttttttttgagacggagtcttgctctgttgccaggctggagtacagtggtgtgatctcagctcactgcatcctccacctccggagtacaaatgaagcaattctcctgcctcagcctcctgagtagctgagattacaggtgcacgccaccatgcccggctaatttttatatttttagtagagatggggtttcatcatcttgaccaggctggtcttaaactcttgacctcatgatctgcccacctcggcctcccaaagtgctgggattacaggtgtgagccaccgcacctgaccacaactctattttttttttatataattaggaaaaaaaaatagaaataaagacctgatagtctgactcctgccggtgagtggaggatttcaattatacttttaaattttttttctatatttttgatatttttctgatcacacaatgagcatgagttgctaataatgggggagggggttattttaaaaacaaggcatggtcttgtcatattaatagtccttgtaggcaaggcatggtggctcatgcctgtaatctcgcctgacccctgaggtcaggagttcaagaccagcctggccaacatgacgaaaccccgtctccactaaaaatacaaaaaaaaattagctgggcatggtagcacactcctgtagtctcagctacttgggaagctgaggcaggagaattgtttgaacccgggaggtggaggctgcagtgagctgagactgcgccactgcactccagcctgggcaacagagcgagcctccatctcaaaaaaaagtccttgcatattgttctgagattctactcaacaccaaattcacaaccttgttttttgttgttgttgttgttgtttaatttgagacatggtctcgctgtgttgcccaggctggagtgcagttgtacgaacacagctcactgcagcctcgaactgctaggctcaggcagtcctcccacctcagcctcccaagtagctggtattacaggtgcattgccaccccgcccagctaatttttttgttttttgtaaaatttttatttttaaattttaatttgtagatagctcattattttgcccaggctggtcttgaactcccgggctcaagccatcctcctgtctctggctcccaaagtgctatgattacaggcgtgagccaccacacctggcccagaatcacagccttatcttatcgggttgagggggtggaaatgtgtctgagttccaaacaattgacttcaaattggaatcttggtgcacagcttgttagaagttggaaatgcttgcattgcgctaggctgctatgtgttcgattttctaggcccagctcccactagccatcgtcccccagttctgagcgccccacatccttaatcaggagacctctctcagcccttaacaaactgcccggtggctcaggtgagaggccctgtaattaaaccgcatcctttgcctctgtaataacatcggagacagcatagttctaggaggggacagacggaatatataatttcctgtcctttgcctgagccagtatgacattggtacatgtgcagtcttgcgtgtttcggctgtaaagtgcgatctgttgtctcagcaagtgtgtaggtaagctaaatattctaacaagtcagtccaaccatggcaggctctttgcatatgcgtccagcatagttgatgaacagacgtctacactagaggaaactggctcagttagtcagttcacaaaaccaatcctggccaccatcgcaaaaccttgccagttgcctaatctggaatccccgggaccgtcctcaattcacctggttcttctgggcctcacgtcaactgtgtgtgtcgctgatctctccagccgccctctcctcctcctcgacacccacaaccactgcccagcgcatctcactcggatgaaagcagtgacgtccgagggttctcttcctccctgccccctcctgtgctctttccaccctgaccgctgctcaggtgatgagggtctccctgcaccatgcacccttgtgcccctcaaaatctcaccccacttgattgtccagctgcgtcacccacagctcctgcatatgtatccgcgttcccacctggcagactctcgtgggtcccctatgccccatggtgtgttgtagccgtgttggtggactcttaatctggactccaggaatagagcacaagctgacatgcaaatgagtgtcttaaaacagaacacataggccagacgcagtggctcacgcctgtaatccccgcactttgggaggctgaggcgggcagatcacctgaggtcaggagtttgagaccagcctggccaacatgataaaacctcgtctctactaaaaatacaaaaattagtctggcatggtggtaggcacctgtaattccagctacttgggaggctgagggcaagaatcgcttgaacctgggaggcagaggttgcagtgagctgagatcgtgctactgcactccagtctgggcgacagagcaagactctgtctcaaaaaaaggagaattttatgaaattctttgctcctgggatttgaatgtgttcgtccgtttacatgcagcatcttacccgtccacctgggtgaaatgctttttaagactctgctctaaggtcacaactttactgcctgaagttcccttctgcatgtccccagggatttaattacttgttaattacatacctgtttccctcctagaccctgagcttctgggggtaggaactgtctcttcccacccacctctgatccccagcagtgtctagcacatggccagctcttaagtcagcatttggagaagacaaaagaccaggaagggcacgccagaccattctctatggaagacccacccagtgttccctgctgtatagtgaatggctccatactcccaaatctctgctcctcccttgtttaccttcatgaacagggtccttttgtgtttgcaggcatttcctctaagaggctgaagcccagttgtcaagcatctcccttgctacgggaattcactagatgtgtaatgctttgtaaattacctcttgacaaatgttgagctctttgtttttcttttctttctttccttccctttcagattgatgcactgagtaaaagaagcaaggaagctgaagcagctttcttgaatgtctacaaaagattgattgacgtcccaggtaagccccggcagtaatggcccaccagtggggggcgttgtgtctggtgagtcggtgggtttttggctcattcttcttggctttcctaaggaaaataaatacaccatcagtggcaacttccccccaagaaaccagggagtgcaggacacatgaattcttcacaacccagactttgggtacggagggaaattggatgcacttgttgaagtactcacgtaatctctaggggatgacttcgtaaaagcagagatccaaatctctggggctacagcataaaaccctgcacgtactgcagagaagatgcagacctgatgtgtgtatgctgtgtggaagtccctcatattgcccaaagccacctttaagactttaggaatggccctactaagacacctggagtgtcccgctcccctgccaggtcatccaagatcagtggcccctggacaagcccttcacttaagggttatgggcagagggtaactgataatccttgcagctacaaccaagtatatcagttgtttcttttattttttttttctaattttatttatttatttttgagacagggtctcgctctgtcgcccaggctggagtgcagtggcacaatctccgctcactgcaacctgcacctcccgggctcaagcgatcctcccacctcaacctcccaagtggctgggaggtacgtgccaccacattcagctaatttttgtattttttgtacaatgagtgcgatgaggtctcactttattgcccaggctggtctcgaactcctgggctcaagctatcctcccacctcagcctcctaaagtgctgtgaggttacatgcaggagccaccacgcctggccctgtttcttcttttagagggattgaagaattaaaatttaaatatgtttgtgaggcattctaagaggtgatggcttccgattctttattctggaaaagtgagaaggcaggtagagtgccttgaactctctggtcctgtttgtgggtcctcgattgccttagaatctggagtaaggtgatggacataactatgtggggcccagctcagccctggagagatgctgatcagaaaattaggaaagtcacttgatgcctttttctgccaagcaaagaattggaattaccaccaccctcccctccccacccattacagttgtgcccttgcccttgttagcaattctctgaatatcattgacatcattagagctacattaacagagcgaggcagactcaggtctcctttgtacctgtacttgtgttctgattcaggtctaccacgggctttgctgtcccctcttggagctgggattaatagaggtcacaccaaacacgggatggcagaaagcacttcggacagggaatgaggagacccagattctccttccctggatgacattccttttcctctctggacttcagtgttctcatctgtaaaatggaacagggtcagggaacagcctaatcgtagagaatggtttgctttgttctaaacttttgctgtcttaggagcttatctagttattggttccaaattctagccttttggttttctgtgagagtttgtatctgactaggagttccctgaagaacctgactgagcttcacgaggaggctccttcacagtaaaatggatcagagtgttaccactggagggtgtccaggttcttggcgttttgagcaatgaattggacaaaatgcacaaagcaaggaaagaatgaagcaacaaaagcagatatttactgaaaatgaaagtacactccacagggtgagagtgggctgagcagccgctcaagggcccagatacagattcttctcgggtctaaatatccccttgaggtttcccattggcaattggtgttcaccccatgtaaatgaagtggtggccctcattcagtctgatcagttgcagaaagcaaccaaccagaggctgaagtgaagttataaaggtcacactcctatgcaaacatcttgattggttgcggaaagtaaccaatcagaggctaaattgaagttacaaagttgtacttctatgcgaacgaagacttggccctgcaatcagtctggttggttgcaaccaatcagaggctgaagttacaaagttacgcttctctgcaaacatctgattggttgcagaaagcaactaatcaaaggtactttcaatttcccatctgcagggcagaaaaggtggaggtttgcaaaggaagtagacgctggtccttttgttacttaggcgtggcaagtgggggtttttccttcgatttagttctaggaagtcagggtgaatcagcctttggttccctgcctgcagaccctattttcctgcctcaagagcactgtccctcgggcatcagcagcctggcgggcatcactggcattttcttgtgcataaggtagtgactgagaattttctctctggactatgtcatgtccatactgacgcagggataaagaatttacagaaaaagcatgacctgggctttgagaaattttattttgtgtttcgaaagagttcattctttgactttttgttggttcctcaggctcaggaaggttctgctccattctattccaagaagttcttgctaccacttctgggagcaggatcccagaaggggagtgttttccagctgagaactttgtccagttggtgatttagtcggaagaagactggcttacttcatctttgccagagacccaaagactgtttagctgctgttttctaaataatatgtaatctcttttctttcttttttttttttttttttttttttctgagacagagtcgcactctgtcaaagaggctggagtgcagtgacgtgatcttggctcactgcaaccttcgcctcccaggttcaagcaattctcctgcctcagcctcccacatagctgtgattacaggcacccatcacgacacccagctaatttttgtactttagtagagacggggtttcgccatgttggccaggctggtctcaaactcctgacctcaggtgatccgcctgcctcagcctcccaaagcgctaggattacaggcgtgagccaccatgcccagcctagctgctgttttctaaataacctataatctcttttcaaaaagtcaaatttgtacctcaatttttccctagtgaaattttccaactgggcagtcactttaaaacattgctaggtttctttctctgcagttacgttctgtgttaatttcccatagaaaaaagaccgtttttctcatcaacgtttcctctttacctgagccaaccttgtccatgtacatgtacaaattttatagaattttgatcatagcatgggtatatattcatattctgcctttctcacttaatattatgattcttattattaccataagcattttcctatattggtaatattcttcacaatttttatttctggccagagaattgaagtttgcagtttaaattgatggatggtgggagcaaagaatgtttgatgttttctgtaatactaaaagtcaatcagaatacatctacattccacatagatccctttcacccaccgcttcccaggtatttcttacaaatgctgtgatctgccacatctaacaagttacttgcaaagcaggaatggtgctcggagcactctccctgtgttttgaagtctgattattgctcagatgcaatcattctgtggctgaggcttacaggaagggcccggtcaatagtgatgatgcatttactgacagtcactcagtcgaggggagtcggggtgccttaactgtctgcatacttcaggccttaatccagtggaatccagaaacattagtagggtgcagtaagttctgctagttgcaagagacagcaactcacactgtcacaggaaaagggaggaagcccttgggaataatgcaacaggcattccagctatatgccacacagccctgctcctggatcacagggagagccgccaagctggccccaggaacagcggagccagagtctcacccagcccaggagtgacaggcacctgaccgcaccagctcccacctgcttccccttcctgaagttttatttatttgtgcatttccttgttgcttatctctgggtctcattagagtgacagctccatgaggatagggctttgcattgtggctctctgcccagtgcctggcacacaacaggtgggacatagtgaatgactgaaggagtcaatggacccaaattcccgccactcccactgagtcctcagcagcggagttcaccaagggttgcactggtgactctcagagctttgtccctggtccaggtctcactcctgagtgccagcttgcatatctgactgccgcctggactttcccactgggatggctggtgggcacccacctgatgtgtccggcagaagccgtcttcttactgcctgccttcttttggcgggtagcatcacctcccaccttactgctcatgttctgagctttttgtttttcttgagatggggtcttgctctatcacctgggctcaagtgcaatggtgtgatctccgcacactgcaacctctgccttctgggttcaagcgattctcgtgcctcagcctcccaagtagctgggattacaggcgtgcgccaccacacctggctaatttttgtatttttagtagagatgagttttcaccatgttggccgggctggtctcgaactcctgacctcagatgatccgcccccctcagcctccaaaagtgctgggattacaggcgtgagcaccatgcctggcctgtgttctgagcattttgtcaccaactctggccatccaacctctaggatgtctcaattccagccacttgccttcacccaaactcctgccctacagtctgcagttcacggtggcatgagtctaagtgcttacagggcggccagactcttcctggctaatcgccaccgacccctctggattaacctgttgagacgccacttcctgacagagaggtcttcctggcctccccagctggtttaggggacccttcccatgcacacacacaccctggccggggaccctgccattcacttcatcataattccttggtaactgtttggccgagagactggttcagtgcggttttgtccctatttcctttatatccaccccagtgcctgccatgtggcagaaactccataaatattgctaaatgaatgcagaaattaatgaatcaaattatttcttcaaaatgctgagtgtttttttggtctcaggctcctactgttcccactgaaccaccctcccgaggttgaagcttcccagtgagggcgagcactgcagagcactaagacaagtcaattgcaggagaacagaatgtatcttttattgagttgtagcagtttaatagctgtctgaactctcattttactttgttgtcattctataaagatttacatgcctgcatggacatttatacagcacttagcattcggagttgcccaaaccagcacatgtgcatctgaggacttcggctctggggccggcccttggtgtctgggatctgtgtttggtttaccagacgtcccgccggcgccccaagcccagcacacagggtaggatctccctccaccccagcttatcccccaccatccccacccgccccacttctcccttggtgttctggctcctccctcttcttcatcttccaccttctataatttccttcacattaaagacacaaaggccaggcatggtggttcacgcctgtaaccccagcactttgggaggccgaagcaggcagatcacctgagatcacgactttgcaactagcctggccacatggtgaaacctcgtctctactaaaaaaatacaagacattaggtgggcgtggtggtgggcacctgtaatcccagctacttgggaggctgtggcaggacagtcggttgaacccaagaggtggaggttgcagtgagccgagattgtactactgcactccagcctgggtgacagagcaagactgtctaaaaaataaataaaattaaaaaaaaaagacaccaaataagcatttagcaatacagtagcattgaaccctcatggtcctcatgtacctctgagtaggtttggtagttcataccttggtgtttgttcttttcatttgccaccagatcgcttcttatttcttagtcagtttcgcgagtactatcagacttgtcttcctgggtattactcgggtcaatgcctgagaccccagcacccctcatgccccacaccacacccccagggcatcaagaaccaggctgagccccagggatacaacagccagctcagttcctgccctcagactatagaggctggtgggaatatgggcattaaaaagtaattgcgaccgggtgcagtggctcacacctgtaatcccagcactttgggaggctgaggtagctgaattacctgaattacttgagcccaggggttgaagaccagcctgggcaacacggtaaaaccccgtctctacaaaagatacaaaagttagctgggcatggtggcgttcgcctgtagtcccagctgctcaggaggctgcggtgggtggatcacctgagcccaggagatcaaggctgcagtgagccaagatcacgccactgcacttcagcctgggtgacagagtgggaccctgtcaaattaaaaaaaaaaaaaaattagaaaaaagaagaagaaaaagtaattgcacaaataactgaattttaggtgcgataagcaaagcccactgggcaatgagagtatagaataaggtgaatcaagcaggacagaggcagctgccctcaggtggcaccaactggggccaggagaagaagccacaggaagcagttttctgaccagagaaagcagcagcagggaggagctgggacaggaaggagaccagcaggtggggagaatgtcgggtcaatggggcttagtgagcagaagaggaaaaggacccagcagcagccaagccctgcagcagccagacggagacactgaagtagtcagaggggctgtgaataatgactctggggatcgggcgcagtggcttactcctataatcactgtactttgggaggctgaggcaggagaggtatttgaggccaggagttcgagaccagcctgggcaacatagcaaaaccccccatctctttaaaaaaaaaaaaaaaaaaaaagatgaacaagtaaaatatgcagcctctgtctctagttcaagaccagcctggcaacatagcaagaccctcccatctctttaagaaaaaaataaacaagtaaaataggcagcttctgtcccttactgtaatgaaatgagaaatgtctctgctcttaaaatgtaatgtgaccctctcaggtagctgggaatattctggaatgaccgcttctaacaggctcttgcatagctggaattttactgagttctaagcaaaattatgacagtatgcataattcgtcagtaattaaccttgtgtgggtgacttgctcttgcttcttgatacttttcatttttttttttttttacaatgagtatgtatttatttctacaatggtggagaacataaattagtaaaatattcaacttgcaatcttagtttctgaataggccttattaatgtattgcagataagaacttagtcaactagttgtagggtaaaacacaagtgtgacttctctgttccagaaacatcttagtaatgtttttgggggtttttgtttgttttttattttttagcagcggggtctctgttgcccaacctggagtgcactggtaccatcatagctcatttaaccgcctcctggctcaagtgatccccctgcctcagcctcctgagtagcaggaactacaggcacacgccaccacacctggctaatttttaaattttttgtagagatggggtcttgccatgttgccaaggctggtctcaaactcctaggctcaagcaatcctcccgcctcggcctcccaaagtgctgagattacaggcgtgagccaccacacccagcctagtaatggtgtattttaaagagttcctaggtagaagaaaaagactaggcactccagaacttctgtgctttggttgcaaagttcactggaagcatctctttgcaagttgtccttgcctctgtctgtgacctgctatcagaaccgtattttactgcttgctgagatgcagtttagttcctacagacacaaacccttcaaatataaaggcagtgcctggaagggtttattttaagatttaaatcttaggaagcacattaccagtgatataaaatattcattgactcatgaaacactgctagaagtcgctgtttcgtgactgactcgtctccctttatttccataggttaactggtctgcctttgtgaaaagtagatgtaggtttttcggaagtcctaaaagagagctggctggaaagagtgcatttgtaggccattccattttcagagcctgctcccaaatgcctgtgctctgaggtcctccccctgggagaggtttcattttggatgtaggaaaaccatctctcctggtgactatccttgtcggcctagcatctgagaatctagaaataaaatggaatgtcatcatttttgagaactgctttttaatgctcctccaggagaataaaatagcagtctggttcttggtgcctgctactttcaagtgaggacacattacaggttaaaattagaaaacactgttcttttatacttctttctccactgcctgcccctcactcaaagatcccacattaagactcctggaaaaaaagttgaagaaatcagcctggcgtggtgactcacgcctataatgccagcactttgggaggccgaggcaggcggatcacctgaggtcaggagttcaagaccagtgtgacaaacatggtgaaaccccgtctctactaaaaatagaaaaattggccgagcatggtggcgtgcacctataatctcagctactcgggatgctgagtcacgagaatcgcttgaacctgggaggcggaggtggcagtgagcctagatcatgccactgcactttagcctgggcaacagagtgagactctgtctcaaaaaaaaaaaaatgacaaaatcttatgatttcgttagaaatagcccctggttttcatgccaagaagttcatcaatgtgccacttggtagccttctcgaaggtgatagaaatgtggccattgcagcctgattctgtacggtgactccagtccacgtattccaggtctccaggtgttggcaaacaagacctgggacccagggcccctccggagagctccctgtaacttcagtagcaggagacatgcgggatccctttacaaatcctcagtttgccttcataaaacattttcattcatgtgattaagaagtaatcacaggccccaaacaaaacaggacagaaagaggaactgggtctggaagaataaagccctgtgggtggcggataatgtgctgactcctgtccaggatacaggtccctggccctaagctggtcctgaaacagcctcgggggacgaggctgtatgctctgtcccagttacactcaggctccggcattagggaaattggaaaccaggcatggaagcagcgtccctaccttcctcggccaggttcataaacctggggctcaatccgcctctccatgtaggacactgtatgtttgcaggctgaggaattggccaccactgttctaaagacaagcaggcatgacaagatgggcgttaggcctgttgccgccaggttttgccggctgccgtccttcccaaggctttcccttctccatccatcctcccccggtccctcgacacagcactagagtgagaacaccctggatgtgacttggggactcctcctcggtgtgcttgcgtggagagtggagaggtgcgtcgtttgtgccccgctttgccatgaccggggtggtcctggcacgccgggtatctagacagcttttcatcagtcgctcatcagcatgctaattgccgtatgactaattatgccctgaattccagttgattttcttaatgagacagctgggttaattatgtaatcgtatgattacattagcctagagtgccctggcgaaaagtagcgtctgccgcattgtgatgtcatcgcggggacggtgctcacaagggggacattcatcctcaggctggtggcaggggacagcccccatcgcccgcagagcgcactgtgcaaacatgagcctcatgtctattaagattggctttttcagccctcacaacctacaagaaaagcagttcaccaccagcagtctcctcgccaccctgcgccctctccacgcccccagccgaatccaaaagccgcctgcaggcctctgcagctcttctgagatccagccatgtgtcctttcttctcacaggacctctctgcaccgaggctgttgggctttatcagggcacaccagcacttccttcagagtgatccgaagaactcaaagcaaaatgtttgcattaaagtcccagagcgacttagttgacgataacatataaacaagccctagactggccccgaccttagatcccactgcgcacgccagatatgctgtttcattccttctttctgcccaatctctaacacacatcatatttactaggaaaatacatgaccgataccttctggtttctggccacttcgctactccccatcacagcagaactcccctgggaggtgactgcctgctgaatcacttcttcacctatttacactcttcctccttagacttttgtggccttctcctcttcctctgccagggctctaaatgttggagtatgccaggacgttattcttagccttttccttttcatttgcattccctccctatctaaaactccacatgaccaaaagagaatgatcatttccccccacgtgctcccaagatagtcagtgacatcaccattcacgcaggtgctttggccactgatatggtttggctctgtgtccccacccaaatctcacctcaaattgtaatctccacatgtcgagggaggtgattggatcatgggggcagtttccccgtggctgttttcatgatagtgagtgagttctcacgagatccgatggttttataagtgtttggcagttccaccttcgctcatctctctcctgccactttgtgaagaaggtgcttgcttctccttcaccttccgccacaactgtttcctgaggcctccccagccatgtggaactgtgattccattaaacccctttgctttataaattacgcagtctcaggtatttcttttttgttttttttgagatggagtctcaccatcgcccaagctggagtgcagtggcataatcttggctcgctgcaacctcctcctcctgggttcaagcgattctcctccctcagcctccctgggattacaggcgcctgccaccatgcccaattaatttttgtatttctagtagagacagagtttcaccgtgttggccaagctgatctcgatctcctgacctcgggtgatgcgtccgcctccgcctcccaaagtgttgggattagaggcatgagccaccatgcctggcccaggtatttctttatagcagtgtgaaaatggactcatacagccataatgcacaactcagcctgggttcccttctttctttcacacccaatagccaggctgtcagtaagtcctagtgagccagcagcctccagaatgtatcccagattcgcccacttacccttcagccactgtcacctagtccaagccaccagtctctgtcacctcactgcactcacacctccacctaacgtcctttgcacagcaggcagacgggtctacgtcagtggtctccaaactacttttgcttatgcaccccaagagtaaaaaagtttgaattgggccaggcacggtggctcacgcctgtaatcccaccactttgggaggctgagggcaggcggatcacctgaggtcaggagttcgagaccagcctggccaacatggtgaaaccccgtctctactaaaaatacaaaaattagctggtgtaatggcaggcgcctgtaatcccagctactcaggaggctgacgcaggagaattacttgaacccaggaggtacagtgagccaagatcgcgccactgcactccagcctgggcaacagagcgagactgtctaaaaataaatacatacataaacacatacaatgaaatgcgctcatttcaagtgtgcagtgtgatagcgtggccaccttcacagtcaagatgtagaacatttctatcacctcaaaagttcccttctgatcccagtacccagcaactgctgttctgctctttgtcacttctggagttgtatagaagtggaatcatttggtctgtggtcctacatctggcctctttcactcagcgcggtgttttgggattcatctaagttactggtgtcattagtcctttcctttttattgatgaatgatattccactgtgtggatatataccaatttgtttatccaacagttatgttgacagacatttggttggttgtgggtattatgaatcagtctataaacattcatggagaagttgttacataggtatatgtttttatttcccttaggcaaatacttaggatgagggtcagggaacctgtacattttacctgataagaaatgccaagctgcttttcaatgtagatgtatctttttttattaatttttttcattttcttttcctcaggatagcaaagttacagttgtattattttatcccctcataagaaattgagaggagttccagttgctccatgtcttctgtttcatcggttattttctaattttagacattcctagtgaatgcgtaatgtatttcacaacgattttagtttgcattttcctgatgattaatgatgcagaatattttttcatgtgcatttttgctttcatagatttttatttataaaggtttcaatcccttgcacatttgaattttggagacagggtcttgctctgttgcccaggctggagtgtagtgatatagtcatagctcactacagcctcagtcttccaggctcaagcgatcctcccacctcagtctctcgagtagctgggactacaggcatgtgccaccacacccgattaattttttgttttttctagacatgaggtctagctgtgttgcccagactggtctcaaactcctgggctcaagcagtcctcccaccttggcctcacgaagtgctgggattatgggcatgagccaccgtgcctggcttctgtatacgttttagattcagcttgtcagtttttacaaaggagttttctgtgattttgattaggattccactgtatttgtagatcaatttgaggaaaattgacaacactatttattcttccataatatatttatttagttcatctttaatttctctgagcagtattttacagttttgatgtataaacctggcacagattatgttcagtttatttctaagtttaagtcatgtttttgaatgttatattaaaggatattttcttttttaaaaaatctacaatgtttattttattattattatttttaatctcgcttcatcaccaaggctggagtaaagtgacgcgatctcagctcagtgcaaccaccgcctcccagattcaagcaattctcctgtctcagcctcccaaatagctgggactacaggtgcctgccaccacacccagctaatttttgtatttttagtagagacagagtttcaccatgttggccaggctggtcccaaactcctgacttcaagtgatctgcccacctcagcctcccaaagtgctaggattacaggtgcgagattaaagtttattttcttttgaaatttgttttccaattgtttgttgcttttatacagaaatataatgaatttcatatattatataatttttacattttaacaaataataaaatatataaatatatattttatattatgtaatgtttatataataataatataggtgacctcttaatgctcacctattagctctagaaatttttttgaagttttcttgaattgtccatatgcccttgaagacaatatatacttttttcttttttttttttttgagacagagtctcgctctgtcaccctggctggagtgcagtggcacaatcttggctcagtgcaacctccgccttctgggtttaagcaattccctgcctcagcctcccaagtagctgggattacaggtgcccgccaccacgcctggctaatttttttggatttttagtggagacggggtttcagcatcttggccaggctggtcttgaactcctgacctcgtgatctacccgccttggcctcccaaagtactgggattacaggtgtgagccaacgcacccggccacaatatatactttattgatgttggatggaatgttctgtaaacatcagttaggtcaagttggttgatagtgttgttcatgtttcctgtatccatcctgatttctgatctataatgctgtatatttattttccttgcttttttttttttttttttttttttggcacttgctacctgtataaaatgttgactagaagtagagaaagcagacatccttgccttggacccaacattagggaaaagcattcagactttgataattaagtataatatcaactgtagatttttttgtagttgccgtttataagatggaaattctctcctattcctagcttgcggagaatttttgtcataaatggtattgaattttctcatattgttttcggcatctttcgagatgatcatatgattttcctcctttattctcttaacatggtaaaataatttgattctcaaatgttaaacaaatcttgcattcctaggataaatcttacttagccatgcattttatgcataatatgcattttataatatattttgtgcattttaaaatttgctggattcaatttgctactgttttactgaggacttttgccgttaaatttatgaggaacgatatggtttggctgtgttcccatgctatctcatcttgaattgtagttcccataaaacccacatgtcgtgggagggaccagtgggaggtaattgaatcatgggggtggttatccccatgctgttcttgggatagtgagtgagttctcacaagatctgatggttttataaggagcttttcccgctttgcttgtcactccttcctgctgccatgtgaggaaggacatgtttgcttccccttctgccatgactgtaagtttcctgaggtctcctcagccacgctcaactgtgagtcaagtaaacctctttcctttacaaattacccagtctagggtatgtctttattagcagtatgagagcagactaatacagaaatatacaactatagttttctggtttttttcctttgaatatccatatagggttttcactttaaggttgcactggtcttgtaaaataagttagaaagtgctccccctttcctctatttgctgaaagagtttgtataagattgcagttattttttcgtaaaattcaattcatcagtgttgccatccaggcctggaattttctttatggcaagtttttaaattacaaattaacttctttaacagatgcaaggctattaagttttttaaatttcttcttgagtcagttttggtaatttggaatttttaaaggaatgatccatttcatctaaattatcaaatttgttggcataatattgtacataatattttattaacttttaaatatctgtaggatgtgtagtgatgtcctttcttatacttcctgacattagaatttgtgaatcctccccccgggcttttttccttgattagtctggctagaggcttatcaattttaaagttatttaaaaatagaaccagcttttgtttgcattgatttttctcttttttttttttttccttgttttcagttttgttgctttctgttcttattagctactttctacttactttgggtttaatttgctcttctttatgagttttactaagtgggcattgttttatttcattgtggtcagagtacatgtttgtatgatttctgttcttttgaatttatcaaaagttgttttctcatcctgtacatcgatgaatgttccatgtgtacttaaagagaatgtgtattctgtagttgtttgaatggcatgttctagaaaagtgagctctgtttagttagtggtgttcttcaagtctcttatatccatattgactatataaaaatcataatattaattaatgtgaatggcttttttcgttgtttttttttttgagacagagtctcgctctgtcgcccagagttgagtgcagtgacacgactttggctcactgcaacctctgcctcccgggtttatgcaattctcctgaatgtggatggcgttttgaaatctaattattattttggatttttcttttttctttcagttctgtcagtttttgatttgcatagtttaaagctttgttttggggcaaatatacctttaagattattatatcgtctctcaattgtttgattcttttaagtttatacaatgaccttcattattcctggaaatattccatatcgtaaagtattctttttctgattttaatataagcactctggctttcttttgatgagagtttttatgttatatatttttctatacttttactattaacctgtctgtatctttatgtttaagttatgtaaatacctacatcttgcttttttatccatcctatctgcctcttaactggaatgttagatcatttacatttaatgcaattatggataaagttggattgaagtctaccatcttactttttctatttgtcttgcctgttttttcttgtatttttcctgcttttgattaactgatttttttaatgtttttatctccccaattatcttattagctataactcttattttcttaagggttactttaaagtgaaaagtaagccagccatgatggctcacacctgtaatcccagcactttgggaggccaaggcaggcagatcacctgaggtcagcagttttagaccagcctgaccaacatggagaaaccctatctctactaaaaatacaaaattagctgggcgtggtggcacatgcctgtaatcctagctactcaggaggctgaggcaggaaaatctctcgaacccgggagacaaaggttgcggcgagctgagttcgtgccgttgcattccagcctgggcaacaagagcaaaactccatctcaaaaaaaaagtgaaaagtaaccatctttaacttatcattttataccttcaaataatacaccatttcacatacaatataagaatcttataatacattgtcactttctcactcttgttcttttgtgcatttttactgattttacttctacctatactacaacgctataatacatggttactattttttctttaaaccattaacttttaaagaaattaaaaatgaaattataatattttatttttactcatctatttaccatttccagtgttgtttattcccttgcgtggattcaagtatgcacgtgaaatcattttcttttggtctatagatctccttttaacatttattatgatataggcacactggcaatgaattctgttagctttcattcatctggggaaaaaataccttaatctcacccttttttttttttttaagacagagtcttgctctgtcacccaggctggagtgcagtggtgcaatcttggctcactgcaacctccatctcccaggttcaagtgattctgctgactcagcctccccagtaactgggattacaggtgtgtgccaccatgcctggctaatttttgtatttttagtagagacggggtttctccatgttggccaggctggtttcaaactcctgacctcaggtgatctgcctgccttggcttcccaaagtgctgggattacaagcgtgagccaccgcgtccagccaccttcatttttaaagagtattttttgtcagatataaaatagtttcttgggtctgccagtcatggtggcttatgcctgtaatcccaacactttgggaggctgaggcgggcagatcgcttgaggtctggagctggagaccagcctggccaatatggttaaagccctgtctctactagaaaaacaagaattagctgggtgtgatggtgcacacctgtaatcccagctactcgggaggctgaggcaggagattctcttgaatccagtaagcagaggttgcagtgagctgagatcgtgccgctgcactccagcctgggtgacagagcaagactctatctcaaaagagaaataaaataaataaaatgaaatagtttgttggtggtttgggttctggttttttctctctctggactgactgtttctgagacaggcgatctccagtaattcatatatatttttttaacctatatacaattaatctttttctcttcaccatttaagattttccttttctaattttgatttcagaaactctcttacgcttactggtgttctttgggtttatcctgcatggagtttgtagagtttcttgaatttttaggtttatagcttttatgaagtttggaacattttgccactgtttcttcaaatacaccctttccctctttctgggaaatgtatgtttggttgcttaattttgtttcataggttgccgagggtttactaactttttttttcaatctttctgtgtatttctgtttggtttgtttctgtgactatatctttaaattcactgatctttttctttcactgtgtctaatctattgttcagccaatcaagtgaattttttccatttcacatactttaagcttcagaattcgatttgattctttatgttttctgttcctctctgtattgtattcatatttttctttaaatccttggacatgctgataatagatgttctagtctgcttcttccattatctcttgtcatttctggttctgtttttatgaagtgatttttcccctgatcatcctgctgctttgcatgtctagtaatttcctattgaattttagacatcatgagctttaactggattttgttgtcttatttaagtttgggcaggcagttaagttacttgcaggtcagtttgatcatcctgagacttgtttgtagctttttggagtggatatgggcaagccttgaagatgagtttagccctccactcaggtgggacacttccagtgtctttactcttcaacaagtccttgctcttcaacaagtgtgtcctctctggctggttgcagttggaaagtcctccagccctcaaactgtgggaggttttcagctcagactttcctttctattcttgcctggccttaggagtttcaccctgtgcataggcactttagctcttggcaaaagatcgcctctctgcagatttctgtagctcttgtccctccttttcacactctgccttgcaaattccaattgctgcagccacccaatcttgtgatgtgtgtccttcaatggacagggagaccatcacactccgcttgggtttttttcttcattgtgatgcaatccagagagttcttcctgccaggaagggtaacatagagctcatctcatttgcttcccttccttcagggaagtcttgttccaccagttgtccagcgtctgtaaatagttgtttcattgactttgcctagttttctagttgtttatgaccagagcacaagttgagtatcagtagatctgtcatggccagaagcagagactccaagttctgttaattttgatttttggttttcatggaaatggctggaaaaaataacttacaaagataaatagattcaaaccaaagaaacacattattggctatctttacaaaaataggattcatatttatgaaatctaggtataggttgagtgtcttttatccaaaatgcttggaatcagagtgttttggatttgggatttttgaattagggatattcagcttgtactaattatgagaaggtatttgttgaaactcagctagtcaattttcattttccatgataccgtttttttttttgtttttttgttttgttttgttttttttgagatggagtctcgctctgtcacccaggctggagtgcagtggcgcaatctcagctcactgcaagctccacctcccaggttcatgccattctcctgcctcagcctcccgagtagctgggactacaggagcccgccaccacgcccagctaatatttctgtattttcagtagaaacaaggtttcactgtgttagccaggacggtctcgatctcctgacctcatgatccaccacctcagcctcccaaagtgctgggattacaggcgtgagccaccgcaccccgcctctttttttttttttttcctagcttttcagaagatcctgcatttcttatattaattaacaaacgatttgaaacttcttttggcaaatgtttactcagatttgagttggtaaataatagtagataacatttattgagtgttaactctgtgtatggcaattttcttaagttaatcctcacggcagcaccatgacatatgcacagttagtatgcccaatttatgcatgaagaaactaaggcacagaggggttaagtaacttgtccaagattgcacaaccaataaatgagagagctgagacttgaacacatgcagcctggctcatactgcagaccattacactacactccctcttgtgtgatataaggcattgaaccatttttgtaaaaggtgctgtctttgcccatcagtatatagatgatggaaacatttccaaatattcacttttagaatgctgtcactgtagcataaaatagttattttcctcaacaagcattaaagcaccacatttattgcaacaacttagagtatgtgtttattttttcaaaagtatctgtcaagcggcatgttactgatatgatagccatttaccatcacaaaacagggcaggtaatttggatcccttagcttgctttttttttcttttctttttttctctctgttttgaggacagggtctcgctctgttgctgaggctggagtacagtggcatgatcatagttcactgcagcctctaactcctggcctcaagcaatcctcccacctcagcctccctagtaactgggactacaggtgtgttcccaccatgcccagctaattttttatcttttatttgctgagacgaggtcttgctatgctgccccagctggtcttgaactgctggcctcaagtgatcctcccacctcagcctcccaaagcactgggattacaggcacgcaccaccccacccggccaggatcacttagcttttctaaagaaaattatatagctcatctttaagcttaaaactcttacatgcttttgccaagagaaaaccaacaaaccattgtgtgggttgaagtactacagttttggtttggtttggtttggtttgaaatggagtcttgctctatcacccaggctggagtgtagtggtgtgacctcggctcactgcaacctccacctcccaggctcaagcaattctcctgcctcagcctcccaaatagctgggactacaggtacgtgccactacacccagctaatttttgtatttttcctggggacagagtttcaccgtattggccaggctggtctcaaactcctgacctcaggtgatccacctgccttggcctcccaaagtgctgggattacaggcgtgcgccatgccgtccatctctggccacttcttgacaggaaaagaattgcatccaaaatctgaccattggctcatttcagacattgtactttcagctctagcatttagtttgcttctttttatatcttctttttctctcctccttgcactcctatttttcttaaaatccttgtgcacaggctccctctcccagatctcttttcccttcctgttctgcctctccttccctgggaccacactggcttctcactatgccttgaccatgccctgttcacagctaccacgggacctttcactgggcgctgcctctgactggggtgaatccttgcgctgcctggcattaccatccagatcttcatccccactcacttcttcagaggccttccctgtccccttgtctctaggacccatttccctcactccctgtgcctctcctctccatgctcagcagcgcaaacgctcctcactcacagtggggctgtgccccagtcaacccatcacaagtggaaaatatcataagtcaaaaatatattcaatacccctaacctaccaaacatcataagttgaaaatatcatgagtcaaaaatgcatttaggccgggtgtggtggctcatgcctgtaatcccagcgcttggggaggccaaggtgagcagattgcttgaggccgggggttgaagaccagcctgggcaatggggtgtgaatccctatctatactaaaaatacaaaattatcctggcatggtcgtgtgcgcctgcaatctcagatacttgggaggctgaggcaggagaattgcttgaacacgggaggcagaggatgtagtgagccaagatagcgccactgcactcccgtctgggtgacacagtgagactccgtctcaaaaaaaaaaaaaaaaaaaagaaagaaagaaaagaaaaaaagagctccttttcccggtttctccaggagcgctcttccactcatctggtctcctgccttgcgtttgtcatttacatgcatggcttatctctgctatgaggctgagcctttcccagagcagctagttggttccgttgcttaggaaatatttgttaaattagtactgaaagagattttctttggctgctggttaagaaaacagaagcttttttttttttttttctgagacagggtctcactctgtccctcaggctggagtgagaccctatctctttaaaaaaaaaaaaaaaaaaagaaagtcatagctctctgcaacctccacctcccaggctcaagcaatcctcctaccttagcctcccaaggagctgggactacaggcatgcaccaccatgcccggctaatttttgtattttttccagagacagggtctcacttatgttgtccaggctggcctcaaactcctgggctcaaacaatgttccctcctcggcctcccaaagtgctgagattacaggtgtgagccactgtgcctggccagtaagcagaaatcatactgagaatttttcaaagtcgtttgcctggcgggcttctttcctttttctttccctccctgggtgagatgcatccaccccatacattgcagagcgggctccgccagcctctgactgtaatggctggaattaacgagataatattgcgtgcacttaggaaaaggtgctgaatatgtacagtattgttgtttgtaataattatgttccttgagccctgtgttgcataacaagctatataatacctccaagattgctttaggaattaagtatcagatgattgtaaaacactttacaagattgtcgcattgggtgggcggagctggcaggaaagcgtgttgaatcggaggaggaggaggctgggaagacaggggttaccggattttgtgtgttcctgttttatatatgggtgtgtcctcttcgcctcctccagacaattccctaattgagctgctaagatcggaggcatctgacgttcgcataagacctgacaatccttgtgtggggtttaaatggcattggaaatcattaacaagacaaaaagctattatttccgtagattaacacacaggttgggttttggcacgccaaaattcattgttttggtctttagcccaaacatgctagagtcattatattgtcatgcagtaattagctgttcctttaatacaagtaataaaaattaagcctaagaagttctttagcaatgcctcttacatatcccaaaacaatattcaaatgctgtaggcatttagccattcaactgtgctgtagtaaagtttggagtttaatgcacagagatgtttgaacatttagctcatcctttagtctgtgaccagctttgctacataggcattaacctttaatagtgtcagactaaatatacatgccatgatgaatgattatgagattgcctgaattttcatttacagtataaggctctgaaaattggtgtaaaggtctggttcctcctcacttgataatgtgcgtgtcattttcatatgtcaccggattccttgcttaaccgcatgggagaagctattttttaattcgaagcagatacagtggggtcctggccttttgaaaagaatgaactggaaatgttgacagaacttttagggagggcaggcagtatactaggtgtgttctttaaagatataatttgctggcacttgtgctagaaagcctacgtgagcaactcttaatagaattttatacgtgatcaaaggttcctctctttacctcctcttccctgacctctatgtcaagtttaaatcgtggttctgtacaaaggaggctgtgaacgggctgttcactttcttgaaaccatttgcccagcacaaggtcgtgaaggtggggaagaggggcaggctgagaaggtgaaggtatccagagaagttatggaaattttttttacaaacagcacctggaatcttttcaggaattctgtttttttgtgttatcacgactcctgcttacaaagaaccatctccccaagatagcatttttttttttttccaagacaggatttcgctctgttgccccggctggagtgcagtggctcaatcacagctcaatgcaacctcgacctcaagggctcaaggacttctcatgccttaagccccccagtagctgggactacaggggtatgccaccatgcctggctagttttttggtttgtgtttttgttttgtagagacaggctttcaccatgttgcccaggctggtctcgaactcctgagctcaagcaatccggccaccctcggcctcccaaagtgctgggattacaggcatgagccactgcagccggcctccaaaatagcttttggagtcaaatttaacataaatattttgatgctgattaaaataataatgaaaagccatgcaccagaaagagatgcaattataggctgtgtatacgtgcagagtaagtgcccagcagccagggattctgcatgatggactgtgttgctgtgaaaccccagcacccgggatctgctgacgttgagcccaacatatcccagcgcctgccttttgtaaactctgcaaagacgctggcatcctaaagagtccctggctcctgctggatacgttaaccgaggcatggtagacctggccctcgattccaggaacctagggtggtctgaaaaattaatgactctggcatttgaaaattaagtgagctcttgaatatatactcttgttgatccgctgggcatggtgtttggcattcttcgactggagactaaatctctgcagccatctcacaagtgacactggcgcccataccagaaatatattcaataatctttctaagccctgtggacttgggtattcttccactctgacggagcctgagaattccaaaggaagtatgccccaggtacccagcaggcggaatataattgcctcttaggcagcagaaagaaaactaaagatcacattgatgcggaagaacatttaaggtctctctatcctgtgttgaattcacagtaaaggcgagagccgtgagtttgtactgtaaattccaggtctgtgacttctgactttggattaaaatccagttttctggaagtgaatctgatggcagatatgaccttgaattggctgcaagaccccagcgctggcctggctgccgtgcagcgcgcgctgctctgcacttagttatcatcaggagtgtggtggcctcctggccagctggtctacgacagggccatgccgggtcaccagctgtgcctctgcaggggtctccagccttgggacctgcggccgctaacccctgactcttctgaacacccttcattagtgaaggaggatcgtaatggaaagtggtcatgtcatgaaatggggtggctttataaagcctaagtgtttctttcctctgcttcacctctgcttcattctttaccttgttgtaaagaatggtcactcagggctgggtggggtggctcacgcctgtaatcctttgggaggctgaggcggtcagatcccttgagtccagtttgagactggcctaggcaacataggaagaccctatctttaccaaaaaatacaaaaattagcccagcgtgcttgtgcatgcctgtagtcccagctacttgggaggctgaggtgggaggattgcttgagcccaggaggtggaggctgcagtgagccatgatcatgccactgcactccagcctgggcgacagagtgagaccctgtcttaaacaaacaaacaaacaaaaaagcatgatcacttggagttaacagacttaggtgtgcattctccatgccaaccaactagctgggtgacctcaggtgagtcattctgcttccctgggctttagtttctgaggcctctttctcgagattgttgtaaggctcaaaagacacaatctccataaagtgtcccgtgaactgtgtggcgttctcaggcatcaggtgtcacttccagcctcataatcactggacccttaaacatcccggcacctgtccacggacttgtccgtcctccacgtgcagctccggggatgtgattgacctcctggggctgctacctggtgtatttctctacttatctgatcaaagaatgaaaatcatgaaagtgtcacaccaggcaggagtaatcggcaaataccagtgaatctcatggctattgccaccccattttcacacctcgaggaccccgggctgggtccatcctttgtaaagcactggagaattctcccacccagcaagggggctggctgcaggggcatgactgtggcctctggggagcccccggagctgatgtcccaggagccccactctgagcctgtgtaccgccgtggagggggcctgtttgctggccgagtggggtgatggctgttttcctgttgtgcagatcccgtaccagctttggatctcggacagcaactccagctcaaagtgcagcgcctgcacgatattgaaacagagaaccagaaacttagggaaactctggaagaatacaacaaggaatttgctgaagtgaaaaatcaaggttggtggaaaatgcgttctttgctttttcttttcttcttttttttctcttctttttattttaattggcttttcccatacttttgagaccagctctccttgtaatatacacgtcataaagtcagggtggggcaggaatctgagtcgttaaagagagatgataatcatgctgagctatttcgaagtaaaacttttcctctgcacaacaacgacgtaagattttattgccctctgatgagaccgatcaggattctttgaaaattcttcccgtatcattacgtgattgggtctgcctcttgaaaggcccatgcattgcctccaggcgacacctgtcagagagccagctcatgatcaaagggtcacacacagtaagtcatttaataattgctgtggatacattaaggcttcagacacatcttaaaggctgcatgcttaagccccgctgttgccttgtcagtatcgcctattcattaggaatttaatgaaagaaaacaacctcttggtgtgtttgcccagccgtcaacaagacagagagggcaaaggttgcctggcttttcccgtcagggaagaacaaaggaatctctcctttacctaaaatccagaggcactcaggatccaggagcctgttggcttccttggcttgaaggaaaatcacagctcccgtctgacagcagcagcagcaggcttttcagccagctccaaagaataattcggccagtttgttttggtttgggaatgtgagtacggaattaaattgaaaggggaggctgcccattcctagtggccttccattgaccatttgtagagacttcaataaagagttaattggggccacgtgcggtggttcacacctgtaatcccagcgctttgagaggccaaggtgggaggactgcttgaggccagaagttcgagaccagcctcggaaacgtagcaatactctgtctctacagaacatcagaaattagctgggcatggtggtgcacacccgtggtcccagccactcaagaggctgaggcgggaggatcgcttgaacccaggaggtcaagcctgcagtgagccatgattgtgacactgcactcagtctgagtgacagagcaagatccagtctttaacaacaacagaaaaagttaattggcaaagacttcttttttttttttttgagatggagtctcgctctgtcgcccaggctggagtgcagtgcacgatctcggctcactgcaagctctgcctcccgggttcacgccattctcctgcctcagcctcccgaatagctgggactacaggagcccgccaccacgcccaactaattttttttttttttttttttttttttttttttaagtagagacgggatttcaccgtgttagccaggatggtctcgatctcctgacctcatgatccacccccctcagcctcccaaagtgctgggattacaggcgtgagccaccgcacccagccaattggcaaagactttctaaaagtgtcctttggctttaaaaacactgcagatagaccagggaagaagaattgtccatgggaatgatccagaaagcatctgtgatgatgtgtgaagagccagaggtagaggcatgggctgtgagggcggcggtgcctaagacctccgagcacacctccctgtagtgtgggcatgggggtactcaagccctcaggccagcatagcttccttgctgaaatttgggggcacgaggtgacaggcagctggggaagccagaccccgcttctttctggctttgcagagagtggtgagcctttaggactagaagggacaactctgtcctgctagagagcgaggcattgggcttactagggctggaactgctgtgagggaaggtattaccttcccttgtaggaagcatttcttgccagaatcacgccagtattgcagtaaaaggtaacctgcaaatctgcacattgagttttcatagatacgctaccctaaaggggagtatcctggttttttttttttttccccttcattgtcctctggtatctaattttgatagatccactctctggtttgtttggtgagtgttttttatttatttatttattttagattcagggtctcgccctgtcacccaggctggagtgcagttgcatgatcatagctcactgcaacaaccttgacctcctggactcaagtagtcctcccgcctcagcctcctgagtagctgggactacaggcatgtgtaccaccgtgcccagcctctttctggcttattttatttttttgagtttgcttttgttttgttggagggtggtgcaggtggggcctggtgggctgtgcaggattgtccttcccttctccttctatcactggtgcctaaattaccagcttcccagtggccagggctttgcacaggggctgaccaggagccaagctgggtgtggatgttctctccccaaagatctcatccacactcaggagtggcttttcacaatgagttatagagcccaagatttaagaacagctccaggccaggtgcagcgactcacgcctataatcccagcacttaaggaggccaaggtgggcagatcacttgaggtcatgagttcgagaccagcctggccaacatgacgaaaccccatctgtactaaaaatacaaaaattacaggcatggttgggcacgcctgtaatcccagctactcagaagactgaggtggaagaatgacttgaacctgggaggtggaggttgcagtgagctaagatcacaccactgtactccagtctgggcaacagagcgagactccatctctaaaaaagaatggctctggaggcagacagacagacctggtttgagtccttttattgctaccacctagctatgtgaccttgggcaaattatctcactttgctaaaagcctctttctcttgggaggcaattctgatacttaccaggtagggttggtgtgagcttaaatatgcatatacacacagcatttggcactcaatagtacctgctacttattcagcagtgtggtttttgaaagaaatttaccctcctttatttggataacaagttttcccaagctccagaaaaatgtcatttcctctcccccacttccaagaataaaagtgattataatttgggaaggtgggcggtgcacatcacttcttgtaattatcacaccagtagtgtaaatgattaaaaagttagagcaggggccagcacaatggctcatgcctataatcctagcactttgggagaccaagtcgggaggatctcttgaggccaggagttcgagaccagcctggacaacataacaagacctatctcttaaaaaaagaaaaaaaaaaagatggtgtgagtccattgtgtgttgctgtaaagaaataccttagtctgggtaattgatgaagaaaagaggtttatttgcctcatggttctgcaggctgtatgagcacgatgccagcctctgcccagcttctgagggtcctcaggaagcttttactcatggcagaaggtgaaagaggatcaggcatgccacaggacaagagaggagggggcatcccagacgtcttaaccaaatctcagtgactcatcaccagagagaggccaccaagccattcatgagggattcgcccccatgacccagacacctcccacttggccccacttccaacactggagatcagatttcaacctgagatttggaggagacaaacatctaaactatatcaggtacataataaaagttagagcaaagagggaacttctgcctcatgggccacagccccacccatcccgcaatgatgagtaaatggaggccccaggtaatgccaagccctttagattcctctctgttatgctggccccgtcctcccctacacatgcctgggaggcctgctgagacacccagcatctgcccgggatacagcctgggccagaaggccagaggcgctaggataaagtggcctctggctgaggttgggctggtccgtgagcactcacccgggtccagggggtggcaaagagacctcatcaggcacagcacactgtcgaggtcacacactgtgatgtgtcactgaggagccccactggagcaagcgttagcgtccaagtgctgtacagccacttccagccggtccttaaaggcaaaaatgaggccaggcatggtggctcatgcctgtaatcccagcactttaggaggccgaggtgagcagatcatttgaggtcaggagttcgagaccagcctcgccaacatggtgaaaccccgtctctacttaaaaaatacaagaattagccaggtgtgatggcacacgcctgtaatcccagctcttcgggagactgaggcacgagaattgtgtgaacctgggaggcagaggttgcagtgggccgagattgcgccactgcactccagcctgggtgacagagcgagtatctgtctcaataaaaaaaaaaaaaaagacaaaaatgctgtatgtttacacgagagtgtagaccattgacgtagcagagcagttcaggctttttcagagctgacctgtctggagtccattctggaagtgtccagctcttgcctcactttggcctcgtccgtatggcttgagagagacgtatcaccaaccactgtgtgcacagagcatttcttccaggacctgaacagccaaaccaaaaggcggaaagttgcccagtcccctctgctgtgccctgatgggatcgttggtggaattccacctctctacggaaagcactctgggacacacctcatgaaaaaggccaacctcttaacaaaagagcctttcacacaaaaattagccaggtgtggtgcgcgcctgtaatctcagctactcgggaggctgaggcaggagaattgcttgaacccaggaagcagaggttacagtgagccaagactgcaccactgcatgtcagtctgggccactgagcgagactccgcctcaaaaaaaaaaaaaaaaaaaaaaagcctttagcttgtatgcactaagccgcgtgggtgttaatcgcccaggtgttttgctcctgctctggccagcgcatgtccgtgcagctcagggagcaggaatggatgtgagttacacacctggcaggtgcccttgctgcaccagagggagctccattgccacaagccctgtctgggcttcccccagctctgcccggcctcggctccttcagtcattcatgccacagtgctttcctgagcacacgtctgtttgccagcactgggaacacaaagaaaatgagcctcgcctgctaagaggtagatctgtagcagcgggcgacaattcctaagagctcccctctcttgggggctggggccacagtgcttttccacaaagcatccagcatgcggagtggcataggcgtatctggaggagggcgcacgtggagttgtcctgccccagagccacccacacacaaagcatccagcatgcggagtggcataggcgtatctggaggagggcgcaggtgtagttgtcctgccccagagccacccacaggtctgttccattcatcaaatccgctttgatattccccatttgggcagttgaggtgatgtctgtgaacctgcagttggtggtaccagagccgtctggacctgcgctttcccaagacagccctgcctcccaaggggcccctcgctgccccacatccttggtgctcacacctcactctaggactcctccaggccacatgccagtcaccggagcatcttcccccaggctacggcaccctctgctctgcacacagcccatgaccaccagagtggtgggcactccagggtgggtcccttccagcccactccctccatgctttatccacctagcaccacatgtttcttgtcacttgtgaaccagcagagctgcagggccaggcctgcttgcttgcttccttccttccttttctgtctccctctctttcttttgctctccgtttctctctctctctctctcactcactcactcactcactcactcacactctgtcacccaggttggagtacagtggcgcaatcatagctcactgcagcttcaaactcctgggttcaagacatccttccacctcagcctcccaagtccctaagctgggactgcaggtgtgtgctaccacgtccagctaattcttgccctttttgtagaggcggggctcgctgtgtttctggggttggtgtcaaactgctgggctcaagggatcctctcacgttggcctcctaaagttctgggattacagatgtgagccactgtgcttggcctgtagactttcatctttttttttttttaatttatttgtaatttgtgtgggtacatagtaggtgtctatatttataggctacatgagacgttttgatacaggcatgcaatgtgaaacatcacatcatagagaatggggtaccgtagactttcttgactccacttcgattgcttcttccaaaatgcacacactattatgaactattttttttctgagaaagtacttaaacccacctaaaactttattaatcatccctcagttacaggactaatttaagactcatcaataagatgatatgatattttaccattgatttccatctccccccacccttttttttctttaactggtactacagaaaccaaagctcttcttttcagcaaaatccattgatcctcctcagcctaaacgtttaaagttcaatttaacatttagggagtaaaaggtctctgaagggactcataaccattgattttgtgtcagagttgaagagctaaggtttaaaacacaccgatcctaccaggttatgagagccttgtacctacagccatatggaattgtatgcttctcttactgtaggtttttttttttcttttctgcagaggttacgataaaagcacttaaagagaaaatccgagaatatgaacagacactgaagaaccaagccgaaaccatagctcttgagaaggaacagaagttacagaatgactttgcagaaaaggagaggtgagcatgacttccaggcacacacagactgacatagcatttgcccctgaacttcacatcatcagacatgttgataaatggatctgcaaaataagcccaggttgtaaccccaaatctataaggggtaaaatgtttcaaaaatgatattctggctgggtgtggtggctcacgcctgtaatctcagcactttgggaggccgaggtgggtggatcatgaggtcaggagttcgagaccagcatgaccaacatggtgaaaccccgtctctactaaaaaatacaaaaaaaaattagccaggcatggtggcgcacgtctgtaatcccagctacttaggctgaggcaggagactcacttgaacccgggaggcagaggttgcagtgagccgagatcgcgccactgcactccagcctgggcaacagagtgagactccatctccaaaaaaagatattctacatttgtgaggtttccttgagcgaaatgcatctgtctttcccaatcggtggatggtgtcaggcagccagtgggcccaagactatccaagccgtgcaggtgcagaggtgaagctcaaggcatgagtcgttagcaaggcggcacctggcagctggacctgggctgagaccagagaggaaagcccatttcccagtgtgtgtcctctggggacaagccctgggctagtgctaaactctttctgccttctcaagcaaattgatatttaatattacacacacacacacacacacacacacacacacacacacagactctctgatgtatttaatattacacacacgcgcacacacacaatctcagtgggttttttggtattgcctctttcattacctcacatatcagggagttagtatcagtaaaatatgttaatgccctatgtaactgatgtgagttttagatttctaatgacttacattaccaaaaacgtttcccacaaataatgagttggttttcccctagtgtgatgagttaatgaaagttagattccttgtaacaacaataaggactattgagcttacggatcccaaccatatagatctttttttttttttttttttttttttaagacagagtttcactctcattgcccaggctggagtgcaatggcgcaatctcggctcactgcaacctccgcctcctgggttcaagtgattctcctgcctcagcctcccaagaagctgggattacaggcatgcgccaccacgcctggctgacttttgtatttttagtagagttggggtttcaccatgttggccaggctggtcttgaactcctgacctcaggtgatccacccacctcagcctttcaaagtgctgagattacaggtgtgagccaccacggctggcctagattggatttttttaaactcatgggttaaattaaggtattaagttttatacccgctcccatcaagtaaaagaaaagcaaaaaagggaaaaaaaagatactgaattttaactctagtatgaagaaatgtatgtatccatcaacaggaagcactaaatttatgactacaggtaaggggccaagtgggactgtggctggtgtgggattttgttgttttattttcagttgacttcctatgctgaatacttggtgaacttttcttttttcttttttttttttttttttttttttttgagatggagtctcactctgtcacccaggcttgagtgcagtgtcgcaatcttggctcactgcaacctccgcctcccaggttcaagtgattctcctgcctcagcctcctgagaagctgggactacaggtgtgcacgccaccacgcccagctaatttttgcatttttagtagagacggggtttcactatgtcggccaggatggtctcgatctcttgaccttgtgatctgcccgcctcggcctcccaaagtgctgggattacaggcgtgagccaccgcacccggctcttggtgaatttttctaaggtgggctctgtaacaatatcattgggttaggaggtggggcttagacactggaccaaattgaagactagctaaaacagggcctggagagaagcagctttctataaaacatgcccaccagtgtgccacatcagtttaccattgccttggcaacacccaggagttaccacccctttccacagcaatgatctcacagcccaaaaggtactacccattccctagaaatttctgtataaactgcctcttaatctgagtacagattatgagtacaaaatatgagtacaaaactgtcctcagctgctactggcagcacacggcctatggggcagtcctacctcacgagaccagtcacagagctgtaacgctgccacctccataaagctgccttcttcagccctaccaccagctcgcctttgaattccctcctggctgaagcccagagcccttgccagctaagccctcctttggggctcgcctgccctgcagcatcatgaaggcctctgaggaatgccattaagctgacttcattcaaaaagaaaactggctgggcacagtggctcacatctgtaatcccagcactttgagaggctgaggcaggaggatcccttgaactcaggagttcgagaccagcctgggcaatatagagatatgccatctctatggcatgaatgaatgtatgaatgcgccatgcatgtcagcatgtgcctatagtctcagctacttgggaggctgaggcaggaggattacttgaggtcaggagttccaggctgcagtgagctatgatcaggccactgcaatccaacatgggtaacagagcaagaccttgtctcaaaaaagaaaagaaaagaaaagaggctgggcgcagtggctcacacctgtaatcccagcactttgggagggtgaggtgggtggatcacttgaggtcaggagttcaagaccagcctgaccaagatggtgaaaccccatctctactgaaaaaatacaaaataagccaggcgtggtggcacatgcctgtaatcccagctactcgggaggctgaggcaggagaattgcttgaacccaggaagcaaaggtttgcagtaagccgagatcacaccattgcattctagcctgggcaacaagagcaaaactctgtctccaaataaaaaataaataaaagaaaagagaactgccagctcccgcccacccggggccctccctgcatcagaacttggccgtaggctttcagtacattctctcactaattgcccagaatggatctgcaatgtagaccatctcttttcatagagggagaaagcaggtcgtgggtgaggtacctcctacagcttttgcggctaatcagggccagaggtgggactttgcaactccagactggcacctgcccatctctgcagcccttgcctccccgtctgctccattgtggccacctggagccctggttgccggaccaaggccagtcccttggggccacgcccaactctgcaggtggaggccgcatccatcgtccctgggggagcgcggcagggcacagactccaggaaaggagtgcgcatcacagagtcaaggctcggacagatgggcagacccttgaccccgttgatacggatttggtcctaagtaaatgccttttaggaaagcactcctcaccagtgagtgatcaagggggaaaacgcgagcaatctcagtgccctgccatggagaaatgggttagtaaaaagaacggaccatccctaactgggatgttatgtcaccgttaaaatattaataatagttatggagaattcatagtaacatgagaaacgtacctaatataatatgaagtcaaaacatgcaccgtacaaaattatttacagtgcagtatgattgtacatcttcctacagcaaactcatgcattaccacaatgtggaaataaacacatatgggaattaaatattattaagttgacttttcttgttttttgagacagagtcttgctctgtcacccaggctggaatgcagtctcacaatctcagctcactgcaaccctccgctccaggttgaagtgattctcctgcttcagcctcctgagtagctgggattacaggtgtgtgccaccaagcctggctaatttttcagtagagataggttttctccatgttgctcaggctggtttcaaactcctgacttcaggttatctgcccgcctcacctcctgatgtgctaggattacagacataagtcactgtgcccagctcttgacttttcaaattaggtaaagggattagctatattaaaatatacaataactgattcttagagggaagggctgaagctagaatttacttcattcattttgtgtgtgtgtgtgtgtgtgtgtgtgtgtgtgtgttttgagacaaagtctctctgtcacctaggctgcagtgcagtgacacgatctcagctcactgcaacctccacctcctgggttcaagcaattctcctgcttcagcctcccaaatagctggggttacaggtgcccaacatcacacccagctaatttttatatttttagtagaacaggatttcaccatgttggccatgctggtcttgaactcctgaccacaagtgacctgcccaccttagcttcccaaactgctgggattacaggcgtcattctttataacaaaaaattgttgatggatctaggatttaaatattataattttttgtcacaaacatactggaagaaaactggggtgcatatttgtttttattaatatgactatataaaacttaaaacagattctcaaaaacaaataataacattttaaaaacatcaacaaactgaagaaatatttgtaccatgtaagacaaaaggctaattttctttatatacaaagaggacttctaaattaataagaacaaaatccgctctacaaaaataggcaaaggagataagtaggcatgtcatacaaagagaaataacatagctttactcagcagtaaaaatttaaatttgattttatcttgtgttggcagagtatacgaaaacacacttacatattgttggtgggagtttaaattggtgaaagttttttgttgggaagtttttcactatctatcaaaacaagaaaagtggccaggcgaggtggctcatgcctgcaatttcagcactttgggaggctaaggcaggcggatcacttgaggccaggagttcgagaccagcctggccaacatggtgaaaccccatctctactaaaaatacaaaaaacagccagacttggtggtgcacacctgtaattccagcttcttgggaggctaaggtatgagaattgctcgaaccctggagcagatgttgcagtcagccgagatcatgccattgctctccagcctgggtgacagaacaagaccctgtctccaaaaaaaaaaaaagaaaaaagaaaaaattgcagatactctttggccattgtaattcctctgttagcatttcatctccaacagattcactctcaaaattatacagcagtatctccacaatgatcgttgagggactgttcagtagaaagaaacctagaaacaatctgagtgtccacagaggcttaagttaattatttaataagaatgagggagaactatgtttgctggaatagaacatttccaaaatacagagaaaagtgaataagggaccccagaatgtggtgcacgttgtgatcacctttgtattaaaagaacagggcagggagattatattatactatactatattaaacacttctatttcagtagcctatttcatattcatattacactatagtatattacattacttcattattacactatagtatcctgcatattagttcgtactatgctatagtatatttcattcatattttgctatactatgtgacatattaatttatattgtgctatagtgtgttacatattcacattatgttatagcatgttacatattagttcatattaagccgtagtatattacattagttcacattccactataatgttacatattaattcatattatgctatagcatgttacatattagtttgtattacactatagcttgttacgtgttagttcatgttacgctctagtgtgttacgcattcgttcatattacgctgtagtgtgttatgtattagttcatattaccctataacgtgttacatagtagtttatgttacactatagtgtgttacgtattagttcatattatgctatagcttattacatattagttcatagtacactatcatttgttatgcattaatttctattatgctatagtgtgttatgtgtttgcttatattacactataggctgttacatatcatatgttacatattcatattttgctatagtatgttacatatttgtttatattacactttagactgttacatatgatgtcgtatttctgtacatgcagaaacattttagaaaaatacaaatgaactccatctgaggagcggaaatgagccaaggaatagtaagactctttcacttcccatgctcttgtcatatttgattacatccctgagtgtccataattgaaatacatgaaaatattaacagtgcttttctagaggtgatgagaattgggttgactttgtaaactgtgtcatttctacttttctgtatcccagtttattattatgagagcatatgttaaattcatatgatataaaaataatcaacttatttttggaggggtttttttttttcccccagattaagaggaaggaatgctatttattgaccagggaattcacttagagatcctgggaaatctgaatctgtggaatgcagttgcgagcattcacaatgtccccattaggtattgcagttgcgtttgcattccattataacagagacggaacagctgccacatctatttagtgcatcctttattccaacaaactccttcattgtgtcagcagaatgtaaatggatcattcttcttgcgctaacttcagaaaacaatgagtgcatgatgatgatttttttttttctttttaaaatctggcatttcaagaacaaattacatttaggataaccttctacgccagttaccacccatcaagccccacgggttgcacacttgccgtgatgtgacacgcagttacaaagttggggtgtggaagctgcgggagcggggcccacggcacacgtgtcgttgcgggcgataccccgtggtgcgcctgccgccagctgagcgcagggagggagctgagctcagccgaaaggcacacgtgcatttcagttggtaaaggagatgaccaatttggcttcgtcctcttcctttgcagaaagctgcaggagacacagatgtccaccacctcaaagctggaggaagctgagcataaggttcagagcctacaaacaggtttgatactctccttcctagtaccatggatgtggggaggacccagggggagagttgggtcagcccctgaccgccccggtccccgcggatacctgttgctcttcggggccgtgggagctgccgggagcccacgctgaagaattccgcagcacgcccgccagctgctgcgcctcattcctcactgactttgagttgttaatgtagaggtgggaggatctcgattccattttcatcccttccacacgccatccttgcttcctgctctttttccaacaaacacttctaaatcaccaaactgtcaaggactgacatttcatttggaacaataatagaaaaaaaaaaaaaaactcacttctaccctaagtgaagttaaggagaacagtaatttcagacctttaaaatttaaaagccaccaaaaaaggttatgctcaagtttttacagtatctttaaacttctttctctctctctttttttttttttttttgagacggagtctcgctctgtcacccaggctggagtgcagtggcacgatcttgactcactgcaagctccgcctcctgggttaatgccattctcctgcctcagcctcccgagtagctggggctacaggcgcccaccaccatgcctggctgattttttgtatttttagtagagacgaggtttcatcatgttagccaggatggtctcgatctcttgacctcatgatccgcccacctcaggctcccaaagtgctgggattacaggcgtgagccaccgcgcccagccctctctctatttctttttttgttttgttttgtttttgttttttttttgagacagggtcttgctctgtcacccaggctggggtgcagtggtgtgatctcaggtcactgaaacctttacctctgtgggctcaagcaatcctcccacctcagcctccccagtaggtcggattacagatgcccgccataatacccgcctaatttttgtgtttttagtagagatgaggtttcaccacattggccagtccggtctgtatctcctgagctcaagtgagccaccacacccagcctctcttttttatttctgaaagagaagcatcaccatgtatttcatttaaatgtatttttaaatttttattattttttttgatgacccagaactgagcagattatttaaatgtagacagacatcagaagtcataattcaacttaaaacacaaatgacgagagtgggagaaaataatcaccacaaatttgacaaacggataattaaaaaatgtaaaggctgtaaatcaatccattaaaggagagaaacagtgcagtcgaacaataagcaagggatatgaacagtcagttcacagaagaaatgcaaatggaaactacacatatgaaaaaatgcaaagttttttttacagtcagggagatgcagattcaattagtgaaagactgttttgcctgtcagactgacagcattttttaattatttatttatttatttttgagacggagtcttgctctgttgcccaggctggagtgaagtggcacaatctcggctcactgcaacctctgctccccgggttcaagtgattcttctgccccaggttcaagtgattttcctgcctcagcctcccgagtagctggcgttacaggcgcatgccaccatgcccggttaatttttgtatttttacgaggtttcgccatgttggccaagctggtctcgaactcctgacctcaagtgatccacctgcctcagcctccgaaagtgctaggattacaggcatgagccactgcacccagcctaattttttatttcattttagagacatggtctctctctgtcgctcaggttggagagcagtgatacaatcatagctcattgcagcctcaaactcctgggctgaagtgatcctcctgcctcagcctcccaagtagctgggactgcaggcaaacaccaccacacatggctactttttttttcattatttcttttatggacatggagtctcactgtgttgcccaggctggtcttgaagttctggcctccagtgatcctcccacctcagtgtcccaaaatgctgggggattacaggtgtgggctaccgcacctggcctttaaaaaaaatatagcaattctggcctgacaaagacttgtcaaaaattattgaaacatccagtgttggtgacggtgaagtggcacttatggaatggatgggcatggaaggagcctcttgggaggccagctgggtggcatttatgtaaagctccagtgcccaagctgttcagccagcagcttcacttccaggtatcctgatgagagaactgaaggttattgccactgcctgggtccacatgtggaaggactcccataccatactgcccagggaaaaaggctagtctcaagaaatattcataccgtcccatttatgggggtagaaaataaaaaaagatatatacacacacatatatacatgcaattatgtatggaaaattttttcttaacgtaaaatacactttcttttattttgttacacttttttgaaatgagtctcgctctgtcacccaggcctggagtgcagtggcatgatctcggctcactgcaacctgcatctccagggttcaagtgattctcctgccttatcctcccaagtagccgggattacaggctatgcgccaccatgcttggctaatttttgtatttttagtagagacagagtttcgccattttggccaggctggtctcaaactcctgacctcaggtgatctgcccgtgtcagcctcccaaagtgtgagccacctcgcccaaccagaaataataaaatacaccttaaaacatgaaatcatccaggtacagtggcccacacctgtaatcccagccctttgggaggccaaggtgggaggatgacttcaggccaggagttccagaccagcctgggcgacatagcaaaaccctgtctctacaacagtgttttaaaatattagccaagcgtagtggcttgcacctgtagtcccagctacttgggaggctgaggcaagaggatggcttgagcccaggagttaaaggttgcagtaagctgtgattgtgccattatactccagcctgggtgacagagtgagaaaacttgtctcttaaaaatggaagggaaagaaagaaagaaggaagggagagtgggaaagaagaaaggaagggagggagggagggaggaaactattaacattggttctgtctttgtaggtgcttgggattagatgaggcagaaatgaagggggatttcctattccattttttgtattttcatcatcttggcctcttttgtgtgtttttaatctttatttttccacgcacctcgctcctcacagaaatctttgcctcttttgaaatgggaatagattacctgtgtatgcattcttttaaaatttcatttaaatagttagtaattctttgcctttcagccctggaaaaaactcgaacagaattatttgacctgaaaaccaaatacgatgaagaaactactgcaaagtaagtctctctgcttggcctcccttatccgtacacatttctcacctgattttgcttgagtagggcaggatcgagaaggttcttgacctctgtgctgctgcagggacacagtgtatttcccatgagttacttgcgtcggttcaatgcacgttctagcactcactgggtaatccttccaacaaacttctttccttctttattgtgaaggctggtcactgctatgccttctgccatgaaaatttgggagttagtttatataagatgtgacacatgggacattttttgtgtggagttgagtctgggtaaatcacatgtctttttcgctgggccacagttcttcatttctcccagggccctttaggaaggcctgccccagaataagcacattcccacgcaggcataggggttcatgtcacacctaacaacgctaggtgtggatatacggatagacacagattcgggcaggcagagtcacaaaaggccaattcctacccagctcttgtccaaaggaaattagaggtgtccactacaagtgtactttttacccgcccatctttcatgcagaacaccagcaaggaagaaataataattgacataaatcatgaaaagatgaagaaatggcagaaattgctcctagccattgcctcctctaccaaactcccggggagcaatgccaggctagagtttgaaccactttttcctgttctggaaggctcttcccatcttccgcggaaacacacacgcgtgcttactgccatgtctcttgggtttccctattccagttacaaaggtccccgcactctgctcacacagtgcctccgtgggcatcggcaagaagacgggtacttctgaatggcgccgctgtcccaccaggctccacctctgtatggggtgccggcacttactgtccctctgccccatctcacgtgaccttgggctttgagggtgctgctgggtctgttgctttcaggatgctgtgtggggttcttggccctttgctctgggtcatttagtagcctgagacctcgagagcccagcttcgtagcctggtggtcagaatggattctgatcatgagtatgaaacttacaaagactaaaacatcaccactagatcagctactctcttctctcaattactgcttggacctgattaagcaacttacttacttgcactaagtaggttgtttttctcagtaaatctgatttttaaaacttactatatttcaccgagcatggcagtgtgcacctgtagtcccagctacttgggagcctgaggtgggaggatcacgtgaacccaggagttgaggctgcagtgagctgtgatcgtaccagtgcactccagcctgggcaacagagcaagaccctgcccctaaaaaaatttttaaaatattgttttagttttaaaaaacatgtcaggggctgattgtccttcacataaaaattagccctgtctcaggactgtagctgagagggcagtggctctcttggggtgcgccccacctgccctctgaagtaagaaacattcttgtctccccagtggtgagccaggccgaggggtgtggtgtgcatgaagggagagagactcactcggttagatgataggcatggctcagagataatagattcattcattgattcaacagacattcacagaggcttcctctgtgcctcgccctgtgcaaattctgagactgttacggctccatggggagacaggccattgcaatccagcatgcccagtgctgcaatcaaggggacagggcgctgacggtcagcaggtcagacagggagcctgcaggtggcaggcagggcactcccattgggatagtcagaagaaagtttggcagggtgcagtgactcacgcctgtaatcccagcactttgggaggccgaggcaggtggatcacctgaggtcaggtgttcgagaccagcctggccaacatggcaaaaccccatctctactaaaaatataaaaatcagctgggcatggtggcgtgcgcctgtaaccccagctactgaggtggctgaggcaggagaatcgcttgaactctggaggcagagattgcaatgagccgagatagcaccactgcaccccagcctgggctacagagccagactccatcgcaaaaaaaaaaaaaaaaaaaaaaggtcaatattgggcctatttgcagaggtgcagttcctaggctcatagtaccggcagggtttccacgcctgggtttgaatgagccagagcggggaaaggtagctagagactgaaggtgagggccccctcgaggggagccgtggccttggggagggaagagggacccagggcagcgccagggaccccttaactgatcccctctctcctcccaccagccaggggagctggggaagggcatagtacatccctagcatcaggggagcgcagggaaagaattgtcgaggaagccttcctaaagagggtggtatgggattcgggattggaagatgagtcaagtcaggttttgcagaggtttgtgaagatgcaagcctggcgaagcctgtcttggggaggacctgccagaggttccgaacgatttgcctgtggggtaggatggggcagcctggtggggcatttcccacatcagaaacggtctggacactgacaaaggcagcctaggaccaaccacgtaatgtaatagttcccagagtaagtcatcccccaaaaatgcagagaatggcctgagagaattggatcttggctactttcttttaactttggaggccatgggctcattctgagacctcccccactgcctttgcctccccttttattttccaggacagatttgtcactattccgtctgcttcaagtccaacctacatgtattttattagaccagacacgttttcattcatgtttgtgaatataagccccttggggcaaatcttttcacatatggtcttacagcatttcaaaaacaatttattttccctcttctgaaggagggattcttagggccaggcgcggtggctcacacctgtaatcccagcactttgggagcctgaggcgggcggctcacttgagcccaggagttcaagaccagcctgggcaacatggcaaaagcctgtctctacaaaaaatacaaaaattatcctggcatggtagctcctaactgtagtcctggatacttatgagtctgaagtgggaggatcgcttgagcccaggaggtcgaggctgcagtgagcctaattataccactgcactgcgacctgggtgacagagcaagaccctgtctaaaaaaaaagggattcttaaatatttgttgacgggaattggagaggcatgaaggaagatgggttttggagaaagactgacttgggattgattcactagggtccactacgagctctctgcgtgaccctgaatgagctatgagctgtccacctccctttctgacctgtacaatgggcataccggaagtcaagtcactgggtggtttttgttgttgttgttgttgttgttttgttttgagatggaatcttgctctgtcgtctaggctggagtgcagtggcacgatcttggctcactacaacctccacctcctgggttcaagcgattctcctgcctcagcctaccaagtagctgggattacaggcgtgcgccaccacatccagctaatttttgtatttttagtagagacggggtttcaccatgttagccaggatggtcttgatctcctgacctcatgattcgcccacctcagcctcccaaagtgctgggattacaggcgtgagccactgcacccagcatgctaggtggttttgaagaggcaggaatgggatgtgtgtgtatagcacctggcatggtgagagtctgaggctaagctgtcgagagatagaagctattcccagcaagctcagagcagggcgtggtatgcgtttctgaaattaacggccttggaggaaattgactttcaccgcatcaccacgacggactgggcccacattgtctgtctgtcgtggggagatgtcacagggtacccatccctctcccgttttggagagaagcccgcaggtctgtggtactgaggctgctccgagaccccggtttatcgtgagcagtcatcgccatgcgtcagctgggacagcacgggctgactgtggcagacaacggcagtaaagttttccatgtgtaggcttgaagcaaaatgtaattagcctttatgtgcagaacaagggcccattgatgaatacagctggtctttgttttgtcctgtcgttgagagtgggaggtaaaagtgttcttcttcatgtttattaatgcaagattccttagacaaatggcaagcacagtttaatatttgttggaacatgggggctttgccaaaacagttgttgtgtaagaggattgcaaggtttccgattataaccatttctgggttaaataaatgaattatttctgccctttttttcttttttgaaatttttttagagtcagggtctcactgtgttgcccagagtggtctcaaactcctggcctcaggtgatcctcccgtcttagcctctcaaagtgctgggattacaggcatgagccactacgcctgacattcttttttctttagttaaaaacatagctccttctcagatggtcaccctgtgtacggatcttcccgcttctcttagcaaatggagatttaccaccctaatagccttaaccttggagactctagcaaaggaacgtgctgtggattttaacatctaaacaattccttgggatggatggccgtggaggtggcagatccctggaatcacgcagcagtaggcagcccagagagaggcctgggcatccctcactgccccaagttcctgcatccgtctcctgcagctgttcacttacttgatcttgggtttgggttgctactgcaccctccagcaggaatgtcgccctcccagccaagcggctagtgttctgggcaaaaatgcaggaattcccatttttgctgaagtccacgatcctatgccctgtccccaagaatctggattggaaaaggagttccagctgcaatacacacagtcagcttcttgcattcctccccactcgtgggccgaggcactgagcctcgatgaaagaaaatattgaatcgcactgaaatactacattttttatagctaatgttagtcttaggagaatttgcacctcccaaacctttcctgccagtaaaattcgtatttcttaaggttactcatgttgtattcctagcctatatgcttttttcaaagaacgacattgtgtatacacatacttacatagtacggttacaaaagagacatttacgaggaacttcacttaggttaattttagagtattttctttataacatgtatataaccagtactttatcacaaaatacaacgtgctctgaaacagcagaaaactttcccgtagctaactcagcactggggagcctctacgcttctttggagggatagagaactccagatcccaaaggaggacataagacagaatttgaaaaggggaggaggctgggcatggtggctcacgcctatcatcccagcactctgggagactgaggtgggaggatcacttgagcccaagagtttgagaccagcctgggcaacatagtgagaccccacctctaccaaaaaatacaaaaattatctgggcatggtgttgtgcctttagttccatttacttgggaggctgagttggaaggttcgcttgagcctggaagttccagcctgtagtaagctatgattgcatcactgtactccagcctgagtgacaaaacgagagcccatctctaaaaataataataataatttttaaaaggaggggaggaggataccagcagttcaagacacaagtctgcatggcaaatgtgggtgggatggatactttctttttattttattttttatttttttgagatagggtctctgttagttattcaggctggagtgcagtggtgcgatcatggctcactgcaacctccacctcccgggttcaagtgattcttctgcctcagctgctggaggagctgggattacaggcttgtgccaccatgcctggctaatttttgctttttggttttttttttttttggagactgagtctcgctctattgcccaggctggagtgcagtggcacgatcttggctcacggcatcctccgcctcccgggttcaagcgattctcctgcctcagtctcccaagtaactggaattgcaggcatctgccaccacacccagctaatttttgtatttttagtagagacgaggtttcaccatgttggccaggctggtctcgaactcccagactcaagtgatctgcccgccttggcctcctgaagtgctgggatgacaggtgtgagcagctgggatggatactttgtttacatactgttctggactatttcacaatgatttcctgagtgttatcttgtttgccctttcctgaagtcactggggcagcttttattgtgctcattgcatggatgaggaagcagtcccaggaacacgcagattcaggccctggacctggtcctttaggctcaaattccagtgctttttgcttgagaccacggcggtcttcaaagcccctttctggtgccagctttgtaatcaagcagcaaaggtgagggctagtcaggtgaaggcaggcgttcctggggggttcagcctttcccagcctcacaagcccccgttgtatttaccatagcagattgatttttccctttttgaacaataattcctcatgaaagactcacagaactggggccaggtagagcccggttgagtaaacctgagaatcacccagctgtcttgaccatcatatttagacaaatattgcatcccctgattgaatttgaaagggacaacttaagcatcctgaaaacagagtctgtctgctgtacctttaagaatgtaaaattttctatttcctgtctttttgatgagtcatcagtttccagtacgagttgctgtaattaccctggttggattaatttccctaaaaatagagaagcagccacttttatggttttcagagtatggacttgaataaagaacctcctgtcctttaaaccttagagagcactaaatcagacttgcagggaaaaaccgatggccttttttttttttcttcctgtgtcttatctccaaaaggggcttgtggattttgtagaattcttgggatttttcatctctgtacaagtattttgctccacacctaaaaattgatgcctgggtgagccctgaaggattttccttgtcttttgtagtaacaccagctgtcttggccccctctgaatagtacaaccatgacctggtgtctccccaggttgggggctagacaaaaacaagggggtggcttcatagttccaagtccaggtagaaattcctctgagcgctgacgattctttgccagttctgtggcccccagacatggctaggaaatgtaattgacatgtaatagacatgtctattgcaaagcatcagtgagaattgccaaactttactcctctccttcattgatgtttagggaagggctgctttactgtggtaggtgtggtgtcaggtgctggaacgatagagtaaggacagggtgggagggggcttacagacgtcacatgcacacacacaggctcacacactctgtactcaaaaacacgtacacataaatagagaggcagccgggcacggtggctcatacctgtaatcccagaactctgggaggccgagatgggtggatcacctgaggtcagaagttcaagaccagaccagccaacatggtgaaaccccgtctctactaaaaatacaaaaattagctgggtgtggtggcgcatgcctgtaatcccagctacacgggaggctaaggtaggataattgcttgaacttaggaggcagaggttgcagtgagctgagatcgcgccactacactccagcctgggcaatagagttagactctgtctcaaaaataaaaaaaaaagagaggcactgtgcatgtggccatgtatataaacatgtttgtgaatataaacatgcaatcagtttttaaaaaatttttatcggccgggcgcagtggctcatgcctgtaatcccagcactttgggaggccgaggcgggcgaatcatgaggtcaggagattgagaccatcctggctaacacagtgaaaccccatctctactaaaaatataaaaaatgagccaggcgtggtggcgggtgcctatagtcccagctactcgggaggctgaggcaggagaatggcgtgaacccgggaggcagagcttgcagtgagccgagattgtgccactgcactccagcctgggtggcagagtgagactccgtctcaaaaaaaaaaaaaaaaaaattatcatacagtctctcaaccagtcctactgcttttttttatttattgattttgagacagggtctcactctgtcacccaggctagagtacagtgatgcgatcttggctcactacaacttctacctcccggtttcaaacgattttcccacctcagccacccaagtagctggtatcacaggtgtgtaccaccacacctggctaatttttgtatttttagtagagatgggggtttcaccatgttacctaggcgggtcttgaactcctgagctcaagtgatccactcatctcggcctcccaaagtatgggattacaggcatgagccaccgcgcctggccaataaagcaatcatattcatccagcatcctttgagagggtagagaaaatcattattcacagactgtcacctgggtttggcgtgcattcctacagattttacctatttaagagatccttaaagtttttctgattcactgttaaggtaagcctagggatcttgcagtgtatatgtgaaggaaatgggtaacggactgttgagtgaatacagtgtatagattgtagcacatatggtgatctgtgaaacgggggtgtcatgacacaccccttcctgcatcccaaaattgtgggggtcagggtggataacgggcatttctgcagcctgcacagcagtgccgaatgcaggctgcaatccagcaatgtcactgctgggtatttatccaaagaaaggaaatggctgtgttgcaggcatacctgcactcacacgtttatcacagcgctgttcacacagcagcctaggtgaggaagtgacctatgtgcccagcttcagatgaatggatgaagaaaatgtgtagatccacagtggaatatgatggagccttacaaaaggaaatcctgccatttgcaacaacaacgtggattcatctgggggatgttacattaagtgaaatgaaccaggcacagaaagacgaataccacaagatctcactcatgtaaaacgttgatcacataaaagttaagaagaatggtggttaccagggggtgaggagaggttggttaaatgatacatatttataggtagacaggaggaataagtttgagagatgtattagacagtgactatagttaatgccggtatattgtaaaattggttagtagaaattttttttttttttttgagacagagtctcccctctgttgcccaggctggagtgcagtggcatgatctcggctcactgcaacctccgcctcctgggttcaagcaatttttatgtctcagcctcccaagtatctgggagtacaggcacagggcaccacgcccagctaatttttgtatttttaacagagacagggtttcgccatgttggccaggctggtctcgatctcctgacctcaggtgatctgcccacctcagccttctaaagtgctggatttacaggcatgagccaccgcgtctggccccattttttaagtgttgactgaaaactacctcaaaagaccggctttatcccacactctgtacaccacaggcttagcacgtcgtggctctccaggaactcttgagccttccccatgatgatgagtgggtcagggttaccgcagagctgaacggcctctgtagcgttcagcctgcagcctgcccaatgaggacgtttgcgctctggaaaggtaaactcaggatgctgttggctcctaagcagaaagcaggcgccacccagccttcaagtgcttcaacagtgaagagttaggacggaggcccagcctggaacattcacgccaccttctgcccccagtaaaattccttaaagctatgaggttctgactcaccacggggagtccctggccgccgctgggagggccttggccatgcaaatctcagtgacatagcacgtcttatttgcttcagaagtggcagaggagaaagtgacttgcctcacgctgcccggttccacccagggaccttgtgaagagacgcgggaaggctggcagaaaggagaaccgtccttcctgtggaatactcccgagatcgcaccactccactccagcctgggtgacaagagcaaaactccatctcaaaaaaaaaaaaaaaaaggcactgtacatgtgtccatgtatataaacatgtttatgaatatacataaataattttttaaaaaattttgtcatgcagtctcagccagtcctgctgtttttattttattttattttattttatttatttttttgagacaaggtctcactctatcacccaggctggagtgcggtgatatgatcttggctcactacaacctccgcctcctgggttcaagcaatcttcccacctcagccacccaagtagctggaattataggctgtttccttttacatgacattattttcccttttttatgttttattttattttatttttgagatagagtctcactctgttgcccaggctggagtacagtggtgcgatctcagctcactgcaacctctgcctcttgggttcaagcgattctccagcctcagcctcccgagtacctgggactacaagtgtgcaccaccatttccggctgtgtgtgtgtgtgtgtgtgtgtgtgtgtgtgtgtattttttgtagagacggggttttatcatgttggccaggctggtcttgaactcctggtctcaagtgatccacccgcctcggcctcccaaagtgctgagattagaagtgtgaggtaccacgcccggcccgtgacattatttttaagtacaaaagccatacatgtttactatacaaagtttagaaaattctcaaagattttttttaaaggaagcagatcatcactcataatcccacagcaaagatgatcattgttaacattttggcctatttccatagtctttttttctatacagattgttccttacaatggcattatgtcccctaaacccatcgtaacttgtaaataccttaagtctaaaatgtgtttagcacacctaacctaaatgtcatagcttagcctcgcctattttaagcgtgctcagaacacccacgttaattagtctacagttaggcaaaatcatctaacacagctgtccccaaccttgttggcaacagggaccagttttgtgaaagataatttttccatggaccagtgcagtggggggcgcggttcaggatgattcaagcacgttctatttattgtgcactttattattatgacattgtaatatataatgaaataattctacaactcaccatcatgtagaatcagtgggagccctgagcttgtttttctgcaactacacagtcccatctgggggtgatgggagacagtgacagatcatcaggcattagattctcataaggagtgtgcagcctagatccctcgcatgcgcagttcacagtagggtttgcactcctatgagaatctaatgctgctgctcatctgacgggaggcagagctcaagcagtcatgagagcaatggggagcagctgtaaatacagacgaagcttccctcctgcagcgcatctcctgctgtgcggcccagttcctagcaggccacagatgtggccaagggactggggacccctgatctatatagtgctttcttttttcttttttttctttttacgagatagggtctcaccctgtcacccagcctgcagggcagttgcactatcatagctcactgcagcctccaactcctgggcttgagcgatcctcccacctcagcctcccgagtagctaggactgcaggtgtgcaccccacaccaggccagttttgtattttttgtagagacagggtcttgccgtgttgcccaggctggttttgaactcctgggctcaaacaatcctcccaccttggcctcccaaagtgctgagtgggattataggcatgagctgcttcgcccaaactcgtctgttttttaccagtggcatagactgataacatgattttgatttctagggtttgttttttgtttttgtttttttttttacctgacatgttgtaaatatttcttgcttatcattaaatattcttcagaaacacagtgcatactgcataacattccatcacgtaggtgagccctaagacttaccacttatttccctgctgttcaggagcctgatttattacactgctttcattgccctttggggtttaatctggggagctttgtccctgttctttctatgccttcatgttctgccagtggctgtggcatctttttcgtgttttttgtttgtttgtttgtttgttttgttttgtttgagacggagtcctgctctgtcacccaggctggagtgccgtggcatgatctcggctcactgcaacctccacctcccagatttaagcgattcttctgcctcggcctcctgagtagctgggactacaggtgtgtgccaccacgcccagtgaatttttgtatttttagtagagacagggtttcgccagttggccaagctggtctgacctcaggtgatcggcccacttcagcctccagaagggctgggattacaggcgtgagccaccacgcccagccggctgtggcatcttgaggtagcctcccaaggccatcatcagacaagagcgtttggaagcccagaattctccaagggctcatggcagtactggcacggggcctctgttcctagactgctgctccatgacgtttgtagatgcctctagtgaaaagtcagggacagtggatgatatgcacggctcagagaccctgactctggtcccatctgtccccaggtgtgaccccacaaagcccctccctcggccgcagcaccggattgggccgggtgccaggcaggacggaggagctggcccttttgtcagcctcttgcactttcttgcccagttctacttcccagagacctggatctcggatgctgtcccccagcagggcctgtttgtggagtggccttcaggcagggctgcatccagggcaccgggcacagcatgagtcacggtgggaagaacctgggtcgcaacatcgtaaagacctgggtttaattcccaactccatgaattatgtaacctcaagcagggcaggaggtttccttactcagaccttagtattttcataagtgaaataaaagaatgccacgcctcacctgtaatcccagcactttgggagatcaaggcaggtggatcacttgaggccaagagtttgagaccagactggccaacatgaggaaaccctgtctctattaaaaatacaaaaatttgctgggcgtggtggcatgtgtctgtaattctagctactcgggaggctgaagtagaagaatcacttgaactggggaggtggaggttgcagtgagctgagatcccgccactgcactccagcctgggcaacagagactctgtttcaaaaaaaaaagagaaaagaatgccacattagtgcctggtacaggacctctataaagggtggctgacattgctgctcctgctgcctgcaaggcacctggcatcacctggcacattttaaaaaggtctgcttacctccccctgctcaaggtctcttcccactcttaagaattatgtcgctttccatgatgagtttgtaaaaatcattatccgcactgcaagacctactcatccatattagcgtgccacagctggggcacccaggtgtaaagctttgtttcccatcatcttcctcagggaccctaaattttaaaatctgcatcagtcaccattgaggtgccactaaatgtggtggccaaaagttccaagttcaaaccattgcacagctgcaaatgccttcatagatgggtctctaaaaaatcaaacaccagggctgggcacagtggctcacctctgtaatcccagcactttgggaggccaagatgggcagatcacttgaggtcaggagttcgagaccagcctggccaacatggtaaaaccctgtctctactaaaaatacaaaaattagctgggcgtggtagtgggtgcctgtaatcccagctactcgggaggctgaagcaggagaatggcttgaacctgggaggcagaggctgcagtgagccgagattgtgccattgcactccagcctgggaaacagagtgaggctccatctcaaagaaaaaatcaacaccagaggttaataatctagtaactaactgtcttctatgtgccacatttttgcaagatccaagttttaaagtgagaacaagttgttcggtccccgcccagctgactgtgacaccaaggtggcggcccgcattggagatctggttccatctgacttggaaaatttggggcaccgtgggctggtgtgaaacaaattaaaagaggtgccaaacagccaggcacccagcaaggatgcccagggctcttgttcggggatttcgttaaaaaactttttggaacccacctcaaagaatgaaaagtttcctataggaaggcaggagcgagcgagataattgaactcattgatttccttcacggcttgtttgccctttcattctcttcccgaggtgctatttgttgaggaatgtctccaattgccagaaagacagtggggtgtctcatatttcctcgccacctctcctttcagccagtgctgagttctaaggcaagcctgcaatatgaatttttaatgccgagctttatggcatcactcccgcacagcccgactgcatcactctcctgagccttcagatttaatgctccaatgaacagagcaaagactggggcattcaacatcagtgagaattaacccccacatgaccacagcagtgccctctgattttcctaaagagggttgggaaaaaataaaaattatgtagtgttggccgggtaaggtggctcacacctgtaactccatcactttgggaggctgagatgggtggatcacctgaggtcaggagttcgagaccagtctggccaacatagcaaaaccccatctctactaaaaacacaaaaattagctgggcgtggtgacgggagcttgtaatcccagctacttgggaggctgaggcaggagaatcgcttgaacccaggaggcagaggttgcagtgagctgaaatcacgccactgcactccagcctgggcaacagagcaagactccatcttataaaaaaaattatgtagtgttgagaatccttgctatccaaatagcctgaagcacaaaagcacagcttattcttgaaattttatggaatagcctatattttgacctttttgcttcttctaagttggacgatgtgtgcttcgaagcatttctgtgatcttcccacccttaaaaaaaaaatctctgcaggctgggagtggtggctcacgcctgtaatcccagcactttgggagactgtggtgggcagattgcctgaggtcaggagttcaagaccggcctggccaacatgatgaaaccctgtctctactgaaaatacgaaaattagccgggcgtggtggtacacgcctgtagtcccagctactcagaaagctgagtcagcgagatcatgccactgcatttcagcctggtcaacagagtgagactccatctcaaaaaaaaaaaaaaaaaactctccagtttgtaggatttaatgaatatatagatgaccggctgttctgcggtttccgtggaaagcccaaatgtaattagaaatccaatttccgatcgatttttccaatggaaaaaggaccagttgtgttaagtggctaattctttttttatgcagatggttgattgtcattttcttatagtagctttctgaatttttgcagacgtcaaaactaagaaaaagttgtatataaaaattgctcaattggccaggtgcagtggctcacgcctctaatcctaacattttgggaggccgaggcaggagggtcgtttgaggccaggaattcaagaccagcctgggcaaaacagcaagacataatttctgtttaaaaaaaaaaaaaaaagtttgaacataaaaactgctcaaatttaagtacattaaagaaggacagagtctttagtaaatggtagaataacaagccaactatgtagaagccagtagaatcagagctgagccccatgcaaaataaaatctatttagttatttttatttattttttattttatttatttattttttttttttgagacagggtcttgctgtctcacccaggctgaagtgcagtggcgtgatcttggctcactgcaacctctgcctcccaggttcaagcagttctcctgcctcagcctcctgagtagctgggattacaggcgcgcaccaccatgcctagccaatttttgtattttagtaaagatggggtttcaccatgttggctaggctggtcttgaactcctgacctcaagtgatccacccacctctgcctgccaaagtgctgggattacaggcgtgagccaccacgctcagtttagatgtttaaaacatttaaatgtgaccagaaagaaatccataaaaacactaggagcaattttaggtgtatatttatataataagggggtggaaaaacttttttttaagcatgatgccaaaagtagaaatcacaaagggaagaaattcagagctttgtggagatggatgggcgggtggatagatggatgggcgggtggatagatggatgggcgggtggatagatggatgggcgggtggatagatggatggatggacagacggatgggcagatggatttagacagactggcaaaaatatttgcaatatatatgagagagagagtgtgtgtgtgtgtgtgcgcgcgcgcgcgcgcacgccacgcacacacgcatctttacagaacaataagaaaaagtttcatttcccaatagtaaaacctctatattttcagtttcttactagacatttctactatgagcatctcaaactcagattaagttgttattctccgtaacttcccccttccctatagtcagcccccttctgctttcttcctctgcccgaccatacctgctcctccttcattccagaaactgagggtatttcgtcactcctttgtgagccctcctgtctaattcatgttagttccgccttcttgcaacattgtacattcccaacttcatcaccactctcactaccgtcattttaatttgtttttctttgcttttctttttttttttttttttttgagacagggtctcgctctgtcacttgcagtggcgcaatctctgctcactgcaacctccacctcccaggttcaagcgattctcctgcctcagcttcctgagtagctgggattacaggcacccgccactacacctggctaatttttgtatttttagtagtgacagggttcaccatgttggccaggctggtcgcaaactcctgacctcaagtgattcacctgcctcagcctcccaaagtgctgggattacaggcgtgagccaccgcacccggccttaatttgtttttcgtctcttggtctcacttcaagatcttctgaacttgaccctctgccaccagtatctccctggacaaaaccaccctccaagcatctgctaaagttatctttctaaaatctgtctgatcctgctaaaacctgtcccacttaaaatctctccgtggcaccctctctcatatctaagggaaagtccaaaatcacagcatgatgcacaaggcactttgggatgcagccctgccttcccagcctcatcttaggccaactcaaactccaccgtcctatagaatcccaggcctttctttccccagctcaccttgcagccggttctacctttcctgacaagctgatcctgccctgccttgcctgctcctatgcccacacttacctgctgtggtgaaagagggctctggtctccctcattctaggggctcttcatgtggggtctatagagagaacctgggggcttcatgaattggacccagaaaaaaatacatcttttttttttttttttttttttttttgagatggagtcttgccctgtcacccaggctggagtgcagtgatgcaattgtggctctctgcaacctccgcctcccgggttcaagcgattctcctgccttagcctaccaagtagttgggaccacaggcatgtgccaccacacccagataatttttgtagtttttagtagagacagggtttcaccatgttggccaggctggtcttgaactcctgacctcgtgatccacccgcctccgcctcccaaagtgctgggactacaggcgtgagccaccacactcggcctagaaaatacatctttatttccatcagtgtctaactgcaatgtagcatttccttccattgtaaatgaagcccccacaccggggtaattgcagactgtgacctcgttgcgagtggaaatcacagaggctttcacatctcattcccgttgttacggaggtcacaaacgctgtttggattcatcactacttcaaaatgtcagtggttcttagatttgttatttagtgcaacagtaaagaacagttgttcctgtatcacaaatctggttttaaaaaaagattgtcctggcgcgctggctcacacctgtaatcacagcaccttgagaggccaaggtgggcagatcactttgaggtcaggtgttcgaggccagtctggccaacatggtgaaacctcatatctcctaaaagtttaaaaaattagctgggagtggtggtgggcacctgtaatcccagctactctggtggctgaggcaggagaatcgcttgaacccgggaggtggaggttgcagttagctgagattgcaccactgcacttcagcctgggcaacagagctagactcagtctcaaaaataaaaattaaaaaaaattgcaataactgcacttcaaaataattgttttccttggtccttaaaacatgattagacttctgtccaataatggccttgtggacttacgtctttaaaacattccaaatagatgcctgtattcttgacaagacttccagaggggaccgtggcaaaggaagggttaagcatctgcgtcagactgacagtgtcttgaccggatcctcctccgtctttcccccaccgctttgcacagtgccacatgactttttatttgttttgagacaggatccagctctgttgcccagactggaatgcagtggcgcaatcacgactcactgcagccctgacctcctgggctcaagtgatcctcccacctcagcctcctgagtagctgggactataggcaagtgccaccacacccagctaattctttttatttttagagatggggtctcactgtgttacccaggctggtctcaaactcctgggctcaagcgatcctcccacctctccctcccgaagttctgggattacagacaggagtcacagcgccaggtccctatttattttactctttgtgtgtttccttatatcctgtaaaaatgggtacagtggaaactgggcagtaattctacacgtattctggattttagctactcacatttatggttacttttacctatcaattaattgcttttcttttcactcgagttttagtgattttcactgtccaaaagaatcgtgtatagttgacccttgaacaacacaggggttagaggcactgacccccgacacagtgaaaaatccaagtacaacttttgactcctcaaaagctttactgacagcctgctagtgaccggaagccttaccagttacatgaagtgccgattaagatgttttgtaagttacatatgttatatacaatattcttccaataaagtaaggcagagaaaagaaaatgttaagaaatcctaaggaagagaaaacacactttccgttcattaagtggaagtggatcatcaaaaaggtcttcatccctgttgtcttcacatcaagtaggccaaggaagaggagggttggtctcgctgtctcgggtgacagcggaggaggacgtggaggaggtgggaggggggccagacacactcagtgtaattttactgaaaaatattcaagttgaagtggaaccatattgttcagacccatatttgagggtcaacttgtgtgtgtgtgtgtttgtgtgtgtgtgtgtgtatgtacacacacacaaaaaataatatatataaaaacatgagtcccagcaatcttatccttaatcatttctaatgtggtttcagtgagagaaaatagtcttttcaggccaggcacggtggctcatgcctgtaattccagcactttgggaggccaaggcaggcggatcacttgaggtcacgagttcaagaccagcctggccaagatggtgtaaacccatctctactctaaatacaaaaattgtcctggtgtggtggcgcgtgcctatagtcctagctacttgggaggctgaggcaggagaatccttgaacccgggaggtggaggtcacagtgagctgagatcacgccaccacacaccagcctgggagacagagcaaggctctgtctcaaaaaaaaaagaaaatggttttttctcctcaatccattttcttatttttcaatgacctattatatctttaatgtgtctgaagtttattatatcatataaaataatatttgtttctgtttgttattctttaatactcagtttgcccaataatattgatgatttcttcccccaacatataatatctgacaaatcaggtataaatacatatagctctggatttctgtctataatttcattctatcagtctagtttttcactctaataagtgccacactcttgatgacgtctccttgttttctatttcagtatttgtatagccagtttactattgttgtttttagtttaaaagaaaaaaaaacaacaacctttagtattttggtcacctattttttctgtatgcatctcgtcattttaccaactttttttttttttatttgagatggagtcttgctctctcacccatgctggagtgcagtggcacgatctcagctcactgcaacctccacctcccaggttcaagcaattctcctgcctcagcctccccaatagctgggattacaggcaccgccaccacacccagctaatttttgtatttttaatggagacggggtttcaccatgttggtcaggctggtctgaaactcctgacgtcatgatccgcccaccttggcctcccaaagtgctgggattttagacgtgagccaccgtgcccggccattttaccaacttttataaattaacttgggagagaaatgtatgtttctttgtatttaatgcagctgcacataaatgtatcattctcttcctttgctccaagcattttgtaatccaatttttctacagatggagtttatgctatgttattttaattcccacgtgcttctgtgtttacctctgttgtaaatgagacagatcttttatttcattttgtggatgtttattactggtgtaggggagtttgttattttcttgtgtttaccaagaaacatagggctttgctgaacgcttgattgtcccagcccatttgctcaagtgaatccctgggatttggggagcacgggactgcattacctacaagtagtgaacgtgcaccctgtgtgacactcagaacttctgatcctcttctttcattcctgtgttcagaaggagcattctgttataggtctgggaagaatcgtggaggctcttggtttaagcctgtgtccctttccatgttaatcaaatgctccaatgatttcccctctgtaaattgaactgtgacctggtttttagatgccatgggatcaaagccccgcaactgtgttagatccttctagtggggtagttttctattaggtcggtgcaaaagtaattgcggtttttgccattaaaagtaatggcaggttgggcgcggtggctcacacctgtaatcccagcgctttgggaggttgaggcaggcggatcacctgaggtcacaagttcaagaccacactggccaacatggctaaaccctgcctctactgaaaatacaaaaattagccgggcgtggtggtggatgcctataatcccagctactcgggaggctgaggcatgagaattgcttgaaccctggaggtgaaggttacagtgagctgagatggcaccgctgcactccagcctgggcgagaagagtgaatctccgtcaaaaaagaaaaaggtaatggcaaaaccacagttacttttgcaccgacctaatagtaggattacacttttaaatagtacatttcattccatttttattttacatattttatagattttcttgcttatttaagacaagttgaagcttatgtttctatttactgtgccatttagcatttcttatttctccctaacattattatgctacatataatattgattagtctggcttcaaaccttaccttaattagccttaaaaaaaaaatctagttggccaagcacactggctcacacctgtagcctcaacactttgggaggccaaggcagaaggatcacttgaacccaggaactggagaccagcctgggcaacgtagtgagatcgtctcactaaaaaaagttaaaaattagctgggcatggtggtgctcactgtagtcttagctactttggagactgaggagggaggattgcttgagcccaggaggtcaaggctgcagtgagccaaaatcgtgccactgcaccccagcctgggcaacaaagtgagatcccgtctccaaaaacaaaaagtctagttaatcattgcctttttactcaaaatgtgtttctaccaccctttttggatttttaaaaaatatgtattttatttttatgggtaaatttggcctaattacattttactgatataactcttaacttaaatttctctttattgttgaattgttgatccttttcttttttctaattcacagtatctctgtcctaggctttctgatctatttaaggaagattgagtgaacagcctaattgaccctctgaatgtcccctgagccttctaatccgccctgccttgagcctcctcttgtaactgaaattcactttctgatgcagaaccattgagcccttctgaaaccttttcaaaactatatatttaaattttcttatcaaactgtactgttattagattacatgtctagcatagcagcaaattatacttcattatattaaccttgccacttccctctacaatgagacccgatcttttataagatactctggacctacaaattcctgctggtgaattctttaaagttatatggattttcaacgatcgtctactccctttacaaagcagctgctgtttagcaggattatccattagtggtaagaatcctttattccctagcatatggtaaatattttttaccaacttgaggtatgccacgtagatcccacgggatttacacacatagacaaaggcattcttctcatcacattgttttaaacaatccagctgccattttagctttcactaaacttagaaatgtatcagcttggccgggcattgtgggtcacacctctaatctcagcactttgggagatcaaggcaggcggatcatttgaggtcaggagtttgagaccagcctggccaacatggagaaaccccatctgtactaaaaatacaaaaattagctgggtgtggtggtatgcacctgtaattccagctactcaggaggctgagacccgggaatcacttgaacccgggaggcagagtttgcagtgagccgagatcgtgctgctgcactccagcctgggcaacagagagagactacatcttaaaaaaaaaaaaaaaaaaaaaaaggaatggtatcaactcgacacccagggtccttctgtaagttaaaacctgggaagtgccctaccctggcatttgaaaagtggctgaatccaatttcctgtccagaattacaatgacattgtattgatacattgatgatcaaaagcatagctaagctgtaaggctggttattggatatacatcttccaagtggagagattattaccacctgaaacagcttttggcttgtccattaagactcctttccagccaggcatggtggcccacccctgtaatcccagcactttgagaggccaagccgggggtactgcctgagcacagaaattcgagacaggctgggcaacatagcaagaactcatctctactaaaaattaaaaccactttccaaaatgaattttttttttaagacaggatcttgatctgtcacccaggctatagtgcaatggcacagtcatagctcactgcagcctcaaactcctgggatcaagccatcctcctgcctcacccccttaagtggctggttctacaggggcacaccagcacacccagctatttttttttttttaatttattgtagagacggggtcttgttacattgcccaggctggtctcaagctcttggcctcaagcgatcctccagcagtcctcccacctgagcctcccaaagtcctggaatgacaggtctaagccactctgctcagcccaaaacaaattctataaccaaaccagaaaagttgttttttgtttagctttttaccttaaaactttcattacccctacttccaacaaagtatttgaggtggatttaacacaagacacagcatcaataaagctcttaagtgaagtctgagatttaaaggagcatagctcagtggggaagatgacttctaaggcttggctttgaataaagcccaactcttcaatagcttggtgtgactaagacatgctctacctatgtgggtttgtttttttgtttgtttgtttgtttgtttgtttttggagacagagtcttgctctgtcacccagggtggagtgcaatggcacgatctcggctcactgcaacctccacctccgggttcaagcaattctcctgcctcagcctcccaagtagctggaactacaggtgcacaccaccatgcccagccagttttttgtattttagtagagacggggtttcaccatgtttgccaggctattctcaaactcctgaactcaggcaatccacctgccttagcctcccaaagtgctaggattacaggcatgagccactgcacccagcctctatgtgttttttttattgttaagagttcgaggctgggtgcagtgacacacacctgtaatcccagcactttgggaggccgaggcgggagaatcacttgaggtcaggagttcaagaccagcctggccaacatggtgaaaccccgtctctactaaaaatacaaaaaaaaatttagctgagcgtggtggtgcacgcctgtaatcccagctattggggaggctgaggcaggagaatctcttgaacccaggaggcagaggttgcggtgagccaagatcatgccactgtactccagcctgggggatggagcgagacttcgtctcaaaaaaaaaaaaaaacagcattactatgccaccctgatacactgcttggctaggagggaaaacttcttgttgcaattaacctttctatttttttcgctacgtctaagtattgtgaacttcctttgtggtattttagtgattagacaggatggagggcgttcttaaagattcatggccaaatccaatgatgtcagagtgaagggaacggacggtcttcgtggggccagcaagtctggccccatctgaattgtttgtctaacacttcacaagcagaataggaaccgctgaattattcattttcaagttgccctaaaaaaggtacttagcctgccgaaaggcagactttcggtgccagcgagaggaagaggaaggatgctgtctttcctatgaacgttctcgtgcctccactgcctgggtcttcagtttcacttcccagccctgcggggtacaggaaaccaccagctaacttaagtgcaaggcaattaagcggggagggaattgtggacaaatctatagaactctgaagccacaggtgagccaagcattgactttactggggaaaaaccaggtggaagaaggttgaaggagcttgggttggtcagaagatgccaggatttgggacctgagccagggaggtgggcccaggaagtgggattgggcttggggatggggaaggagaggaagctgagagcgataactagtatgcaatcagaaattttttttattcttagttttagcttctctgcctctgccaccaaagctttgttttggtttttgagacaggctctcactctgttgcccaggctgtagtgcagtggcacaatcttggctcacttcaacctgtgcctcccgggttcaagcaattctcccaccttagcctcccgagtagctgggattacaggtgcacaccaccactctcagctaatttttttttttttttttttttttgtatttttagtagagacggggtttctccatgttggtcaggctggtcttgaactcctgacctcaagtgatccacccgcctcagcctctcagagtgctgggattacaggcgtgagccaccatgcctggtcccaacctttccttaacacttcctaccacacagtacttaggggagaaagtcattagaaacccttgtacttgggagtaaaggccaggcttttagtagagacaggttgcctaccatgcccttgagcccatgcaccactgcgccgccctgcacctcagtttccccacttgtgaaatcctagcagtcttcctctgtaggtctgcactgctcccctgtggtgtgtcttttgtgcagcgcaggaggcagatgagagagagaagcccgcgtcttgtccaaaatatgatttggcgcattcttgggcagcgtctgttggaggtacaggcgggatgctcacaggtgaagtaaaccaggaatggcaaacagaacctgaaaggtggttctgaaagagagaatgcagaaactgggcaagcagtactcccacctgtaggaaggtttgctggcgaagtttcacactaaaacatgaaggagactgttaaaaacaatgggtatagatgacagaacagcatcccttcctaaacagcctttaaaagtctgaaactagggccaggtgtggtagttcacacctgtaagcccagctagttgggaggctgaggcaggaggatcacttgagcccaggaatttgaggctgcagtgagccatgatagtaccactgcactccagcctgggcaacagagcaagaccctgtctctacaaaaaataaattagccatgtgtaatggtgcacacctgtagtcccaggtattcaggggatcgagacaggaggatcacttgaagacaggagttcaagaccagcctggccaacatagtgagaccttgtttctgcaaaaaatttaaaaattagccgggagaggtgatgcacacttgtagtcccagctacttgggaggccgaggcaggaggatctcttgagcccatgagttcaaggctgcagtgagccatggtcaaaccactgcactccagcctgggcaacagagcaagacccatctattaaaaaataataataataataaaaacaaatctgaaagtaaagaagtaacaaccggtccccatttcctgccaggttgttgtctacccgtgattcctggcacagttggggcaagtccccggagtgcaggagccatgttgcctgcgtctttgtaactgtcccatggccagggggctcaatggatggcaggctgccggcccacgatgtcaacagcaggaacttgtgcctcagtttcctccatcacctaagtgtaggcctctcaccatgacagttcccttcctgggtcagatggtacttggggggttcccttccagaattcattttcttcccattctctgttcttggctaacaatctttttcttttttatgagacagagtcttgctctgtcacccaagctggagcacagaggcgcgatcatagctcactgcagcctccaactcctgggctcaaacgatccacccacatcagtctccaaagtagctgggaccacaagtgcataccaccatacccagctaatttttgtattaatgttttgtagagacggagcttcaccatgttgcccaggctggtctcgaattcctgggctcaagcgatcctcccaccttggcctcccaaagtgctgggattacaggtgtgagtcactgcgcctggcccaatcattttctgtgtcaaagaaaaacatatatatggtatattattttttaaagtcacattcttcttatagagatgtgctctttgtatacatttttttccccttggcaagtgggtaaacgggattccgggaaggtaactgtcttgactaaagttagcagagtctggcatcaggtggaccgcacaggacggccacttcttcttttgtttttttgttttgttttgtttgagacggagtctcaatctgtctcaccaagactggagtgccgtggtgcgatctcagctcactgtagcctccacctcctgggttcaagccatcctcctgtctcagcctcccgagtagctggaattacaggcatgcaccaccccacccggccaattttgtatttttagtagagacgagcctttaccatgttggccaggctggtctcgaactcctgacctcaggcaatccacccacctcagcctcccaaagtgctgggattacaggcgtgagccactgcgcccagccaggacggccacttctaatccatattcttttccacagctgcagccacagccatgcagcgtcctttagattctccttcttcttgagtatttttatgtcttgcttatcaccttgtttcattgcaaatggaatagtagcagtcagcatcagtgcacgctttacaattaatgagtgacgatggagggatacctgactactgtgatgctcttcactttttttgttgtcttattgggttttttgtttatgtttcatatgttaaatttccgacgtacgcgtgacctggtgtcagcatctcccgttcatggcccatcccgtctcacctgtccccactcctgttttgacttgaagctactcccagaatcctttcatttcctttctaaacattttaacacacatatcctcacaataaggactttctttttaatatagtcacagcgcaattagcacattcaaaaataatttttcacctgcagtcccagcaactcaggaggctgaggtgggaggattgcttgagcccgggaggttgaggctgcagtgagctatgatcacaccactacgctccagcctgggtgacaaagcaagaccctgtctcaaaaaaaaaaaaaaacagtaaaaataataatcataataattttttaatatgatcaggtaaatctagccagttttgaaatttctagttgcccccaaacttcataatggttttattttctaaaattattttaatttaggctgggcgcaatggctcacgtctgtaatcccagcactttgggaggccgaggtgggtggataacttgaggtcaggagcttgaaaacagcctggctaacatggcaaaacctcgtctctactaaaaacacaaaaattagctgggtgtggtggcacacacctgtagtcccagctactcaggaggctgaggcagtggaatcacctgaacggagaggcggaggttgcagtgagccgagatcgcaccactgcactccaacctgggcgacagagcaagactccgtcttaaaaaaaaaaaaaaaaaaaaaaatttgaatctcgattcaagtaagatccacacgttgcagttggctggtgtatctttaagtcttggtcattgtatagattccctcttcgtcactttttcttttccttgcaatgtatttgtgctagaaatggggtcatttgtccagaaaagattctccaccccactgctgagattttactgattgcctccccagaaatagtttatcatgctcctctgtcctcatgctttcctgaaaatttgtggttgaatctagaggcttgatcagattcaggctagaagtttttggccaaaagcccctttgtgggtgattgtgatgatctcgcgatggtgtcaggtactggaagtgagcgctcaccagaagagaaaggtcctgactttgatacacaatcataatgaatccaggcatggagcttggtggtttacaaaatcttttcctttctttttgtgttcttgttttatcctcatgctaatttctttgaatttcatggctcctcctgtataggtgactgtccagctcagaagtctgtccaaggtcaaacaactaaaagacaatgggagggccgggcgcggtggctcacgcctgtaatcccaacactttgggaggccgaggtgggtggatcatctgaggtcaggagttcaagaccagcctgaccaacatggtgaaaccctgcctctactaaaaatacaaaaattagctgggcatggtggcaggctcctgtaatcccagctactcatgagactgagggaggagaattgcttgaacctgggaggcagaggttgcggtgagtcgagatcgtgccattgcactccagcctgggcagtagagcaagactccatctcaaaaataaataaataaaaatttttacaaaataaaaatgcagtggagaagaattccaacccattttccaccagccacactcttttctgtagaccacaattttcctaatttcacttgattttaaagaacaaaggaacctgcacacccagcctgctctccacttctttgggtagagcagggctgttagaactctagagagatgcaggaagcagccgccgatgaacccagatgctcatccctggaggcactgtgcggtctcaggagcagaagccgaatgaattatgcaatatcagagcctcattccctgggccgcagctgtcccatgttccctgcctggagatgactgaagcccgagtgacagtcacaggctgttcccgatcacgctggggtcacacgctctggtgagcacccagccggccagagctgtgctattggtttggcacaggtagaaagttgaccccgcacgtgccgtagaaggtcatttcgttcggttcatcagctatactcggactggctaaaggaagattttattgaaatcgtttcccatgaacacgtcaacttgtggggcaggaagggaaattttcttcccgtttgggattgaaaagatgaggcttaaccaaactcgttcttatgttcgttggtttgttttttctttctttctttcttttttttaaacagactctcactctgttgcccaggctggagtacagtggcgtgatctcggctcactgtaacttccacctcccaggttcaagcaattctgccaccccagcctccttagtagctgggattacaggcgcacgccaccacacctagctaatttttgtatttttagtagagatggggtttcaccatgttggccaggctggtctcaaactcctgaactcaagtgatccacccaccttagcttcccaaagtgcttgggattacatgagtgagccactgcgcctggcctaaacttgtttttaatcattacttttgtatcatttaaattagtataatggtaatctacagagaacaaattctggttaatttctgagcagacagaggtgacatcctggccgtttaactgtctctcggcacagtgttacttccagcaaaaatgaaaaccgctatttccagaaggttatctgtagggataaagctccacagactggaccgactctctttccaggcctttgattggggaggggtggggccaccgtggagtgtgacacatttgatccggggcttggcagatgcaagatggcttcatcctcccctctacttctgccaaagcagaagtggtttaaccttgggtggaaaacgaaagatagggcaagtcatacagatgagggctgccaagaaaacctttccccgaaaaacactctctcctcccctcctccccttccccatcagcctccgtgtcttcagtcctgacctggttcacagatccgtgttgggcacggggatgagtgatgagtggtgagctgggccacctggttctgcactccaggacctcacggtccattggacaaaaagaagcctaattctgggtctttcaatacttctcccccaagactattattgccttgtttttcagaggctctgaaaagcgaatcattttccttctgcaataacatcttgtaggctctttccttaaaagttgtatttacaatttgccaaaagaattctaccctttctgccctttagaatactagccagtgaatggctgtctgtcaagaagacaggggacctcaggtatcacaggtgtcattaatttgcatatttgggccggtgcggtggctcatatctgtcatcccagcactttgggaggccaaggcaggtggatcactggagatcaggagttcgagaccagcctggccaacatgatgaaacctgatctctactaaaaaaatagaaaaattagccgggcatggtggcgcatgcctgtactcccagctactcgggaggctgaggaggcggaggttacagtgaaccgagatcgccccactgccctccagcctgggtgacagagcgagactccgtctcaaaaataaataaataaataaataaataaatttgcatatttggtcaaccagtattttgtgagtacctgctgtgttccctggaactatggcagtggataagcaagtaatcaatatatgaacaagagactttgagacgggaataaatgcaacagaaacaaaatgaatggacaatggagagtgtggctgtggagaggcctctcagaggagggccaggagggctgagacccaggcctgtaggtgggacaagcatggtgcttccaagaaacagaacaggactaaagaggctgggcacggtggctcacacctgtgatcctaacaccttgggaggccaaggcaggcagatcacctgaggtcaagagttcgagatcagcctgaccaacatggtgaaaccccgtctctactaaaaatacaaaaattagccaggcgtggtggtgcacacctgtaattccagctactagggaggctggggcattctcaagaatcacttgaaccccgaaggcagaggttgcagtgagctgagattgcaccagtgcactccagcttgggcaacagaccaagactccgtatcaaaaacaaacaaacaaaaaaacaaaaaacaaagaaatgcccatcttttattttaaaaatcttaataaaatagggatatagttggatatttcattaataaatgtatatatataatgtattttatatataactacacattaatgtatgtgttatatatatataatatattaatatatatatattatatattactcaagaacatgagtaagttcttgagtggtgatttgtgagatttaggtgcacccatcacctaagcagtatacactgcacccaatatatagtcttttttccctcacccccctcccaccctttccccgcaagtccccagagtcctttgcattttcatcgcttagctcccacttacgagtgagaacatacaatgtttggttttccattcctgagttacttcacttagaataatagtcttcactcccatgcaggttgttgtgaatgtcattaactcgttcctttttagggctgagtagtattctgtcgtgagataagaaatattcaaagggtgtgggaagagactctgccgtctttatttgcagatgtggtcacaggatgcctcgcaaccccgagagagccactgaaaagttgttacaaaattgaacaggcttccatttccctgtggcctctctctctagacagccgtacctctctatcccagtgtcccctgctcagtaaatctgtactcatcctccagggtacagactggatgtcccctactccgggatactgtttctcctggtgtctgcagaggcccttgtaccactttctgggatgtcactgtgctgaatcgctggtggctgccatttccttccgcctcccactgggtagacaggaagggggtccctgcccacccacccacccatgcccggtatatccctgctgagctcctaggatgtgcagggtgtattcctgtgtgctagcgagaagggagtcccagcgccactacgccattgcccactcctcccctgggacatttgtttcccttgggtgtggttcatggtaggtgccccatgggcgttattggtgggagacctccctgtctcagtctgagctgggcccatcgccatcagggcacgacagccacagcaggtgcctttgctgggagtaatcttgccctggctcgcatgagactgcagaccagcccttctccgtaagttcaggcgtttgtgctccgatcagcttttcctataggtttgtcccccaccccttgcccaactctttgaccccccgagttaaggggattccagacctagagccaagtgaccttcctcagagcctggccctgtctccaccgcttcagcaacctgctctttctggacagggtccagcgagccccacctctgtccgtttcctctaccccctgtgctaaggaagcctcacctgcagtgtaggttgtggtgaaaaatgtccccccttaaggacagagcaggtcatcacgtgcagccctggggtagaaggggagagttcgcttgatcaaacctaactggagcttttcttttaaagcaggaagaattaatctgtagatatttctcctttcaatgccaaagaactttatgatctggtattgagactattggtgggttttttttgttttctttgtttttttgttttgttttgtttgagacagggtctcgctctggtacccaggctggagtgcagtggcacgatctcagctcacttcaacctctgtgaccggggttcaagcgattcttccgcctcagcctcccgagtagctgggattacaggcgctcgccaccatgcccggctaatacttgtatttttagtagaggcagggtttcatcatgttagccaggctggtttcaaactcctggtctcaagtgatccacctacctcggcctcccaaagtgctaggattacaggcgtgagccactgggcccggccgagactattggcttatgaatcaagtctaagaagatacactagtctttgaaggccgctctgtatgtttttccaactgccttgtagatatactttgttttaacagctcgttttaacagctcctgatgccagcgtgcttatttgggtattgaaatatgcgccaacaccgtgccccgatgccacgcgttagcccccaggaggcttgcgtgaaagtaaatactagaatttccagcgtggatataatttcccttccatcgaccttgaccatgtccttttcagttcctcataaaaactgtgtgttagcccagagaataccctgaaatgatctgtggtgaactgattgaacgaactacatattctaggccaaactgaaattattcgctatttgaagtcagagctgagcataataccgggcaggttaatagatcagtggaagctgtttcgtcagctcataaaaacgtgagagatctaaatttttataataaatcattttgctgagcaaacaatatgtgcggttattacagactttggaaaataaatgattttagaccaatgtcaggctgcagatactgatgtggttagttgagccttcagcatgaagagaatgaaaaatctttggaatactgttgacactcacaccatgaaaccacatgccatttaattcattactgcgcttccaagattacatttacagttgtggtattaacccctgggcatttttgtattacttattgcagacagtttgtcaggcaggattaattcagtggggggaggaggcagcagtttggagagaaagtggatgattaagactggggtggggctgggcgcgtcggttcacgcctgtcatcccagcactttgggaggccgaggcgggtggatcacctgaggtcaggagttcgagaccagcctggccaacacgataaaaccccgtctctactaaaactacaaaaattagccgggtgtggtggcgcatacctgtaatcccagctactcggaaggctgaggcagggagaatcgcttgaacccaggagatggaggttgcagtgagctgagatcatgccattacactccagcctgggcaacaagagcgaaactccatctcagaaaataaaaataaaaatacaaaaattagctgtgattgggtgtgcctgtaattccagctacttgggagaggctaaggcaggagagtcacttgaactgggaaggcagaggctacagtgagttgagattgtgctactgcactccagcctgggcgacagagtgagactctgtctcaaaaaaaaaaaaaaaaaaaaaaaaaaaaaaacctggttgggaggtgccccaaagcaagacccgcctccttggtcctggtctgcaaacactgatggccacactcacatcttccaaagcccccgatcgcacttactcagctagttgtatttttctttcggcttttaaaaaagaatacctccttagaaaaattaataatgggccaggcacagtggctcaggcctgtaatctcagcattctgggaaactaaggcaggaggatcgcttcaggccatgagttcaagaccagcctcggcaacatagcaagatcaactttgtctctacaaaaaagaaaaaactagctaggtgtggcagtgcatacctgtagtcccagctactcgggaggccaaggcaggattgtttgagttcaggagtttaagaccagcttgggaagcattgtaagacccctgtctctaaaaaacaaatttttcttttaaattagctgggcttgctagtgcacacctataagtcccagctactcaagagactggggcaggaggatcacttgagctcaggacaagagttggaggctgcagtgagctatgatcgcaccactgcactccatcctgggcaacagaaccagaccctgtatcaaaaataaaaaagaattctcagaaaaatgagtaacaaacatacagatttttgtttgtttgtttttgtttgtttgtttttttgagacagggtctcactttgtcacctaggctggagtgtagtagcaccatcttggctcatgctcctcctgcctcagcccctcaagtagctgggactacaggcatgcaccaccacacccggctaatttttgtacttttagtagaaacggggtttcaccatgttggccaagctagtctcgaactcgcgacctcaggtgatccacctgccttgccctccccaagtgctgggattacaggcatgagccactgcatctggccgacttttaaaataataatcagagcgtttcctcgccaactgcatccctggttcctcccattgtctcctcctgtggtttctggtcccttctgtgaatggagacagcagcccctccgagcctggctgtcaccacaatccctggtatggaataggcctgccctgcaactgcagagtgtggtgtcgtcattgtcattcgaaagcctggggaaagagagttgcttttgtcatgaaaggtaagtgcagtccttgttatcacattcagtattttggtccgtttagcagttgcttagtaaccaaagcacaactgaccaggagatggaaaacttgaaattcacttccaggattgcctcacactgccaagtctgcaccttcccgcgtcagtgggactgatttttttataaatgatgtgaaatcttctggagatgaggcgtggttttccggatattcggtgtcctgatgaaaatccaaagccatgtgctatctgagaagaaatccagagagtgtgcactttccaggaggtgcccaagccccacccaggccccataaacctggcaggaactggactcgacccacatggaccccagccctgccaagccggcctctgtgtaaagctgggcccctggaactttgctcttctctatgcctgggcctttggccactggcaacaccaggtcgcaagtgaggagtggatgaaagcagccaggggcgggccagcacccccaggcagccacgcctccagcttttcagctccgcactcccaagatcagggagctgcacccagggagacggtgtcctcctgttgctgctgctcccggaagagtcaaggctaagtaagctacctggccagagggttttcctggttgccaagcagcagggaggagtcatcggcaaggcatctcagagatgggggccatccccttcccttccttcctatgttcggcagaaaggcattgaatgcctaccgtgtgtttttctccttcaattcgcttgagagacacgcagcagggctggcttctctgtcctcccaccgtgtacattgccagaaagagcggctggtatccctggaggacccaaacacacaagcaaaaacagctgggccccagaggagggcagtgcttctgaaagacacacccagaccccaacagtgggtgtgatatgaggcaggacagctgggccacaaagacaaagcaccacaaaggcactcagggaaacagaggaagatattggcagtgtgaagcgaaaccaacaggtaattttcaaatggaccaagtggaagtaacagcgtaaaaaaattgaataacttaggagcaaagaagaaaggatacattgccagctgggtctgatggctcatgcctggaatctcagcactttgggaggccaaggccagagggttgcttgagctcaggagttcgagaccagcctggcaacatagcaagaccccatctctataaacaaaatgtttttaagtaaataaataaaagaatcaacacaagcctggaaaataaagatgaagatatttcccagaaagtaactaaaaagatatagatgtagatgttagaaagaaaagaaaattagagatcaattcaggagctccaacatccacctaataggaattccagaaagaggaagtagaaaatagttcaggtgcagtggttcacacctataatcccagcactttgggaggctgaggtgggaggatcgcttgagcccaggagttcaagaccagcccggataacatggcaaacccccatctgtaccaaaaaaaaaaaacaaatagaaaaattagctaggcatggtgacatgcgcctgtagtcctagctgttagggaggctgaagtgggaggatcgcttgagcccaggagactgaggctgccttgagtcgtgatcacaccactgtactccagcttgtctccaaataaataaataaataaataaataaataaatagctaaagaccagttagatcaagttaaccttgatccagaaggcagcaagaaaaggataaagaaatagcaaaatataaaagaaaagttaaatgacatggaagacagaagtagctatgccaacaatatccaaataacagtagtctcaaacagaatagaagtattcaaatgaaaatagccagaattaaagaaagagagggcttatataggggcacactggagccattaggaaaagtgctcacctagacccacattcagtgtctcttcactcaccagccggaccagtccccatccacctcccaagttctgcagccagctctgctgatgcattcagaggaggatttaggcaattgtcaacctctgcacatcttgttgtgggtacgcagcagctatgtattttcattgtcatcttttaaatctatgacatagatgagatacgcaggacctaagcctgcatctctatgtgcccattccagcaccaggaaacttttaggggtctgaaacactagtggagctagtgaatgagtgaatgacggtagccagggcagttttgacctgtgtatgtggacattggaaatacacgataggtaactaactgaagtacaaaattgtgtttaaaacttgtgatttgggacaggcgcagtggctcatgtctatagtcgcagcactttgggaggccaaagcgggtggatggcttgagcccaggagtttaagaccagcctgggcaacatggtgaaaccttgtctctaccaaaaaaaaaaaaaaaaaaattaggtatgctggcgtacaccactagtcccagctactctggaggctgaagcgggaggactgcttgagcccaagaggcagaggttgcagtgagccaagatcacaccactgcactctagcctgggtgagagtgagaccctgtctcaaaaagaaaaaaaaaaacaacacaaaaaatccttgcaatttgccttaagtaaagtttgcaagcttttattttgtgtctgaaggagtttacgctctgaattcttcaacagggcgtcaaggtagcagctttctgcattgactggtgattatccttttctgatatgttttaagacccttaacacttttaatttttttaattaccatttgtagtattagactatctttgcacagcaatttttctgtcagatcttggaggtttcactttgagatgatacagaaggatgtttcatcatttaagaagccctgacccttccccactccctgcacccagcactgtattgcagaggcccagtttgggtatttatcttacagagacgctgccttcttcatgaaatcgtcctaaaaatagcttcatttaactaggccatttgacaggctttttcagactttttctcagaccagtctgaaagccggatattatttcaaacagatacaatgaacattgaacccgatcacaaggcatctgttaccctattcaggctgctgggagttgataagactacctcaaatcgctgtgtgtagttaaaggctgcaaaagcctcaggccacaaaaattccccagcccaggggcccggagacagtttttccaactctcagcgtccagggtgtaccttagcctgttttctgttgctgcaacagaacacctgaggccagggtgatttataaagaagataggtttatttggctcacagatctgcaggctgggaagttcaaggacatggccctggctcctggcgagggcttccatgctgcatcataacagtacggatagggtcaaaggggaggtggatgcgtgccaagagggacaacccagggaggttcctggcattatgataacccagtctcaagggaactcatccagtccctaaagtctggtcagagcaagaactcattcactgccaggagaatggcaccaagccattcatgagggcatccactgccatgacccaaacacctccctctagaccccacctcccaatgcccccacactggggatcaaatttcagtagcagttttggtggagacaaaccatagcagggtgggtgggtactctcacttggacgtgcctccttgggaccatggagcaggtttcggaaggatagaactctcattgtcaggcctgtccagcaccctgggctgtccccaggagtagacttgcccgtcacagacaggatgggccacatccaggactctggcatccaacgtgacgtgcagccctgtgaatacaggacaaattctagggatatagggcaaaagggacctatggcccagcattcagagagagctcacagcgtgggcacccagtgaaaactcaaacctggaaactaggactagggacagtgccacttcctgagacagagctgctgagagggtctgggaagggtggatggggtggaagtaggagatgaggttccctgggacgagaaggcattcaggcaggcggcgcaggtggaggcctagtgccgaggaaggcctggctctttggggtcccgcacgagatgggagttgttagagcacagggtcctgagaaagagtggcgggtaaggccaagaggaggaaggagccttggcatggaagggccttgcgtgtggctgagggagggattgcatcctgaaggcagcagagtgcaggtgcatgtggactcagagccacagcatgagagccctcaaccccaaccaggtccctgtggctgtaacattggctccatggcccttgggtatgctaaaaaaaaaaaccttccttgggtcacagacagttccagcctgtggccttctaacagagaccatcctcaggacctgcttgcagacattggggtggtggtctgcccgggtgtgctgctctaacctcccataggcttttggagttggccgtgcccttctcaaaaggactctccaggccgggcgcggtggcttatgcctgtaattccagcactttgggaggccaaggtgggtggattacctgaggtcaggagtttgagaccagcctggccaacatggcaaaaccttgtctgtactaaaaatacaaaaattagccgggcgtggtggtgcacgcctgtagtctcagctactcgggaggctgaggcaggagaattgcttgaacccaggaggcggaggttgcagtgagccgagatctcatcattgcactccagcctgggcgacagagctctgtctcaaaacaaacaaacatacaaacataaaagcactctccgcattcctctctcatgatgctctgtgttgggttcgcgtatttgccttcagattactcaaggaagtactttcaaaacagaaaaagggaaagacagaacctggacaattgcttttacgaccaggctgggccatagcaatgaacccaggctgtctgcactgcagcctgtacagtcccccaacctgtgtcaccatcctcacctgccctcctcacctccagttggccaccttctcctggtttcctcattcctggtgaggctttcactgccaagtgccttttcctaaagtagcctttccccagctcctcctctcacccccagcctggcaaacttctactcatccttcaaaaccccacttacctgtcacctcctctgcagccttccttgattccctcccacaaagagaatttatttctccctctttttttcagagcactctgctcagagctctttttgaacccttggcaggacatgctgtattttatatttttatggttatgtctccccaatgagattgggaccccatcaaaggcaggcaccccatacgcaccagacacatgattatcaaaagagcgcatggcatcagcaagcacatctcttcccccagtgtgagcccacctcctcctgctggacagcattgactcacgggtctgcacagcccttcccgagccctgagctaggaagctgtcccatcagtcaccccctgagccggtctccttgtgactaacctgctctctccctctcaccctcctagggccgacgagattgaaatgatcatgacggaccttgaaagggcaaaccaggtaggaccctggacgcttttagtcctaaaacccacaatagcgggcccgtttctggcatctcggaagatgcgtcacccgaagttagaaggccggttatccttccattttttactgacagctttcaacgtcgatgctccttctgttgtcatgagaagtaggaaaagacataaaaagtcctaggaaccatttccttggcaaagtctttgatgtggttccaacatctcagacatcccatggtgaacatcccctccaaagtggtaactgtctccttttccctactccatctctaaacacccgtctttgtagctgtggcatccatgacagtgtagacatctcaccatggaattatcctcggagagttccttagtgtagacatctcaccacggtgttatcctaggagagttccttagtgtagacatctcaccacggtgttatcctaggagagttccttagtgtagacatctcaccacggtgttatcctaggagagttccttagtgtagacatctcaccacggtgttatcctaggagagttccttagtgtagacatctcaccacggtgttatcctcggagagttccttagtgtagacatctcaccacggtgttatcctaggagagttccttagtgtagacatctcaccacggtgttatcctaggagagttccttaccgccacgttctcatgggtcgcagccacttgctccaaagagggctctcagctgacggcccctttttggctgacacttggtgctcagagaggccttatggcaagtacccagcacagtgtccggcccagatcaggcacaggacgcatcttaaccattagcgtacttttgggtgattctaaatactctgcttcctggaaaattcagccatccccaaaaccccttcctccccccaggagcccacagaacaggaaaacattttgctttagctggtgctgctgttgctctgaaaagaaagtggtcccccagccgggcacagtggctcacgcctgtaatcccagcagtctggggggccaaggtgggaggatcacttgaggtcaggagtttgagaccagcctggccaatatggtgaatccccgtctctactaaaaatacaaaatttagcaaggcgtggtggcaggcgcctataatctcagctactcaggaggctgaggcaggagaatcacttgaaccctggaggcagcagttgcagtgagccaagatctaagcctgggcaacagagcagaaactccatctcaaaaaaatacaaaataaaatttaaaaataaatttttactacccagccttgggctgggtgtagtggctcacgcctgtaatcccagcacctggggaggccgagatgggtggatgacttgaggtcaggagtttgaggccagcctggccaacatggtgaagccccatctctgctaaaaatacaaaaattagccgggtgcggtgacatgcacctgtcatcccagctgttcaggaggctgaggcaggagaatcacttgaacccagaaggcagaggttgcagtgaaccaatcatgccaccatactccagcttggatgacagagcgagaatctgtctaaaaaaaaaaaaaagcagttactggaaggagttaccttcatcatagatcactattcctatttctcaagtttccaccgactccacctctctcctcaaggccagtcttgggcatgccttgcctttagatggcactttagggcaatctaatgtgcccaacaggagagcctggtttgttaaacgggagagccttatcctgtgaatatcagtgctctatccagaacaggttctctgtggtctcagaggcagtccccagctacctaagaagtttggcaaagcgaatgcacttctcaaggtgccaaagccactcggtggaccccagtcttaggagacaccagacaaggctgtagggacaggtgctggctccgcaatgacacgggttcagttcctaactcggtatttcctgtgtggccttgacgggtctcttaatctcttaaatttcttggtcataaaaaaatcaaaagaaaagtgaaccttgaggccattatgccaggggaaatacgccagtcacaaaaaaagacaaatactgaatgattccacctgtatgaagtatctagaggagccaacttcagagagacagaaagtgccacggtgactgccagggacgaggagaggagggaaatacgaagttgttgttaaatgggtacagagttttggttttgcaagatgaaaacattctggggattcattgcacaaccacgtaaacgtccttgacgctactgaaaagtacgctaatggttaagatggtaaattttatgctttgcgtagtttgccacgatttaaaatatgttaaaaaattttttgaaagaaaggaagggaatttagctaatgcttcctttgcaagattgtttcgaggatttgaggtaaaatgccagagtaaaaagtagatggtggccgggcgcagtggctcacacctataatcccaacacttggggagaccgaggcaggcggatcacttgaggtcaggagtttgagaccagcctgggcaatttaacaagtcccccatctccataaaaaatacaaaagttagctgggcgtggcagtgtgcctgtagtcccagccactcgggaggctgaggcaggaggatcgcttgagtccaggaggtagaggttgcagtgagctatgattgcaccactgcaccccagcctaggtgacagagtgagaccctatctcaaaaaaaataaaagaagtagatgcctaaataaatgttagttccgtagctgctgaagaagctcaggttttgggggaattgtaaagtcctgccttcaggaaagggtggtgaggggtagaggtgagttctcaccaacaactcagccagagtttatagcctgatacggctacattaatagaaatacagtttctagaatgaaggaggtggtgattctgctcattggcagcaaggagtccgtgcctaggaaattccattttttaaatttatttatttttcttctttgaaatggaattttactcttgtcatctaggctggagtgcaatggcacgatctcagctcactgcatcctccacctcatgggttcaggcaattctcctgcctcagcctcccaagtagctgggattataggcgcccaccatgcccagctaatttttatagttttagtagagacggggtttcaccgtgttggccaggctggtctcgaactcctgacctcaggtgatctgcccaccttggcctccctaagtgctggggttacaggcaagagccaccgcgcccagccggaaattccattttagactggaagccacagtataaggaaaacagctccttggagtgcattcagagatgactccatggccaggacagggaggggctctaacataaaaagaactagggggttcggagacgttcctaatcttggggtagcagggaaagacggcagcaccactggacagcaggagcaagaggaataatttcaggaatctgggacgcgaaaagataagggggaagggtcatgggggcatttgtgggttctgtccttgtagttctcaagagccgaccagaaagaaaggccaggggacggagccaggctttttctgagagacccctgtagaccccagccaagcatagaggctggcgagaggaaacttttttgtttttgcttctgagacagtcttgctctgttgcccaggctggagtgcagtggcacaatctcagctcactgcaacctccccgtcctgggttcaagtgattcccctgcctcagcctcccaaatagctgggactatgggcatatggctccccatcctgggttcaagcgattctcctgccacagcctcccgagtagctgggactacgggcatatggctccccatcctgggttcaagcgattctcctgcctcagcctcccgagtagctgggactacaggcatatggcaccacgcatggctaattttcttatttttagtagagataactcctgggctcaagcgatctgcccacctcggcctcccaaagtgctgagattacaggcacatgccaccacacccagctaattattgtgtttttagtagagacggggttttgccatgtttgcccaggctgctcttgaactcctgggctcaaacgatccacccacctctgcctcccaaagttctggggttacaggcatcagccaccatgcccagccaggaagcttattcccagtggtctggctctccagagttgccacgctgaaagatgcttgctctggagagagtgagctccctgtcaccagagctatgcaagcagattcaggccagccctcccagagagcatgagatggggaatcacgcacagagtggaccgaaggagggattgaacaagaaggctcaaagggtcccttttgaccctgaagtctaggatttcgtgaagctacaggtgaacccattggcatgagaagcatccagggaggaaagatgcaagcccttggaatatcgagagaatatttccagcaggaaaagaagtggaaggttaaaggaaagccagagaaggggacgttgccctgggccatcaactaagagaaaagctgcccagagccaggcatggtggcggcggtgcctatagtaccggcagttggagaggccgaggcaggagcatcacttgagcccatgagtttgagaccagcctgggcaacatagtgagacttttttctctacaaaaaagtttaaaaaaaaaaaaatagccaggtgtggtggtgtgcacctgtggtcccagctaacccaggaggctgagatgggaggatctcttgggcccgagagttcaaaaccaacaccagagatgcgggtcagagagtgggctggtaggacgggacctggccaggcctgtgggagggtctgagtatgaaggattcatcctgggagcagtgaagaatcgtaggcgggattgagacatcaggtttgagttctagaaggatctctctggctatacattggagaacagatgggagtggaaagaccagaagccaggagagctgtgggaggctattgtgtaagtatggggagagatggcatgggcctgagctgaggccatccctgcggaggtgagctggaggcgggctgggcaggaagaggagggcgcagacacagtccaacactggtgcaggtggcaggcatctggaccaacacctttcccatcaggaaaccccccaggaggagcaatttactagctcactggcatacaacattcgttttccctgggtgtgtagttagaatgttctacggagacctgaagtgctcgtttattgctcaaccactgtgctcctgttatggagaagtagcagaggggtcggcacctgtcagttatgtccgagcctcattcacacctgtttgttgaacatcagggcactggcataaatactcactgtcccaattggtgacagtaaaggatcagatctcttgagacttcatggtcaataagaagccacagctttacactttgaactgcatgtgaaaccccgtcccgtccgggggctttcagcaattcacagcctttttgtggtgaaaaaaagtggcccgcccaccacccctccggggcctcctttctgagcagtggtgatccgagttgctggtgggtctcaaactcctgggctcaagctatcctctcgccttggcctaccaaagtactgggactacaggcatgagctactgcgcccggctttgaagccagcatttctttactacctacgaggcctgctcagagtccgtgctcaaaaagatgtattgaatgaatatgggctttgacgcacaggctggagcgcagtggcatgttctcctagcccacagtggggctgggagggagtcattgaagtgagctgccctcttcctgttcacctgcctggtgtttatgtcacaagactgccctagtggaggactctccaggttgaggttaggggttggaaaccacagctgaccctcaccacggagagtgggtctccatggaggccttggccactggtgcagcatcagcgtgggacacgtggtggtcagcatttggtctccagctgtggtagctgttcccgacctccttcctgcagagtcagtgacatggagttacctctgggagtcgagatgttcactgtaattgcatgctgcgggtagggcagcagggccttagcccatcatcagctcctgggtctactttgttcctcgggggacttgctcatctctggtgtcctcaagcctgagttttaatggccatgcaagcagagaacaagagacaaaacctggggccaagaagggggtggaagattggatcagagaaaacccccctcccccgccatataaaaccagggacttcaaaggccacactctgaaagtgtaaactggcagggtgggggaaggagtctgcccttaaaggggagacggtgagggttctctcttgttggttccagagggagaagaaaatgagcctcccaagagaattcctaaccacagccacctctccacaggtctggggccatgtcgcacatgagaccccccagccctctccccacaccttcgccccaccaggctgcagctggcccaaggccctgtctttatcctctgcaagcccacccctctctgtgtccttcccatgatgccttaccacgttttatgagtcaaattgttcagactttagaggcctggaagtagctgtctacatcctgtattcacatcccaatcgggcactgcggttaggggaaagcttttttttttttttttttttgagatggagtctcaccctgtgacccaggctggagttcagtggcgtgatcttgactcactgcaccctccccctcccagattcaagcaattctcatgccaattctcatgtctcagtctcccaagtagctgggactacaggtgcacacccccacgcccagctaatttttgtatttttagtagagacaggatttcaccatgttgaccaggctggtctcaaacccctgacctcaagtgatctgcccacctcagcctcccaaagtgctgggattacaggcgtgagccacagcacccagcaaaagcatttacttaccatccttcctggggcctttcagggacccttgagggatgggcaggggttggggggcccgtggaacttcttctaggatgaggtgacctcgtggacccctggttccggctctccttccccaaatcacccagtgaggaatatgacaccagcccagggagcagaaaagcctccttcaccttccccagagaagcgaggctcccctgggtctcacggtggaaaccatctctgtatttgctggcttgactctaacaggaagaattcctgagacacggtgtcgctggctgcttgctacctcccaggtgactgctgaggggaggcagagtttaacctgatgccagctaagagtaatttcccccaaaagggtcttccattttgagatgaggaggatgtgaggtgtgcctggggccacacatgccagggaccttcgtgacaatgtcctggacaccatcgccaggtgatgggcatcggcttgtgtgagccccgtggccaccagtccccttgccgggtggctgttttctgccatcgtggtctgggttaccactgatatgcaagcagtatcctcctcgcccctgtgtttctagcatcaactctgatttctcagcaaatgacagagaatagacaagaaagagcaagaaagatctcccaggacagtgctcaggcttggcgaggggccgttctcatggtggggcagacacaaaagtagaacgagggctcccagtggccctgtctctgcagggacacaggaggagacgggagtccggcggtgaccacagggaagtgatgtctcagggccgccaccgctagatctggggttccagatctagaaacacagctacagctggtttaacaggggtcttcaggaagacgccagagcctcaaaaccagtgtcaccacacgccgacccgggacagggcccccttcttcctgcctcagctgccaatgatgggctacgcttacttctcagctcctgaaatgaatttatcccagctccagatcagtgtctgtttccctgttccttcctttcactgccattaggcctgtttttagtttgaattctcctgtttcgtggatctcaccacacaaaccacctcaacgcttcattttgtgagttttgtattttttttcgacgccctcaggacagaaatcctgaataactatgtgatcagaaagttgcgtgaaagtaacgaaggcaagccacaagtgatagaagtctgacaccgtgaccgccaacagatgggccacagagagactgtccgtgaacttggaaactgattgcaagtgcaaatgctccacagaaattatgcaatcaggccgggcgcggtggctcacacctgtaatcccagcactttgggaggccgaggcaggtggattacttgaggtcaggagttcaagaccagcctggccaacatggtgaaaccctgtctctactaaaaatacaaaaattagctgggcgtgatggcgggcatctgtaatcccagctactcaggaggctgaggtgggagaatcacttcatcctgggaggtggaggttgcagtgagccaaaatcataccgctgcactccagcctgggcaacagggtgagactctgtatcaaaaaaaaaaaaagaaaagaaaagaaaaagaaagaaattatgcaatcagaaattgaaatcatcaacagctagatcccttcttttgtgaaccatcaccctgtgatgagatggtatccgctctgaacggctaaatgcctgcttgagaccatgtaggctcccggggacaccttgtaaccagatgcccgggacttccccagcgctggccgttccagaacacttcagagccagtgttacaagtcagggtggtgaggccacctccttggctgccaccagaacagcttctccactaggctaagaaataggttttctagcccaagagaccaggagaaatatctccaaatacatcttattccaggcagagtcttagatattttctgcccaagagttgaactgaccagcaagggaggcgtaagctcttcagtgatttgacgtgatcatcagaaacacttggcatgacacatctggaaataaactgggaaaaatcttttttgttgaagaggacatttttctgtagtcttaatagttgattaggtcggatgcagtggctcacacctgtaatcccagctctttgggaggccaaggcatggatcacctgaggtcaggagttcaagaccagcctggccagcgtggcaaaaccccgtctctacaaaaaatataaaaatgagtcggttgtggcattgtgtgtctgtaatcctagctactcgggaggctgaggcaggagaatcgcttgaacccgggaggcggaggttgcagttaactgagattgcaccactgcactccagcctgggtgacagaatgagattccatctcaggaaattaaaaaaaaaaaaaaaaccagttgattaattagcatgaaccagaaatcacctctacagtcctggacatacaggtcaccttgccaccttcctgatggctggttctagattcagtgtggacgagagatagtgacagaggtgacctgcttgggcctagacacacccacccaggcaccacatgaattcaactgaatgtaattccaagagctcctggagaggcaaggcaggcggccaccagcaccgccctgggcggacggaactgccattagaaatatcctaaattggctgggcgcggtggctcatgcctgtaatcccagcactttgggaggccgaggcaggcagatcatctgaggtcaggagttcgataccagcctggccaacatgtgaaaccccatctctactcaaaacacaaaaattagccaggcatggtgggcacctgtaattccagctactcaggaggctgaggcaggagaatcgcttgaacccaggaggtggaggctgcagtgagccaagatcatgccactgcactccagcctaggcgacagagcgaggctctgtctcaaaaaaaaaaaaaaaaaaaaaatcctaatttgtctgtatgcagggcaaatagattcaatgctgttgccacagaattgcttaaagctgccaaagccactcctcctagaactagattaatcagccagttccaggacaggccaacttcttgtttgtctttctgagtcctttctcagccattgttagccacacgctgccatgccacaaaataaaacacacgatggagacgctgcttggccaggcttttcttttcttttcttttcttttcttttattttcttttcttttcttttattttctttttttttttgagatgtggttttgctcttgttgcccaggctggagtgcaatggcgtgatctctgctcaccgcaaacctctacctcctgggttcaagcgattcttctgcctcagtctcccgagtagctgggattacaggcatgtgccaccatgcccagctcattttgtgtttttagtagagacgaggtttctccacgttggtcaggctggtctcgaactcctgacctcaggtgatctgcccacttcagtctcccaaagtgctgggattataggcgtgagccaccgtacccagccaattttttgtatttttagtagagatatggtttcaccatgttggccaggctggtctcgaacccctgacctcacatgatccacccgcctcggcttcccaaagtgccaggattacaggtgtgagccaccatgcccagcctttggccaggcttttctgattgaatgtttctagcagtggaatgtaagtctgggaggaagaagcagaactttcacctcagcccacgtgtcccatgtcattcgccaccatctcccacctgtcttagaactgtgcctcagtcctaagtattaagccggcacaaggccattcacaaacgacctctgcctgagttgtgtgtcctgggcacttccgtggctagggaccgtgttcccattttccagacgggtaggcagcagctcagtgagtttgggtaacttgccatggtatgtcttttcccagacaccctgtcgggtggtgggcactggggtgacctgtcctcgtcatccagtgggaaatccccatctgctctctgggggtggttgtttccttgttcaggaattgcaggcaaatgatggaaaagtccactcatttgtcccgcagcccccagcactggtctatgctgtcctgtctacgtcctcggattggcctggttggctgaaaatgccaggatcagcattcaaaacactttgtccagtgaagggttaaatatgttgaaataagcccggcctttacaaaagcagtggcatttacatcctgtacgtttatggaaatccttgctgaagaaaaacaaccacaacattgtttgtgcgtgtttttaggaagagaatggccaaagtgtctttaattcactgtttacccgtgagaattactcccaggagtaatcccgcaataaaatcttcttggtctatgagaatagaaagaaattgaatcaaaagactcgatttccacttgtatttattcagtctgggaaattcagtgggccggagtattagtatcagcaggggattcctttgctcctagcgttaaattactgtcataatcgctcaattatttcttccttgtactgtttaaaataaaaatccatcacattctgtgttttttttcctagcatttattaggttgagtgtttaggaaaatcaattatagtcagtcaggcatgaattgatgaatgttcttgtaataattgtcagttgttaaactgaatgtactttctctttcaccccttttcatttccttcagagggcagaggtggctcagagagaggcggagaccttaagggaacagctctcatcggccaatcactccctccagctggcctcacagatccagaaggcaccagacgtggtgggtagccccggccccgtgggggactgtccccgcctggcctccgcaccttcgagttacagccgcttgctcctttttgttttcagcatctctttttgggaatcacgttttaactagtactgctttctcggtggggtttgctttgaccaattgggggccggagcttgttaaagtcgaaggaagagctttgctaactgtgcgtgggtgggctgaggctagcgtggcatccacccagggccaaggtggaggctacgcaggcacagtcacagacacagtcacgatgccccagccaggcctgggggtgtgatcgctggcatgcgggtgcagacccgaaccaggagcctctccagaatgacacggagaaattgagggtttccgctgtgcctttccaagatgaggaacagttcaggatgagctgggagggtaggggtgggcgggcagagaggtaataaaataacattctgcaccgagtttatagagcaggaagagtgggtatcacaccacttttttgcagcttgctttttctgaaattagcgcaaatggctcttagcccaaacattcccagctcgatcaaggtggctttgaactatgggtttccagactctctttcaatgctgtatagggacaaggaacagcgtaggagctaagaccttgggtgttggagccatagcccccagtgcagaccccagctcagcagtctggtgatggggacaaaggagcttaacgtccctgagtctccgtttccccgcctgtaaactggggggttggtgcgaaagttattatgagcaaataacttagagcaaagctggacatgtaataagactaagtaaaccttagcagtaattctagttgtagttggcaccattatctctgatccctcagttttgggttttttttttttttctttttttttctaagacaaggtctctctctgttgcccaggctggagtgcagtggcgcagtcttggctcactgcagcctccacctcccaggctcaagggatcctcccagctcaacctcccgagtagctgggactgcaggcgcacaccaccacacctggctgattttggtattttttatagggactaggttttgtcgcgttgcccaggctggtctcaaactcctggacttaagtgatcctcctgcctcagcctcccagagtgctgggattacaggcatgagccaccacgcctagcctgatccctcaatttctagcacataatttcatcactagttcacttacaaacctcagttttcccatgtgtaaaataggaattaagtgatcacaaggccgctctatggagccctcatcctaaggttacaatgagtacatatcagttgtaggagtccttttatccaacagtgactccgtcaagcccttgccgtatgctagggcttgtagtggacacccgaagaaccataaggagtaagatgaggctggttgcagagagtacagtctcatcagaagaacttgctcttgtaataaattcaatcattgacaatcattatttccacccaatctgtgaaacagaataccgttatttcttttttttgagagagagtcttcttctgtcgcccaggctggagtgtagtggcgtgatctcagctcactgcaacctccacctccacctcccgggttcaagcaattctcgtgcctcagcctcccaactagctggagctgcaggcgcataccaccatgcccagctaatttttgtattatttgtagagatggggttttgccacattgcccaggctggtcttgaactcctgtcctcaggttatccacctcccaaagtgctggggttacaggcatgagccactgcgggatctcactcggtcacccaggctggaatgcagtggagtgatcatggctcgctgtagccttgacctgggctcaagcgatcctcctgcctcagcctcccaggtcttgaactcctgtcctcaggttatccacctcccaaagtgctgagattacaagcatgagtcatcattcccggccctatttttttatatagatgaagaaacaaaacctccatgaatgtaaacaccttttcccaaagcacagtcaatctaatggctgagctaagacctgaattgggcgttctggcaccccagactgtggcttttaaattattccccaggaatgaatctagatcaaggtattaagactcccttctaagaaaagattttagccttctttttaaaattaacattaattaaaacatttgttgctgggcgcagtggctcacacctgtaatcccagccctttgggaagctgaagcaggaggatcacttgaggccaggagtttgagaccggccagggcaaaatatcgaaaccccatctctacaaaaattttaaaattagctgggcatggtggtatgtgcctgtagtcccagctactcaggaggccgaggcaggagaattgcttgaacccaagaggcagaggctgcagtgagttatgattgtgccactgtgctccaacctgggcaacagagagaaaccctgtctccaaaaaagtaaatatgagactgggtgtggtggcacacacctgtaatcctagcactttggggggccgaggcgggcagatcacctgagatcaggagtttgagaccagcctggccaatatggcgagaacctgtctctactaaaaatagaagaattagctgggtgtgatggtgggcgcctataatcccagctactcaggaggctgaggtaggagaatcgcttgaacctgggagacagaggttgtgcagtgagatcgtgccattgcattccagcctgggcgacagcaagactccatctcaaaacaaaacaaaacaaaaaaagatatgattgaagtgttcctggatgtagagaaaagatttgcattgagcaggccatcacgtccttcatacttcatggactctggaacttaattttaactgaatgtccccttggctctgttacagttccttcctctaagtttagacaaactggatccagcaccatggctagggtgggaggcagccttcaggacagggtcagcggcttcccctggcccctggggtcctgcttcattctgcaaaggaagtcgtccattctgatgtgtctacacggggcccctgagctcagtgttttggttgaaaagaattctggcactatcctggactgcagcaaccaaaacatttcagaaggaaatgaatgtttttgcaggtagagtccgttgtggatcctaggggcgcttaaacacttcatcatcggttaagtgccgtgtttacatggcaccggttcagtctccccagagcagccccgtggggctccccgcgggcgtgtattcccacatagccagtgggttccagctgcagccagttggggagcaaacataggaaactgggccagcggaaaaatggtctgttgggcttggctggcagaatgcagcagagaaacggtggagtctgtagatctagcaaaggccaaaacccatccattgggtatcccagtggaatctccgattctagaaggtgagcggtcactgagtgagctgctggcccaagtttgcagccatgctgggctttgcatagttttgtttgtttgtttgttttttagtgagatgtagccccgctctgtcacccagggtggagtgcagtggcgcaatctgggctcactgcaacctccactcctgggtttaaccaattctcctgtctcagccttctgaatagctgggattacaggtgtgcgccaccatacctggctagtttttgtatttttgctagagatggagtttcaccatgttggtcaggctggtctcaaactcctgacctcaggtgatctgcccacctcagcctcccaaagtgctgggattacaggcgtgagccaccgcacccagcctccctaaagctttgaaggccacctcttcctctctctgatttcctctctagcttttgcccatgtctctcccagccatcaccctatggactgacaggccgctgcttctcatccaggccccctggatcgctccccaagcccctctctgtttctttcttcattctcccttatgtccttgtgacagcacaactgggagtgcccactgtgttgagatggagtgagccacagtttcagataaaggaaggatgggccaggcgcagtggctcacacccataatcccagcactttgggaggccaaggcaggcggatcacaaggtcaggagttcgagaccagcctggccaaaatggcaaaatcctatctctactaaaactataaaaatttgcctttgccaggcatggtggcatgtgcctgtaatcccaactactcaggaggctgagacaggagaatcgcttgaacctgggagggggaggttgcagtgagctgacgtgacaccactgcactccagcctgggtgacagagcaagactccatctcaaaaaacaaaaacaaaaaaaacagatagagggaggatggtcatgtctgtgtcatttccaaggtcttactgctttggggttcattttcacctcatttagttcgtgcgagacagcgatgatttttgctgttttatgaaggaggagtttgtggcttgagttgctgggagttggccagtgtggccgagctcttgtggccatgcccagccgggcgcaggagttgagccctcgaccacccgctgcccggtccccactctgggtccagggacagcactgaaatccacacctttgacctgtgtcactggaagcacctgtcccagatacattcactttgacttgcgccttgtaaaacccacattcccttggctggttttactgacccttttcgtaaaagccctttaatcagtgtctatggccagcacccctcagggtggaagattaagatgaagacgtgatatagcatgattcaacctgtgcccagactgacctccctacatgtcacttctgccatgtcccctccttgctccagagctggcagggactccccagggctgccaccacatgtccaggcgcctctggctacccctggcagctgtcactcctccagccctgccccacactcctgccagcctctgcacctgcctgcatgtcctccgcccttccccggcacccaccctgagatggagccccctttccttccgacaaggtcccgccagccctcccgaggcccacccattcccccctcctgtggctcagccccacgtgccactgtcctggtcctcctaccctggagggctcgtgacgttggccctgcccggcattattcagagcggtgctttccagactccctgtgatggacagttttgttttgttttttaaatttccagtctgtggcagactgatcgttttatataaaagacatttaaaatgtcaccgaaatgccgaatcgctataaaagtttctaaacacttattctcgatttctgtaattgcctcactgtgcaccagcaacagtttgcaaattggcaacgatccctgcagctcacgctgcacagaacgggcctggacagcctgtgcctggtaaataagccgacaggagatgctcgctccagccccccagggccacgcgcacagctgtcagaggtcaggagaaccgaaacacctcttttacaacctcatacaaatcaaagaagcaggaaggagtaccctctttgcacacaaaactttacagacttaaatggtaaaggcctcattttccccgagggagatataaaacattatttccctgagtgaatgcctgcctgtccccaaatttgaaaatccgtggtgagcacacggtgcatgggatggcccagctgtacctgccagctggggccacggtgccaccctttccccacaatacaagcaagatcaggacgtgaaactgagcacttcagaggggggacagcggcaaggacagtggctttctgtgttacagcatgagctgcccccaggattcggctgtcatagacaccatgcagctctgccctctccacccctgtccccgtctgtcatgcccagaattgcatctgccctgcagaaaatatttcagaatctttcaggagccaggattcctttttttttttttttttttttttttttgctttgacacagagtcgctctgtcacccaggctggaggtcagtggtgcaatcatggcccactgcagcctcaacctcctcaagctcaagcaatcctcccgccccagcctcctgagtagctgggactataggcatgcaccacaatgccttgctaatttttgtatttttttgtagagatgggttttcgccatgtggcccaagctggtctcgaactcttgagctcgggtgatccacccacctctgcctcccaaagtgcttggattacaggtgtgagccacagcacctggccccgtgattacttttaaaggttgaaaaaagtactacttgagtcattgagaagtagaattacagatttgactttttcctttttttttttttaataccttagcttttttctattttgcgtattttccacaatgagcatttagtgaggttaaggggtgggtagccaggtttttttcacatcaattatcctaagagttcttcaacaaaggaacaccaaatatacattttccacatcttttaattcttttattaaataaaatactggccgggcacagtggctcatgcctataatcccagcactttgggaggccaaggtgggtggatcacttgaggtcaggagttcgagaccagcctggccaacatagtgaaaccccatctctactaaaaatacaaaaatgagccaagtgtggtggtgcccacctgtaatcccagctacttaggaggctgaggcaggagaattgcttgaacgcaggagacggaggttacagtgagccgagatcgcgccactgcactccagcctgggcgacagaccaaaactctatctcaaaaaaaaaaaaaaaagaaaagaaaaagaaaatgctgatacagagttttcaatttgtcagacaatatctcagcttccgggtaatttaacagtgaatctcaaggaccttgaatcccaccttgtggtggaaaatctcggtggtttgggagcattggagggaggcttcctcctctgagccacccactctgctgttcccctgcctggagcactcttccctcttccccaacgctcagcagcccctccccacctcctcctcctccaggtctctgctcacacatcaccatctcagtgagtcttttcctggccatcttactaaaccccctgcctctcagctctgactctggcctctgttttaagtctcctttgacagtggtcaccccgcacacttttcattactaataagtgtattttctgcatctcactcatcctgccgcatccctgctgggctgtaagccctgggaagacagggacttttctcctgtttttttttgtttttttgagacagagtctcattcctttgcccaggctgaagtgcagtggtacaatctcagctcagcgcaaccttcttctcccgagttcaagtgattctcctcctcagcctcccgagtagctgggattacaggtcaccaccacgtgcctataattagcccagctaatttttgtatttttagtagagacggggtttcaccatgttggccaggctggtcatgacctcctgacctaaggtcatccacccaccttggcctcccaaagtgctgggattacaggcgtgagccattgcacccagcctggactttctttgattcactgctatatggttggtacatggtaggcactcagtacatatttgtccagtgaatgaatcgaggtggcagctaaccacagggggaggaaggttgcataggggaagtgcaagcaagggcaagaagtgacatcctgccatcaccatccacacactgacatctgtgcagcttctgtctcagttgccagcacaggtagcctcgagcacccgcctcaaggccagcgcagttttgtcatctcttttctcctccccaggagcaggccatagaggtgctgacccgctccagcctagaagttgagttggccgccaaggagcgggagatcgcacagctggtggaggacgtgcagagactccaggccagcctcaccaagctgcgggagaattcggccagccagatctcacagcttgagcagcagctgagcgccaaaaacagcacactcaaagtaagggggctgcggggcccgggggtggcccgaggaggcagggcggatggctggacacacgcgcacacacacaccctctgcctttctggacttgatagcaagtgtggcaaccttgaacctctgtaaagtagcaccaagcagagtcccggagtccatggcagggagactggatgttaaaccctggcatcagcccttgtgtaaacagcatttccctctttttttttggagtcggagtctcgctctgttgcccaggctagagcacggtggtgcaatctcggctcactgcagcctccgcctcccaggttcaagtgattctcctgcctcagcctcccatgtagctgggatcacaggcgtgcatcaccatgcccggcttatttgtttatttatttattcattcatttatttttgagacagagtttcattcttgtcacacaagctggagtgcaatggcatgatctgggctcacagcaacctccacctcccaggttcaagcgattctcctgcctcagcctcctgagtagctgggactacaggcgcctgccaccacacccagctaatttttgtatttttagtagagatggggtttcgccacattggccaggctggtcttgagctcctgacctcaggtgatctgtccacctcaggttgccaaagtgctgagattacaggtctgagcctctgcacccggctctttaactgagttttgcagggcatcctagctttctgaggatacccctacaggaggagctggtgtactataactccagcacttccggtgcatgagccaaatgaaaccccagaggtccatggaagtcacatctgaccttctaagggacattctcttgtccaagcaccttttccctcagtggcccctgtccaggtgctgcttcagtctaggctccctcccactaggcactcttggcttttccataaatttctatcccagacgcagaacccagagctttttccacatattaaaaagtaatgattatactttaggtatttatgatccgttgaagcaagtgtaatttgaagagggtcctgggacccttgattcacaggcttcagagccaggggagactctcggagttgtctgtcttgacagcgaagaaggcaggaccttcagggcagggcttcagccccaggccaggggttccctgctctgcccgggggctgcccgttcaggcccattccttccccaacccggtacctccatgttgggtgggtgagggaatgagtggctgtaaagtatattcattgtatgaataaagtgggtcagggttcattgtgaacatttaaaggaaaccttttctggtatgaagtagtcctaggatgtacttaggtccattgtgttttgtcgttgttgttgttgttgttgtttttgagacggattttcgcttttgtcgccgagactggaatgcaatggcgcagtcttggctcactgcaacctccgcctcctggattcaagcaattctcctgcctcagcctcctgagtaactgaactacagtcacgcgccaccatgccagactaacttttatatttttagtagaggcggggtttcaccatgttggccagtctagtctcaaactcctgacctcaggtgatcaccagcctcggcctcccaaagtgctgggattacaggcgtgagccactgccttttttttttttttttttttgaaacggagtctcactcactggcccagactggagtgcagtgacaggatcatagttcacggcaacctcgaagtctcgggctcaagcgattctccttgcctcagcctcccaagtaactgggaccctgggaccaaagacatgccccaccacacccagctagttttttaattttttgtggagatgggatttcactgtgttccccaggctggtctgggacgcctgggctcaagcaattctcccacctcggctcccaaaacactttgggattataggcatgagccgctgcacctggcccaatgtctttttttttttttttaattgaaattttctttttgacacatgaccaaatttataccaagactaagtttccagcaatctattgcctatgctgatggctcccacgaccctccctcactcctttcttctgcctctttggggtgaatttcacccattcactgagaactgcccagcgccgggtcccttggaggagacagtcctgccgactttggggaaatggttgaaacctggttctgtctgtcctcagccaggtcgttttttttaaatttttattttattttattttattgtattttattttattttattttattttattttattttatttgagacggaatttcgttctgttgcccaggctagggtgcgatggcgccatctccactcactgcaacctctgcctcccatgttcaagtgattctcctgcctctgcctcctgagtagctgggattacaggcatgagccaccacttccggataattttgtatttttagtagagatgggatttctccgtgttggtcaggctggtctcaaattcccgatctcaggtgatccacccgcctccgcctcccaaatgctggaattgcaggtgtgagccaccgcgaaccaggtcatttattttgtcaccgccgtttcttcctctctcatcagcttacccaatgagtaccaggattcagtttttatttctacatttaatctcattttctcatgttacagccatttctgaccccagcaacggcattatgatgagataatttgcctttctctccattgtcaagttaaagggcgtgactcagatacacaccggctacaagagagcaaagctgtagacctcacattttttattatagagcaatttcttccaaatcagttaaggtttcaatgtttgccttcacaaaaaaatgaaacgcggttttgcaaattaatgttcgttatccgtatcttgggggaattgtttaataccgtgcagttaatgaaacaattcagcgatacttcttccaaaatcattgctaccttatcttcatctaatctaataatcaaaacatatcttctagtaacaagacttctgattttaattatcttaactccttgttgccagattgtcctgatacgaaacccacatgcagaaagcatctgacttcaccaaaccagggtttcctctcgccccaaaggaataaggttaattgaatgagatatgttctgagggctttttgtttttcctaatgtgtataatgtatagcctcaaatataacctaaaggaatacaattattaggaaaatatttttatgaataagacttggcaaattggcaacctgatgcttttgccatggggaaccctgcccccgcagtcttggctactcaaagaactcacctttacttaccacggagctgctttctttctttcttcttcctgtccccttcccctctttcatgtcttacgggggaccctcggacacacgatggggccttgaatcaggttgctgtttgggagaggaggctccaagctcccagctctgggctcagctgtttggagttgcaggtggttttcccatgaacacttggcagcaggtccttgatctttgagacatgtgccagggtgtttggtgacagtcacttggggagagggcatttcccataagcagaaggcttattgggcagaatcttttgtcctgagttcactgagttgtttccacccatactttccaatgatactttctgtagttggatatatcagaggactgactaattggttttctttctctaacccattgaaattctccatctttctgccactgagatttctcctcttccctcaaatttgatttgttatttcacaaggataccagacagctgcacatcttcgagtctgtcctgtccagggctctactttttcaagcaaagctccccataaatgccccgctatccacgtgtgtcatgggacatcgctaacctttaattaggcatggaaacagacgcaaaagtggaagatgtttcctcctgcctaatctgacaagtgcttaagcatagtgccacttgtaaagaagaactgtttttgcaattaatgaaatagcccgaccgccgtgacaaggctgctttttgataactctctattctgtggtcttctgttggaatgctttaatatagaagcagtataattagctagtcaactgcactgtacttgctacagcacagaagataatgctaccaatagcttcgatttaaaatagatatttataagaaaggctaactaaaagaacaccagtctcccagaaggagaaattatatttttctagagatgcgttaaagatcagtgcttcccactgggtggatggtcacatgcgttagaatcacctaggggtcttttccaaactgcttctctttccccactcctgaggttctgatgggtcccatggagacactatgggatgatgctgtgtccctcggggcactgaggtggtataaaagaggtggtataaaaccgtccctctggccttgggtgtctctcttttcatcttgcattctcggagcccaggagttcaagaccagctaattttttgtatttttagtagagacagggtttcaccatgttggccaggctggtcacgagctcctgacctcaggtcatctgcccgcctcagcctcccagagtgctgggattacaggcgtgagccatcgcgcccggccccatctcttaatttttttttttttaatgagccagagtggtggcacatgcccgttgtcccagctacctgggaggctggggagagaggatcattggagcatacacagcacccaccccattgctttggagatttggactcaccgtccagagtccacagtatccttgggctcctccccaactcccagcatcagcagaacctaaatctccatgcctgctgcctctgcctgaggaaccatggagacacatgtccttatctatggagagtccttgtccagtagaagaggaggtgcatgctgcccaggcctggaccccagagatgcagtgtcagctaagggtctgtgcctcagacccctgccctgggccagggggtccccgtgagaccgaagactcccacaccaactctaacctgagccagtcagacagcaccatgtggagcctggccccatttatctgcactgcagatgccactctgcccccacggtcagaattttatggaaaagagatattgtcaccttgaccactggctgtgcaacctggaagacatgacctttccctgggtctctgccttagtcagacctgccagaggcccctttgctgtttttttgagacagggtctcactctgttgcccaggctggagtgcagtggcaccatcatagctcactgtagcctcgacctccctggctcaaggaatcctcccacctcagcctcccaagtagtcgggactacaggcacacgccaccacacccggcgaatttttatatcttttgtagagatggggtcttgctatgttgcccaggctggtgtcgaactcctgggctcaagtgatcctcccacctcagtctcccctagtgctggggttacaggcgtgaaacaccatgccctgcagtagatagacatagtttatagattaaacacctaatttgctaaagccaaaatagttggcattgtaaagtttattatcatttaagtcttagccaggcttttaagagcttcaaatagacaattcttctggcatttcaggacccagctggggagcaccagctaggtttctggagccatgtgggctccgtgtatcttttccatcgtattattacaacaggcgtgtttgattggcacttgatcatcctacatctcaccactgtcctttgaaaacccatattcattctgaatctccccattcttcagatgagaaatgtgaggcccaaacaggctaaggttatccaaggtcacagtcagctagggtaggaccaggttggcagccaggtctctgacacttggccttttcttacctgtctgtgtaaagcccacgtgtgttccttagattcatgcattttattttattttatttttaaagacaggatcttgctcttttgccccaggatggagtacagtggcgtgatcataattcactgcagcctcaacctccagggctcaagtgatcctcccactttagcctcccaagtagctggaactacaggtgtgcaccaccacacccagttaatttttaaatttttgtagagacagggtctctctatgttgcccctgctggtcttgaactcctaggctcaagcaatcctcctgcctcggcctcccaaagtgctgggattcaaggcatgactcactgcacccagccagacaagtgcatttttcaggaagatgaccagttcccagattctctttccacagccttggacatgaagttacccttgacagcgggagccactccagggcacatgtgctctttctctgtggctctgctacagaatagcggggaccctgggaggtgacaggctgagatccgcagaccttcacgaacagagcccctggagaaacagaaccagagactctcttcagatccaatgtagccagattcaaccccacctagcagggatgtagtaattgtagtaacaaggacagtaacagtgctaaccaccatttacagagcactttgccatgtgcccacactgtactaagctctaagtacccaatatttttttaatcctcatcaaagcactgtaacatataaacatgatccccattttatagataaggaaactgaggcttggagaagtcaagtctgggtgggtaggttggttggttggttgattggttgatttatttatgtatttagagacagggtctcactcttttgcctggggtggagtggcaccatcacagctcactggagcctccacctcccagactcaagtgatcctcctgccccagcctcctgagtagctgggactgccggcacatgctaacacacccagctaatgttttggggttttttttttgttttttttttttggtagagacggggtcttgctatgttgtcgtgcttatcttgaactcctatgctcaagcgagctaccacacctgacccaagatgttgagtcttatctaggttcaccctgcaagtacgtggtggagccaggatctgtcggactctggagtccaggtttgcagagagcccccggctcatcctggcctctccggcatctcacttcctccctgcaggcacgtaggaccggcctcagctctgtcaagatctgcactgtaggaccccagagatttttttctttctttgggtagtcagacccatctgcaaaagttttgcaatcatgaaatcagatagcgtatgaaatgctaggaataagcgcaggtctagcataccacgcggccagcggtagcgtgacctgacaggaggagtgcgtcttcagagacattgggaaactggcgtgcctgtcgcccgtcccagggtcagagtcttcgaaaccaggctttctgggaacccaacaaggagtttctgatcgaagaaccgcactgaggacagttagtcttttttccacactgggcattttcagcattggaagtcaatgggagccctgcgtctgcaggttttgagatgtggcactcacagcagggtcactagaatggagacatccatgggaccaggttacaggcgctccggcagttgggagaagcgtcgccaagcagcctcccctaggctccatccagcttgtctgcccaagacagaaaacgtcatagaaggtttacagaagagatcttggggacttcctagttcaactgcccctaggtagatggcagaaccctcaatggaagctgtttagctctcagcaaaactcacggccaactaaaatacagtcgtgtgtcacttaacaatgaggctgtgttctgagaaatgcgtcaataggtgaatgcgttgttgtgcaatcatagtgtgtacttgcacaaacctagatagtatatatatatatatatatttttttttatttatgcctatttttcatacagaaaaccaaatgtcccagcaccattactgagcattagtcatttcccttgcttgatctgcagtgcctttataaagggccgtatgtcaactttctctgtatgttccattagaatcttacgggactcaggccaggcgtggtggcacacgcctataatcccacactttgggaggccgaggcgagtggatcacttagtgttaggagttcgagaccagcctggccaacattgtgaaacttcatctctactaaaaatagaaaaattagccagacattttgcaggcacctgtaatcctagctacttgggaagctgaggcaagagaattgcttgaacctgggaggcagaggttgcagtgagccaagatcgtgccactgcactccagcctgggcaacagagcgagactccatctcaaaaaaaaaagactcttatgggacttaggcagcctttgttgaccaaagcgttatgcggtgcatgattatacatggattccactcctaaaaccttccaattagggccaatcacaggccttcaaagaagacctgcagccgtgcccctagacagaaactgtaatgggacttagcagtgctaagagtcccaatatcaagccaggaacctggaatctcggcactttgagaggccaaagcaggaggatcacttgagcccaggagttcaagaccagcctgggcaacatagtgtgacctcgtcactacaaaataactttaaaaaaaaaaacaaagagtcccactgttgagggcccagagttgccaacatctgaactggttctttgctttgtgcaaacccttgagtaattgctgttattcccattttacagatgagaagtttattaacttgtccataggcacccaggtcagaagtgacagactcgagttccaggctcaggctgtcggccttcttggtctgtgccatgccaggctctgagaccctctgtgtgctcctccctctgtctgccttattcccagccggctcctattctctggatatgaccacgtttatgcacgctaaatttagaccacacctggctaattttttgtattttttttttttttttagtagagacggggtttcaccatgttagccaggatggtctcaatctcctgacctcatgatccacccaccttggcctcccaaagtgctgggattacaggcgtcagccaccgcgcccagccctgaatttttaaaacatcgggcaggttgggatttggatggtgccatctcctccccaaagtctagaatgttctcagttggctttaaactgtggtcttagccatggctagtcaagggcacctacaggcatggtggctcacgcctgtaattccaacactttgggaggctgaagtgggagaatcacttgagctcaggagtttgagaccagcctgggcaacatagcaagaccccctctcttaaaaaataaccgggtgtggtgatgtgcatctgtagttccagctactcaggaggctgaggcaggaggatcacttgagcccaggagttggaggctgtagtgagctatgatcgcaccactgcactccagcctgggtgacagagcaagatcctgtctcttttttaaaaaaaaaaagaagaagaagaacaagaagcataatacctagaaaccctgtagaggggaagttaccggaaatgacaattgttcacctctagcttggaaacatgctgaatggccagaacaccctcccggcaccgcccctccatattcttgttttatgtagagttgcctcatttcctccaaggagctccctttagaaaagatcaaaagcaaactagtccaaaaacaccttcagagaagaaagcaccccctacgaccaccctacagcaatggctcctctcacaagaaagccctgcagagctgtgggcagaaacggccacatcaggctgggtggggtggctcacacctgtaatcccagcactttgggaagctgaggcgagagggtcacctggggtcgggagttcgagaccagcctggccaacatgacaaaaccccgtctctactaaaaacacaaaaaaaagtagccaggagtggtgatgcatgcctgtaatctcagctactggggaggctaaggcaggaaaattgcttgaacttgggaggcggaggttgcagtgagcgaagccaagatcacgctactgcactccagcctaggcaacagagcgagagtctgtctccaccaaaaaaaaaaaaaaaaaaggattaaaaaggaaaaaaaggaaacaggccacatcaatccccagtgagctcacagacctttctggagcccactggagcgtcatcatactttggaaatgtgccatccctcccctaggcccctgagagggagcagcatctcggtcagggccctccccgcaggactcagaccagctggctgtcagggaagccaccaagcactcgactgaacaggtccctgctcctaaaaccccagcatccaggggttcaggagtggaaaggcctttgccctgatgcctatctgatgcctactctcaatacaaaagggctgtgtctctcgttagtagaggtcctcccaaaggtgttgacaaccagctgtatgagtccctcagcctaatatattttgtttaaaaccacacgctgcttttcagacaccaggaaagcctctcctcctgtcctcctgtttgctgtttcatggcacttcctacaaagtacacttttcctcctctgcttttcacctctgcaaagattcttccttcttttttttgggtgcggggggggatgcttttttttttttttttttaaaaaaaaaagaggtagggtctccactcctcactctgtcacccaggctggagtgcagcagcacaatcatagctcactgcaccctccaactcccgggctcaggcagtcctcccacctcagcctcccaaagtgctggaattacaggcgtgagccaccacacccttcattctgcttttgctaagttgtacgttacaaccttacagcatccctacacactttgccgtgcctgggcacgcactcacactgggcaggccaggagcgtgagggacaaaagatggccccagcaccgttgactccattcgcaagggctggcttcccctctcaggcacagctggctgttccgcagtgaatgccgtcggtgaagtccgtcgacctgttgtcaggcatggccactgatcaaattcttctctgttttcagcaactggaagaaaaactcaaaggccaggctgactatgaagaggtgaagaaagagctgaagtaagtacggagagccctgtggcccctcacacgctggggcgcattagggccatctgctaacaatgccaggctggtggcaggaagccttggccccctgccctctggctcagcagatgcccgtaaatgcagccagagttctaccactgcatggtgtcctgggctacccaccactgtgggcgtttgcccttgggcctgtccctgaattctttggacttttgctaaaagctgtgcattgcaggtattccagaatgtatggaatcaggggcatagggcttttacagaaatgatcaaatatgaccttgttttgcaactataaattccccaaacagaaacaaagcacaggagggaaatgttttcgggttgaaggtgggcatatggcctcacgctgccccggcctcctggactcaggaactctgtcttccaaactctattctccatctgtgaggctgtagccgaaagcttatcatcttttcagggctaatgatggcattctcagttctcaagcttcaaagttcctttctcggccagcagcccccacctctgcctcctcaccctgagcctgctttggcactctggagctcccaggtcctggtctttacctgtccccccacatccataatgctccaggctcactgacctcccctgcaagcctggagcctgtggtcagaccctctacgttcatacagctcccctggatcgtcagccattccaagccttcccactggcatgcccgcctcactcctaggttattaagcactgcaaacgaaggttgcctagggcatggtgaccagccccacaggtcccccgtgcttctcgcggctggagctctgctggttcgaggcttcctcaggggttcctccctgcccttgtcactgttaccccaaccactatccacagatgccctagccctctgctagggacagactcccgcctctggtcttgggtgccacctcccatctctgcaggctgccccctctgcctagaccttgagtcccttccttcctgcccctcctgctgtcccatcagcccctttctctcttgctgctattttccatttctccttttaagatgagcctacacccactcaccacgttttctttgtgttgttaattccattctgctaagaaaagctcctcgggcatcctcttgaaccatctcacttccatgaccagctgccttctctcgcctgggacccccagcctccctggcgtctgctggccctggtagtccctgtccccaccatgctctccccctgagcggtctcatcccctctccagctgcaaagcctctgccggcacctcctcggacagacccctacatccctctaacagttccagcctctgtaacttacttacttgcttgcttacttatttatttatttgacagagtttagctcttgttgcccaggctggagtgcaatggtgctatctcggctcaccgcaacctccgcctcccgagttcaagcgattctcctgcctcagcctcacaagtagctgggattacgggcatgagccaccaccccgggctaattttgtatttttggtagagatggggtttctccatgttggtcaggctggtctcaatctcccgacctcaggtgatccacccacctcagcctcccaaagtgccgggattacatgtaacttattattaaacattacctggttaaccttctctacctgcctctcctatcccattctttccttcctttccctcttcttccctcttccaaaaagaaaaagaaattgggccttttaattttgagccagagaaactgctgcgaaggcctttgcccagcctcaccctgggagttagtcgtcgtcttcattgtcgtcttcgttgtcttcttctttcttcctctcttcttctttcttcctcctcctcttcttctttcttcctcttcctcttcttcttcctcttgctcctcctcctcctcctcttctcccccaacccccacgttcacttcatcccctgggagctgaggcttccaggctccagcctgcaacacataccgttctactccctctcatccacagcctgccggaccacaggctgcccctacccccactgaagggctgccacaccagccccgcttgtcactgcatttctgctaactctttctgttgcgtccgcacatgacaggccccaccaccatgtgcacatctggaagccccactcaggtggcttctttgcccaaatgcgctcctagttttccacttcctggtgaaccagctgtgctcttgagctcttgcccgcgtccccttctcagcatcgtcccatttccacttcctcacccccacgcaacaggggatgctgacctcagatcctcatgcactgcagcacaagacaccctgtcccttcagggcccttctccaatgcttgttcatcatgacactgagacgtggtctccaatccatcaagatccctcctgctggggtcctcacaagttctgtcttaatggaccacttggagtcttgcctattacctgtaatggcctgtaaatttcctggagtacggaccaggagtggttctgattccccacggcaacaagcggatagcaggctgctggtaaagatctgtagaatagataaagagccacgtggtcttttattacataatcctaaagaaaataggaaacgaaggacaggattccatcttaagaaacccctttcagctgggcgcagtggctcacatctgtaatcccagcactttgggaggccgacagatcacctgaggtcaggaaaccagcttggccaaaaccgtctctactaaaaataaattatccaggtgtggtggctcacactagggggacagaggccgaaattgtggctgcaggaacatggcgaaggtccggttgactctgcacctgcgagtcgtaaatctcacggtccagccagcctgctctgggtctctctcttccatccttggtatttcaaagaaacacttgcagctccttcaaagccacatagcctcacttcccctcttctccctggtaaactcagcaaaaaagggacatccacagcaaaaggaactcaagaaacagtaataatcctggggacctggactcactgagacagcccagagaccgtagtgatcagggtgcggcccttttcagtgccattgagaacaagggagggagaagtcaccttctcttgccacatctttgtcattgcactccttccccaacctggggctgcagagaaggtctgcccacctggcttctgagtcatccaagtctaggaggttgctctttgcctatgtcccctggtccccaggtaggtgccagttaggagtgaggtgtgggcagtggccgccctggtgggttcccctctctctggcttctccttacaactttttccttccctttaagctttacaaatacattccacttgcaacaatgttatgtctgtattaaactttaaaattatactctgaacagacctggtgtgattccatatggaatgatttacatgctaggcaagaaacttttgccagccaactgctagttgaatagttattctagagacattatcagattctattactgccagggaagttgttaaagttgacagttcttcggttcctggagagcaggaaattgtaatgttaatgcttattaatgtggctgttgtcaaaggtataagtagaaaataatcactctggtggctcatgcctgtaataccaacactttgggaggctgaggcgggtggatcacttgaggtcaggagttcgagactagcctggccaacgtggtgaaaccccgtctctactagaaatacaaaaattagctgggcatgatggcacatgcctgtaatcccagctactcgggaggctgaggtaggagaatcgcttgaacctgggcagaggttgcagtgagccaatatcgcgccactgcactctagcctgggtgacagaacgagactctgtctcaaaaaataaataaaataacccctctgttgtgctcttgcagcattctgaagtccatggagtttgcaccgtccgagggcgctgggacacaggtacgtgtctcacctcaatggtcagcactagcatcagccccgctgctggttaccactggtccctccggcatatcccatgatccactgtttctacgagacctctcacttacagccgatgagtcatacttcaagaacatttaaccaagttgaagcaaattatctttttttttttgtctcctttttttccatgtgtccaaggcatgaaccaggcatagatcaaaagccaagctggggatgaacaagggattgcttcatccctgactgataggagatgggcactaccaaaaagcaaattatctttaacaaaaagaggcaaaaagagaaaagctagtgttttccaaactggtaactgaagtgaaattgtgatttcacttcagcaggtactaagaacataaataaaaaacaatttcagattgtgtttaagaaggccaggctcagtagctcatgcctgtaatcccagcactttgggaggccaagacaggaggatcgctttgaggccaggaatttgagaccagcctgggcaatatagcaagaccatgttgctattaaaaaaaaaaaaaatagccaagtactgtgacatatacccgtggtcccagctacttgggaggctgaggcaggaagatcgcttgagcccagtagttcaaggctatagtgagctatgatcgcaccactgcactccagcctggacaacagattgagactgactattttttttttaattgcattaaagagcagccaaaaatggattggtttaggaactttagttacatgctgcctcagtagagaaggtacaagggaaggatgactgtggcccagggtcatctggtggccaattaaaattgacatcccagaccaagcatggtggctcactcctgtaatcccagcactttgggaggctgaggtaggtggatcacttgaggtcaggcatttgagaccagcctggccaatatggtgaaaccctatctctgccaaaaatataaaaaattagctgagcgtggtggcgcacgtctgtaatcccagctacttgggaggctgaggaaggagaatcacttgaacccaggagccagagggtacagtgagccaagatcatgccactgcactccagcctgggcgacagagtgagactccatctcaaaaaattaaaaaatcaaatcaaataaaattgacatcctaagtggaatctgactcctgatgcccagaagacagccaacatctttgtggctggcaaaaaaaaaaaaaaaagaaaagttccctttacagtaacgttcggacagacgtttgtggcttggcagccagtcttatggccaaatgaggcacgggctcaggtcgcttgagtttgagaacagatgagagaataattaatttttttaggagctgtggaagtctaagaaggaaaatgacttcaactagaatccattctttctaaagggaacttgttttccacgtgtgttaaacgacttggggggaaatcagctgtccgcagcccacttcctaatcagatcgagagctgggtgggaacgcggacagatggagggaggcagggctccaggcctggtggccccgggagcgggtgagtggccggccccgcagtgagacccccgctctgccccttctaggatgcggccaagcccctggaggtgctgttgctggagaagaaccgctcgctgcagtccgagaacgccgcgctgcgcatctccaacagcgacctgagcggtaggttggccgggcttcgcgcgtgtgcggtggttggttcgcttccaggggtcggtcgaggacgaggaaggtgaatcgtgagtctggacagatgcatggccagagaagcgccggttgacgagaacctttgactaacgcgtgttgggtgccctcctcctcaccgctcctcccttcccttccccgccctgcttaaagctggatgtcgagacgggccagccgcacaggctctgcggaggtcagttaggggcagtgcggctggaatccccgggagggacagctcggaggacgtcggcctttctgatctgtgtctggttgtgctgcacagaggccaggggcagtgtgaacccagcctcgctctggtggtgttttcagggacagccccgggcctgccgggtccagtagaggtttttcttccttggtcaggtttcccctggggacgcgtcccccatccttagcctttcttggctcatcccccaaatggtggcgtcacttgactgtgcttctggtttgggcagctggtaaaacgcgtacaggtgtctcgggctctaatggtattgcattctcaaaacgggcgcgcgcctccacatcgagggggctcggtacggtgcatcgcctcagagcaagaggtgcgagcgaatccattggtcctaaaatgtcagtgtttgctgctcctccggccggggccagcgggcccagtaagaggcccgcgacccgtcaactcttccctgtgtgtgtcaccagctccttgtcacgctaggagtttgagtctatgtcaaggggactctccaggctgcaacgtacaagaaaggcgcaaacatgaatgcatgttgcttgttttgggaagcctcgtttggctgacttacaaatttaatcggaaaacaaaccaacccacctcattggcccttgtaaaaaaaacctgcacttttttttgttttcccttttgcgggggcaaacttttgcattttggtcttggtttttttttccccctttggaatcccccataatgcattctgtttgcccttccttgtagggtcagccaggaggaaagggaaagaccagcctgaaagtcggcgcccgggatctttgccggccccccctccttctcagttgccccgcaacccgggggagcaggcttccaatactaatggtacacaccagttctcaccagcggggttaagtcaagactttttcagctcatccctggcaagccccagcctacccctggcttctacaggaaaatttgcactaaactctcttctccagcggcagctaatgcagtccttctactccaaggctatgcaggaagccggaagcacaagcatgattttttcaacaggtccatacagcacaaactccatatcttcccaaagtccattacaacaaagcccagatgtcaatggcatggccccatcccccagccagtcagaaagtgctgggagcgtctccgagggcgaggagatggacactgcagaaatcgcccggcaggtcaaagagcagctgattaagcacaatatcggacaacgtattttcggacattatgtgttgggactgtctcaagggtccgtgagcgagattctggcccggcccaagccatggaataaactgactgttcgtggcaaggagccatttcacaagatgaaacagttcctctccgatgagcagaacatcctggccctccgtagcatccaaggcagacaaagaggtgagagactggcgttgggtggcgccagcgtgcgagcccgtcacagagttgcacatgtgtgtgtgcatgcgtgcgtgtgtctgtgtgcgtgatgaaacatttgtgcatcacatcaggtaaagttctctttgcttctgccacgtccagagctcaagggtggcccggcatgagttaaggctgttagatttgggagatctggcctttgaaacgcactcagcactccatacttaggaaaccctatagtatttcaatactagagatcgtatcagagggaattgcattacatgatgtatagcgtctccgtatgcttagtggccgcgggtccaattggccttgggtgctggtctcacttttgggaggagcccttaagtcccctccagccccatagcagcaacgttgactgggctcgatcctcatgcaaagctggttctgtagggagaacacatcacagatgacacctcccctcttcccaccccgcagaagagggcgtgtcccatggccaccttccctacattgttcacggtccattagtgatttgtttagcattatgagtaaaacaggcctggcttgagtaaaatacacaaaagttttatttaagcaccctttctaccccaccctccgtaaaaagataaaatgtcagtcacattcataatttcaaaaaatcccagccgggcacagtagctcacgcctataattccagcagtttgggaggctgaggtggatggatcgcttgagtccaggagttcaagaccagcctgggcaacatatattttgtaatcttttgatctacaaaaaaatcaaaaggttagctgggcgtggtggcgtgtacctgtggtcccagctacttgagaggctaaggcaggaggatggcttgagcccaggaggtggaggctgcagtgagccatgattgagccactgcactccagtctgggcaacagagtgagaacctgcctcaaataaaaaaacaaaaaagaaagttccttttctgtttaagaccaggggatcaatgtgccacatcaacagagctattgagaggtcatttcatcagacatgtttgaaacaccctgaaatttagactcaaacagagcagggagatgttttgaacagcatcaatttgcaccaagaaaatgcagtgttttatgaggatgttaaccgaaattgaatgtctttggatgattaatgcgagctttgttctgggggctggcgggtgatcctccttcaaggcagtcctccctcccatggacctccctggcctcaatgccgtaggtcgctacttagatttcccccatctccttttgcagcagagccacggcctctgcgggccggtcagccagggaagggcctctcagaagattctagaaactcccgagttgcacaggcagccctgagccctttctttagtgacaggcggctcagatttcatgtcacacagcccatatcgtcaacaccaccattcccctgattgttttgttcttaccacacttgtttttcaacagagaatccaggccagagcctgaacagactatttcaggaagtaccgaaacgaagaaatgggtctgaaggtatgttgcaggcaggcgttttctttgcagtcagtcacctagggaagcagcatgtccttagctgtgtatttgggttaaaactgtgcagtgtgattctggcctggaacctgatggaaaaacagctagtaagtataaaacaaggcacgggttcaagcacacccagccccttcctcccgagctgcctgccctctcccaagcacaggcgggggtgagaagaggcattgctaagctaagccccccgagtctgaatcccagcccacttcagatcctaattacccggtcccccgtttttctcagacgcagttgaaaaaataacagcggttgctctgagaaaagtcaggtgacccgtcaaattaaatactgctgcttcctcgtatttttaactcggaaacacactcaaggtcctatggaacggacgcatcccacatcgtcccggtggcatacttgtttttaaatggtggtatacttgttttgaatgcagtggttcctatttaggaaggtagtaagaaattaaactatccgggtggcttcccgaaagagctggggccagcccctgggccatagtagcctcatttcgtcggcacgtgtgcctgcacaaaacatcaccatgtggccgaaagaatccatcctccccacttaggaatttctgcaggctcctttcctcgtatgtaaattttaaaaagatattatgtgataataggtgcaaacaattttttaagttaagcctttcttcaccctgtgcctctgaatgattgatagacaatcagcctcaaaccctctgccctccttttccgtttatcctgtgtgggaccccagcatccaataaacatctaaccccgaggagagtcagtcccaagccacagcagttgcttctaagtgactcatgagaaacattgccttttaatcactcgccttttatatatatggattaaatgatcggttctcccgggtactaacccacgggtggtgtccggctttggcagagtaacattgaccgtaaggtcaaatgagcaggaaatccctcctgcccggtgtcgctgtgaagttgcactcacagcaaacacaggccactgggaggccacatctgcctccttgtgtcaccagcccccacccggggctatatatcagaatgacgtcttcgcgcagcgctgatttttgtccggggtttgggtttgatgtcattggcgcaacttctccccacaggtaacatcaccacccggatccgagcctcggagactggctctgatgaagccatcaagtccatcctagagcaagccaagagggagctccaagtgcagaaaactggtacagcttccatttcttcatccactgtcttcaaacttaattaagagaattgtcatgagtgctctggtcagcagtaattaactattttttttttaaacaataatgaatgcctgttctcaagcatttaggcacgtagagagaagcaggtctgtgtgatctgtatttgcctaatagttacctttttttttgagatgcagtctctctctgttgcctgtgctggagtgcagtggcacgatctcagctcactgcaacctctgcctcccgggtttaagcgattctcctgcctcagtctcccgagtagctgggactatagacatgtgccaccatgcccatgatatttgtgtttttagtagagacggggttttaccatgtcggccaggctggtctcgaactcctgacctccagtgatcctcccacctcggcctcccacggtgctgggattacaggtgtgagccaccgcgcctggcccctagttgtaattattcacagaaattacgctccttaactttgacagaaccacttgcatttcagaatatagcacaggaaaatgaataccaagtataaaaattatcagaggtcaggcgcggtggctcacacctgcaatcctggcattttgggaagctgatgggggaggatgacttgagttcaggagtttaagaccagcctatgcaacacagtgagagaccttgtctcttaaaacactagccaggcatggtggcatgcacctgtggtcccagctacttgggaggctgagctgggaggattgcttgagccagggaggtggagggtgggtacagtgagccgtgatcgtgccactgcgctccagcctggacaacagcgagatcctgtcgctaaaaaaaaaaaaaaaaaaaaaaaaaaaaattctcggggaaaggagccccaggagggcaggtcggggagcactttcactgacaccccctttattaccctctacatctgtgtgtataccaaaggccaccaggtcatcaagctgtagtgtcaggccctggtccttggttgagacaagatgcctgaatgtttcactgacaggggccatgctggggaaatacacagtgtggttctcccaaataacccacactttgcagtaggtcaagttaggatgagaagcatgtccccagctgaagggggccgccctgccacactctcacccctgtttctccatgcagcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagtgacatcaccatcctcacccccaagcttctgtccacctcgcccatgcccaccgtgtccagctacccacctctcgccatctccctgaagaagccctccgcagctcctgaggccggtgcctctgctctgccgaaccccccggccctcaaaaaggaggcccaggacgcccccgggctggacccccagggagcagccgattgtgcacaaggggtcctgagacaggtgaaaaatgaggtgggccgcagcggtgcctggaaggaccactggtggagcgcggtgcagccggagagaagaaatgccgcctcctccgaggaggccaaggccgaagaaacgggcggcgggaaagagaagggcagcggtggcagcggaggtggcagccagcctcgggccgagcgcagtcagctccagggaccctcgtcgtcagagtactggaaggagtggcccagcgctgagtccccatactcccagagctcagagctgagtctgaccggggccagccgcagcgagacaccacagaacagccccctgccatcctccccgatcgtgcccatgtccaagcccaccaagccctcggtccccccgctgacccccgagcagtacgaggtctacatgtaccaggaggtggacaccatcgagctcacccggcaggttaaggaaaagctggccaagaacggcatctgccagagaatcttcggggagaaggtaagggatctgctctgggggctttggttctcccatctcttctccttgctgaggaccaagtatctatcccgcagcctgtgaccctcacccatttcaattcacccaagagcagagcgtaaggcatcctctgctcccagacttccaaggtgcggctggtgaacattgcagccccgatcccatttgccgagccccgactgcagccaggttctaggctcagcctttcacctgcatgctgccctttcgacccctcacttggcgctgggaagtggatggtaaaatccccaattgacagggaaggacaccaaggcttggggacgttaactacttgccccaagctgaccggcagccgagtccacatccagcttttgctgccaaggggagctgagaggcacccctgcaggcttccttggccaaaaaaaatcccatctgatcacacagagggaccaccagtacgcagagagccaaaagggacttactagaaaaagctgcagagagcattattgttcctttctgtgtaactcttggatattgttcagtcagagaggtcaagcaacctgcccggggacacacagcttggggatggcccaagcagggtggcccgtgtttccctatcatccttccctggctcaggaaagtgtaatcgtgcatggacgagcttctaggcctttctgttcttggcactttcctggtcactgagattcaggagaatgagggttaaccgtgcctgccaaatctaaaataaacatcatgtcctagtatcattttatttatttattttttgagatggcgtctcactctgtcgcccatgctagagtgcagtgacgctatctcggctcactgcaacctctgcctcctgggttcaagcgattctcctgcttcagcctcctgagtagctgggattacgagtgcccaccaccacacccagctaatttttctatttttagtcgagtcagggtttcaccatgttggccaggctggtctcctgacctcaagtgatctgcctgccttggcctcccaaccccctaccattttagattaaataacggagtgctgaatagaaggagaagcacccctctcccctaaaaggcaccttcctgagggagcacgtggctggatcagcaggggacaaatcccaccccctcccctgccaagccagggtccctgcatggcgccgtccccgcactccccaccccgccttccactcagtgtttgccgtatgctgtgctgtgaatcccggtggtgtccgatggcgaactttgccctgattttgcaaaaggtgaaggggggcgactagaaatgaggatgagtatttcaagtcccttgagatttctagttcagtgttgtaaaaataccatttgagaacattgaaatagacattcgtgctcatgccttaaatttagcagagacttaataacattgaacttgtttggcccgtgagtgcagttttattctggaacttgagaacttttcaaaagagtgatcggatgcagcccctaaatatcccagggcggcatctgtgtcctgtggggggtgtttgtgcctatacatatgtatggccatatgggagcgtcagaaaactcgggtgtgtacacgcaactcggcaatcatctgcggcggaatgtcactcccaggccggctccccaggtcccaccagctcacctctgggcccccacctttgatcaggatgtggtcagaacaagcagacctttctaaatgctggcctggctcagcgtttgcagaggacaccagcttcgccagtcccaccggcacccactgccccacctctggagggatcttgtccctggaaccttagcctttcccggtgccaccaagtgaagagcaaggtgcttgtacacacctcctccgcggggtgtcagggtgacagccctgccatcttggcaggatcaagaccctgggatgagaccctcttccctccctgggagctgagagctgtggctgtaaccatggctcacccgaaagtccccctgtgccggggtctcagccaccgttgatctttaaatgcatattccctgcccacaagctgtcaccgccaccaggccgtggttctgtgctcagaagtcagccctagacgcgccctctgcgtggtgggtgtgcattgcagcagcatctgtggtgtcatgctaatagccaggcactgatggcctgtgtgttcggtgccactccaggtgctgggcctgtcccagggcagcgtcagcgacatgctgtcccgaccgaagccatggagcaagctgacgcagaaaggccgagaacccttcatccggatgcagctctggctgaacggcgagctaggccagggtgttctacccgtccagggccagcagcaagggccaggtaatgggggtcctgccacaggagaggggctgcccccccatagcaaggacctggtcacagcagccccacctgggctatgcagagagggaggagggaactccgccccaggaggtggccaaccacactccccaccgtgggctggtgctgggggacagaaccgtccccttcctccacaacctgttgccgtgggactgacttcagtgtttaggagagatcatgcctgtctaattttataagcagcagaaaatgagttaccaatttaaaaaatgctgtttatacataaatacaggtaaaagtcaagtagctgaatcagggagtcaggaaagaaagtcagccaaaggtacaaaagtggaagatgtcacaggcgaaacctttcacctgctcccggcccgggggcctggccttgcaacagcagcgcctccccggcccgtgggtccccatgcccgcccctccccaggaggaatgggaagcctccccgggccttgccacattcagttaggaagctttaagccctgggccgcgttccttcctttaattataacctttttctactttagtcctccactccgtgacatcgctccaggacccgctgcagcagggctgtgtgagctcaggtaagcagccagtttctgttgcttttgcatgaaatgtctcactgccttttctgttgtcccgtgctgtggtctgtcccggcgagactccgagggaccgcacattctggatttggggagctgaaatatggcatcctatctgcaaacggggtccctctctgtgtcagtttctaatggagagcgagctgacagtgcatggagggactctgccaagatttgcacgcccactgtcatcctttgtcggcccagagccttgtgttcagggctggggtctaagtcggagacagattccccactcagggggcttaccgtctgataggaagggataaagcacgggcacacgtccctctcctggtggggtcatgtcgggggacttcttatctaaccggaagacatccaggcagcctctgagcaagaaaatggggagctttgagcttgagcagtgggaaaggtagggtagcagaaaggaaatggccaggaagcccctgaagacagctcaggtgtgaacgaatggagagctggggactgagatctgagcctgggagcaggtggtggcggagagtggtggctgcaggctgagaaactcgggctccttcctgtctgcatttcacagcctcgaggtctccaaccacacttgttctctttgccacatggtgcctggacacagcccaccgaggctgacccatggccacggctcccaggctctcgtctgcgcccccccgcctcccttctcgtgcgccaatcccacacttggagctgagcttttcacagccagcttttaggaacagccagcactgtgagctggtcctctttttccctttctgtatttttctaaacatgttgattcgtctccatatcccattgattcattgaaaacacaaacaaagctaacaggagcacgaagcccgccagcttgccgcaagctccacgagggggaacatgtgtagcacggggaacagctgtgtggcagtggctgctgcttctacaagagaccaaaccctcatacagatgcagccggggcacctcggtggcatccaagtccccagttgagagttctgcgtgttttccgtgttctgatttgactctgaccaacgtgggggtcgagaggctgcatctcacccgcgccgtgggtcttcttggctggacatctaggtggagcgggtgcccattggaagaagggatcactcattctggcttggccaatttaattagaaagtaccaagaactaatccagcactggctcgagttcagaatacttcaggggaaataatggacatagctgtttgtgctggagttttacggacgtctgcttggaaagttagccttgaccccctgctctaacgggaagttggccttcttgaaactcacgagagtatttgattccattgaggcaggactgaacttggcagaaagtgactaatgtattctagatcaaaaccccttgttagaccaggtgcggtggctcacgcctgtaatcccaacactttgggaggccgaggtgggtgcatcacctgaggtcaggagtttaagaccagcctggccaacgtggtgaaaccccgtctctactaaagatacaaaaaaattagctgagtgtggtggtaggagcctgtaatcccagctagtcaggaggctgaggcaggagaattgcttgaacccaggaggcggaggttgcagtgagctgagatcgtaccactgcactctagcctgggcaacagagcgagactccatctcaaaaacaaaaaaaaccctcgtcctacataaaacaggaagtctcccctggtgccaggcctgctaatgatcgatgccagaagcaacttctatgtgacggaacaaatccttgaagaatgacgttttactttgtattgtaacggatcatcgccactgtgctggaacgtttgtacaacagtcacatttcaaacctaggaaaaacacactaggctcctaagaggaatgtaaatgatatttgtaaaatatcaattgactttatagaataaagttagttaagactcctgggcaatctcgcagattggaagcaggagagagaaaaaggcgatgagcccctggatgaaacggaacagagtgtagaagttgccagtggtttttgtgaagaggcagcagatgggtgtgtctcccccacccgccttccatgtcattccagcaagaggggaggttgagcacaaatcacttacccaaaatcttgaagtcataggaaagccaccagcagaagcaaaaatcgtggtgactagggagaaaaatggaaaaagatttcttatttgcaggaaaaaatatttttttttttttgagacagagtctcgctgtgtcacccaggctggagtgcagtggcacaatctcagctcactgtaacctccacccccccaggttcaagtgattctcctgcctcagcctcctgagtagctgggaatacaggtacccatcaccacgcccggctaatttttgtagtttcggtagtgacagagtttcaacatgttggccaggccggtctcgaactcctgatctcaggtgatccccccaccttggcctcccaaagtgctgggattacaggtgtgagccactgcacctggccaggaaaattttaaaaaattgtatagcataatgatggccaagtgaaaatatttctctggaccaggaagactaggagggctttgccagaaagaaaagagattatcatatggttttcctcgtctgaatctttactatcagaggttacttttcaagggagtttcacacagaggctcacatctgtaatccaagcactttgggaagccaaggcagacagatcacctgaacttaggagttcgagaccagcctgggcaacatggtgaaaccccatctctacaaaaaatgcaaaaattagccaggtgtgatggcatgcacctgtagttccagctacttgggggactgaggcgggaggattgcttgagcccaggaggtcgaggctgcagtaagccaagatcacgccactgcactccaagctgggtgacagacggagaccctgtctcaaaaaaaaacaaaagagaaaagaaaaaaagctatgttcacagtatatggagtgtgtgtgtgtgtgtgtgtctgtgtgatggagtctcactctgtcgcctaggctggagtgcagtggcacaatctcagctcactgcaacctccgcctcctgggttcaggcgattctcctgcctcagcctcccaagtagctgaaactacaggcatgcgccagcacacccagctagttgtatttttagtagagacggggtttcgccctgttggccaggttggtcttgaactcccaacctcaggtgatccacccgccttagcttcctaaagtgctgggattataggcatgagccaccgtgccccacctagtatatggaatttaatttagaaaaatagagttgctaacagtggtttttagtaaatccttgggattagtgacatgagagactagaatcttccttgactgtgtctctgtggaagcttccagcagtgctgcccctgaagcaggagagcgagcctctgtcctaagattgctacaggattccgattccctgttcttcccatggctaccccagaatcctttcaagaggcccccagacccagaagatgctccctccattgcttgcctcaagtagctcgccgtggtagaaccaatgtctgcagaaaggtcattgcaagcccggcttggcttcttcctgaatgtcagtgagaaatgctcagtgcttgagattctgggcctcgaagatggactggcggttggttttccttcccaggtaggcagggactttggacaacttgctcagccagccacagccctgcagtaagggaatcgggcttacagcggagtccgtgggggcggatggctctgtgctctgtgctcggttaccatggtgatcaggtgccctgcgctagagtggcctcgcccatctgaacagcaagctgctggcccaggagtctattttcttttcctcactgagagctcccgtcagccttttcctgccgggctctgttgccttgtctgtccttccgttttccttaatgacttagacgccaatttgccaaaaaggagagagaaactgacatttcattcacatcatcactttttcctcttggtggatacaactggttctgaatgttcctctaagaatccgagcatgggggtgacgggcttgggcattaaggaaatttgatgccatttttaagcagcagcgtcactagtgacccaccactttttcttagacactgttgaggccttgaaaaggcgtaaggtgagcggtaggttccatgccagtcatgagtaactttttttttaagaaaaaggatttttaagagacaaatcttcagatcagttacctgttcatagatttcctggtacgtcttaactttctacaaatatttttttttgtttgcttcttgcaaaatgcccagcaccttgggatataaaggggggtgtagttataaccagggtcatctttgatctcatttggaaaacttcatttcaagatggagttgcaggtggtccttggggactgattctgcaagccccttttgtctgtcagtcattccaggcttcatccctcatttctggacctcacactacttaaccataccaaatgttcatagaggagaaggtagaggctcattaaggcttgtttgctcagagtgtggccttcttatcatttagcaatttattgtatcttattctatttattttatttattttttatagacagacggggactcactctgttgcccaggctggagtgcagtgacacaatcacagctcaatacagcctcaatctctcaggctcaaacaatcctctctcctcagcctcctgagtagctgggacttatagacactttccaccacactcagctaatttttttattttttgtagaagtgggtctctcttttttattcgtttttgtttttgttttttgagatggagtctcgttctgtcacctgggctggagtgcagtggcgcgatctcgactcactgcaacctacacctccggggttcaagtaattctccttcctcagcctcccaagtagctgggattacaggtgcctgccaccacacccaggtaatttttgtatttttaatagagatggggtttcaccatgttggccaggctagtctccaactcctgacctcgggtgatcctcccaccttggcctcccaaagtgctaggattacaggtgtaagtcaccacacccggccttttttattctttatttccaaatacccaagtaacctggtctctgttgccagggctggtctcaaactcctggcctcccaaagtgctgggattaccgatgtgagccaccatacccggccactttgtaactttttaatgtgggagcgtttcattgctgtggctaacaagctgttacgtctgcattcacactggcttcaggtgtattatggctatccaggtggaaggatggtcccctgcccttggctgaatcgtgaaatacccagctctttcctggcgtgttaggaatgatgggttccaagccttctctgctgcctgttgctgttcccagtcagccaacagagtatcagttgcctctttgagaagacagctgctatggtctgtctctaatgtgggtggtccaatgtgtgcccctctttgacgtgaagcccacggggccgtgggctgtccatgaccttgtacaaccaggagattccccttggctgcagcccctatcgcggacaggtccacgttccttttgaatgtgcatgcgtatcatggtcatggctcttagctggttcccaccagacagccaggaacacgtgtccagggctcgtgagctttgaactctgcagtaagattctaaagcagtgtccttgataagcagtcagtcggctctcccacattcatggctaacagtcagtgtcgggggcatgtggatagcatgttcatagggacaggagaggctgattgcacccctgggcattccacagcactgtctaaagcaggcaggggccaggcgcggtggctcacacctgtaatcccagccctttgggaggccgaggtgggtggatcacttgaggtcagaagtttgagaccagcctggccaacatggtgaaactcggtctctactaaaaatataaaaataagtcaggcatggtggcttgcacctgtgatccctgctactcaggaggctgaggcaagagtatcacttgaacccaggaggtggaggctgcagtgagcaatgatagcatcactgcactgcagcctgggtgacaaagcgagaccctctccgcccgcaaaaaaagaatacctcttcaattggagacattaaagaatcagcttttcggctgggcgcagtggctcacacctgtaatcccagcactttgagaggccgaggcaggtgcatcacctgacgtcaggagttcgagaccagcctggccaacatggggaaaccccgtctctagtaaaaatacaaaaattagccaggcgtggtggtgcacacctgtaatccagctccttgggaggctgaggcaggagaattgcttgaacccgagagacccaggttgcagtgggccgagattgcactattgcactccagcagggtgacaagagtgaaactccatctaaaaaaaaaaaaaaaaaaaaaaaaactcaacctgatctcggctgagctaagatgcaaagggactggctgtgccactgtgaacccttccagaggcaggtgaggcaggccgcgcgggagcagcacgggaagtcccggctgatgagatgaggctggggggccgccccaagagccacaggaggaagggcacatgcgcttctcaaaagttccttgatgtgtgatgtatagggatcactcagggaccttgccggaaagcccctttgtcactgtgcgtgacctgcttgttcagttccccaagcgcctccagatgcttgtgggattcaagatgggggctggccacatgttgctggaaccagcaccctgtgacatttatgcaggagaacatgggtatttgaagggtcttttgttcctaggacagccctgcctgggggaccctgcacacacagatcctgcacagatgtcaggggcagccagtgctgagtaccacagcccactttaggttttgtttcaaagcaacaaacgtcgctgtcatcaagtgagcaaggcagcctacgcaggctgccagcaccgccccagcaccctgcagtcccaccttccagcaccactcgtcacacacccttggggaaggctgctttgccagaactcggccccccaaagtctctgttcctagagcagaatttgtccctgtgcctcacccaaagagagggaagtcatagcccagagtcaccgatttatttgacttttttgtttttattatgatttgcaggattttttccaagaagtaaaatgcaccatagttacaaaatgcaagcattcaaacttacagtctttttaagaaatcggtcaccatccctccctcatcttcctgtcacacaccacccccacccccacaccccaccccaccaccatccccagtttgtcatgtgtccttcaggacagtcatgcacctaaatatttattccacgcagatggggggcgtgcaggcctcaaaaaggccgtgtgccttgcttttctcacttagtaacacaccgtggagaccttcctccatcagcacatggagaattttccctttttgtgtgtacatgtgtgagagggagtctcgctctgtcacccaggctggagtgcagtggcacaatctcggctcactgcagcctccgccttccgagttcaagcagttctcctgcctcagcctccaagtagctgggatcacaggtgtgcaccaccacacctgactaattttttgtatttagtagagacggggtttcaccatgttgctcaggctggcctcgaactcctgacctctggtgatccacccatcttggcctcccaaagtgctggggttacaggtgtgcaccaccacacccagccagatgtctgcttttaaaacagaatctagtcgcatcttcccacctcctttggtggagattgtcccttgcagatggtgcagggtactcctggtgccgcagtcctgtgagaggtgatctatatgtgcctttccaaagtctcgacttctacaaaatgctattccatccttggaagttgcctgttcattgaccaattccttaaagtggacacaaaaccttgagcttccagagtaagactatagggcctaggtcattgcttaggccatttggggccaagctagtatggaaccaggccaactaggctagacacagccggcgaggctgagggctcacataactctcgttcttcccgtcgctttccctggaccctccatcctggtgctccctggtttccccttctgaaaaggcccgacaggcccagtccagcttgtagacacatcccgttctctccccttcaggctttccatagaaaacagaatttacagcacattgggcattcagtacaagaggcaaaagtaggtcataggagcaaatgaggacttcagttttcagtggttgaattctagggaaggaatgaagaagcttaaatgcctagaaaccctcaggtgattgcagaaaggggggtgggaataaaacaagggagtccacatgctggtgtggtctctgtgccactcacagagctgatgtccgtaatccttaatcagtaagtgaggccgggctcagtggctcacacctgtaatcccagcactttgggaggccaaggcgggtggatcacctgaggtcaggagttcaagaccggcctggccaacatggcaaaaccctgtttctactaaaaatacaaaaaaattagctgggtgtggtggcggatgcctgtattcccagctactcgggaggctgaggcaggagaattaactcgaacccagaggtggttgcactgaggcgagatcacgccactgcactccagcctgggcaacaagagcaaaacttcatctcaaaaataataataataataataagtggaaatggttcccttctcttacggatggagtaaaccaaggctcagagataaaaggtgatttgccccaatcaagaagaaggtggtggccaggcgtggtggctgacgcctgtaatcccaacactttgggaggctaagactcaaggatcgcttgagtccaggaatttgagaccagcctgagcaacatagcaagaccccatctctacagaaaatttaaaatttagccgagcatggtggtgtgcgcctgtagtcccagctactcaggaggctgaggcaggaggattgcctgagcccaggagttgaatcagcaaatcagtgacagcatggaagccacatttactaggtttggctgttggaaaatgtgtaatccacctggcctaggctgcatggagtgtccatgctcctttgaaacctcttctggtctaaattcagtgaacgtatacacactggcttgaggtcctctgcctgctacagggcagccctgcctttcagctgtcacggccccccggagccatgccgacacccaggccccagccccatgcggactggcccgagggacctgccccgctcccggtgaggataaggaggggagtttcttaatggcattgccctggatagattgggagccaggcaggaggcttccatcggggcctcctctagattttgcgtttacttcttccctttggaaccggattcctaaatatagcccgagtctgaattggcagatgttgggtctgtcctttccttgacggccaaaattagtctgtcatttggcacctaaataaagcagccaaactacctttataccagctttgcaattaggcggtagttggaacattctatttgataaggaaacttttatggatgccttagcagcacctctgaacccaggaggctgaggagagaggacacccgggccccagagggacactccttcctcgccatcaggccttctcattccagagttaaggtcaattttgttccatgtggcttaaaaacacctcgtgaatgtggaaaagacagtcaatgctccccagaaatagcattctaagagcatggcaatggttactccaactttttttttttttttttttttttttttttgcaagcaaagaaaaatctgtccagagtgcctggagctgggttagtgcagggactccccaggggcagcagaaagatgttataatcaattatcacatcataacactgatgtatgataattactgagtgtttctcctgagatagtgcagcatttggctgggatgccgctctttcacggtccactgcctgattaatatgcaaataataggctgattgcatgatgaatgcagaaatgagttcgctgataacgtgagcaccgaagcgggaagatgataaattacttttactgactgtcctacattaagtaccctttctcaacaatttcatcacaaattaagtaaagcagtatggagagattaggaggacgtgtaaaataatgtaccttaatggtttttctaataccatcgtggaagacgaaaatctcaacttggttctgcccgggtctttgtagggccaagtgagttcactcacctgggcattgagtggaagacaggaggcaccccaccacaccggcgtgttccacgggccatgatcagccatggattctctgaggaatatcccattgcagcccagacattacccgcacactgggccaacaggcagcatcatggagggaggaggacaggctgctctcggggcagacgcagcatcctccacacagatgggcacccccaagcctgctgtccaccatgtgcctgcaggaaaggagcatttctgggctgcaggcctggaagactcggaaagaaaacaacatttaagacctcctgcctgggcacagtggctcacgcctataatcccagcactttgggaggccgcagcgggaggatcacttgaggccgggagtttgagaccagcctggacaacatggggaaaccccatctctacaaaaaatacaaaaattagccaggcgtagtggtgtgcatctataatctatagtctatagtcccagctactttggaggctgaggcggaaggatcattggaccctaggaggtggaggttgcagtgagctgagatcacgccactgcactccagcctgggcagcagagcaacaccccatctcaaaatttaacaaacaaaaaaagacctccttgacctctttttagctcttccaagtctcagaaatctggaaaaattaatttcactattagaatggcagtgggcacaccggccagagagcatgacttggtaagggatgggtaggtttgtccaaagccagaattgaacccttgagaaaaagagggcgtgcgtgtgtgcgcgcacacacacactctcccccccacacacacacacccacacacgcacacacactcccacacacacactctcccacacacacactcccacacacacacacacactccccacacacacacccccacacacgcacacacacacactctcccacacacactcacacacacacactcccccacacacactcccacacgcactctccacacacacatgcacacagagtcccacacacacttctgcacacacacactcttccacacacactctcccacacacacactctcccacacacacccccacacacactctcccaccacacacacacacacattctctctccctcacacacacattctctcacacacacattatctcacacacacacacacacacacatttgcagtgattaatctttgattacagcaaagcaatttaactagaggctttgttttttcccgtcttagtaatatatatttagactgtttgtatgacatacattttgtcttaatgcacagggacgcattgataagtgttcgtacacacagctggcttggtaataaggttattgaaggtaatttgaaagcatcatttctaaatcagtatggatctgcagaaaagccggaacaaggcgagcctgtgcccctgaagcagggccatctgtgtcacccagtgtcccttcagcaatctggccagactgagttcactaccaaaatcgaattgtaatttaagcagggtttttaatttttaatatcttcaagctctgcttttgatatgcttatttccttaagagcttataaaagatacacaagccaactgagcccagagggaaagtgactttccactccgaatccccggcaggtcccctccccgcccgcgggtgagctctggttctgcgcaggttcccgccaaccacagggcctcatcacctctgcagcttcctcctcgtgcatttcaggccaacacagaatttctaagatcatttctccccaccgtaccttcccatgtcggggagatgaaagaggagagtcgaaaaccatccccagagggagggaggctccagatggatgccatggtgtctagagggagggaggctctggatggatgcgatggtgtctagagggagggaggctctggatggaagcaatggtgtctagagggagggaggctctggatggacacgatggtgtctagagggagggaggatctggatggacgtgatggtgtctagagggagggaggctctggatggatgtgatggtgtctagagggagggaggctctggatggacacgatggtgtctagagggagggaggatctggatggacgtgatggtgtctagagggagggaggctctggatggatgcgatggtgtctagagggagggaggatctggatggacacgatggtgtctagagagagggaggctccggatggatgcgatggtgtctagagggagaaaggctctggatggacacgatggtgtctcctctagttagaggagctcatggttgacttctcagagcaacttctcactcgcttggcagcagggacctgtcacacccctgtgctgtggccaggaccatgttgcctgcactgctgcacctccagaccctgccctgacactgctctccccagaaacaccctcgtcccagactctttgtttgagtgacctgcttagtgacttcggcctcccgctttggttacaagatgtgggggcgcagggtctgccttgctcacggctgtacccccacacctggcacatggagggtttccccattgtggaaagctcaggtcccatcttcaagtaacttagaagtcaggtttggggaggtaaaatacaaatcacacaagttaaacaaccttgctctaattgaaacaggttttctttggggccagatatggtggctcatgcctgtaatcccagcactttgggaggccgaggcaggagaatcacttgagcccaggagttcaagaccagcctgggcaacatagtgagaccctatctcgacaaataataattatagtaaattagctggaatggtggtatgtgcttgtagtcccagctgctcaggaggctggggcagagggattgcttgagcccaggaggtcgatgctgcagtgagccgtgattacgccactgcactccagcctgggcaacagggtgagaccatgtctcaagaaaaaaatcaagagagaaagaattttggctcccatgtcattataagagtttctcgggcaaacctaaaaacatatattgttggccaggcacggtggctcaggcccataattctagcactttgggagtctgaggcgggaagatcactagagtccaggagttcaagaccagcttgggcaacatagtgaggccccccatctccacaaaaaattaaaaataaccaggcatggtggtgcacgcctgtcgttccagctactcaggaggcaggggtgggaagatcacttgagcccaggaggcagaggctgcagtgagccaagattgcaccattacactccaacctggacaacagatcaagaccctgcctcaaaacacacacacacacacacacacacacacacacacacacactatggctatatagttgtcacacagacacaccccagcacctactaggtaccagagactttgagttcatcttatcctattctttctttagtccctgcagagggtgtgtgtgtgtgtgagagagagagagaaagaaaatcattgctgttccattttatagaagaaactggcacccattggtgggggtgggggggacattgatctttcctggagtggggcagagctaccacccatcccctctagttcctctgaggcatcttccctcccactccaacccttctccacctcctcccccacaccccctacagaatctttctcaggttctttctgctgttgaaaaacagtgatttgataggtttggggctggcaagggatgtgcccaaagcttgatgctgccacttgtaagggcacagaccttcccagggggcagaaggccaacccaggaccctcgggaattggaccttcgcgtcggccccccgctggcgtcaggcatagctgctcaccttcttggaaagaaagccattttgtagtttggccacgctgggtacgtctctgatattccttaggatgttgttgggctacttttgtttctttcatggtaaggaaacgtccagtggcccaggaaggaggtgcagaaagctcatgagtgtctctgtgacatctgctaaagtcgctgcatattttgtttcaagctcttgctaatcagtcaagatgccagtcttactcaaaagaagaatactgtaggtttttatatgggcgatgtctaatggagatggaggactgttccgatggagattcagcagggctgtgagcttctgctgctggattcagaagcaaggcttgggaactgaggagcccagcgtcgctgccatggttgaggaaagccttggtgttcagaaatttcggagctggtcatgcaagggtgtctcatgtttgtgatatgagcctgtatgaccaaaatacaggaggccagggccgggcacagggccgggcacagtgggatcacacctgtaatcccagcactttgggaggctgaggcaggcagatcacttgaggtcaggagttcgagaccagcctggccaacatggcgaaatcccatctctactaaaaatacaaaaattagctgggcctggtggcacacacctgtaatcccagctactcaggaggctgaggcaggagaactgcttgaaaccgggaggcggaggttgcagttagccgagattgcaccactacactccagcctgggcagcagagtgagactccatctgaaaacaaaaaacaaacaggaggccaaatgagcattgctgttcccctttgatgctgagaaactcactccaggcgtaaaccaccagggggtgtggtctgtttagagcacagggtcagttccggagcaggtctggtgcccacatcacgatctgtccctctaaacctagctaggaagtatccaggctggtggccaccctgttgtgtcttctgaagctgtcagcaccggtcgctggaaaggcccgcaggctgggaagagtctttctgagcctctagggctcctgccagccccggcatgcccacaccgggcacctcagagcctgccgtgcatccttgtatcttgcaccagtccccgccacctccaggcccatccctccctcgggctctcctttcctctcctccagggctcccttgatgttttttatttgtgtttttttattttgtattttattttatttacttatttatttttttgagatggagtagctgggactacagacatatgccaccacacctggctaatttttgtatttttagtagagacagggttttgccgtgttagcagggctggcctcaaactcctgacctcaagcgatctgcccacctcggcctcccaaatgttgggattacaggcgtgagccaccgtgcccggctcccctgctcattcacacttaatgtgccaggccacgaccacctcccctctcccctctcccctaacctcctccctccttccacccgcccttccatacgtgtctgtctgtatagtcattggaatttcctggcttggcatgggctcaaagccgaaaccatggacagaatgaaaagtggcgcatcagaccagccgccagttaaataatgtttgggttcttgtcagaatgtcacggagtaccctgtcattttgtttcagcaacttgtccttctgaatgcacagttcgccttatggcatgccagcagtaaaaatgtcacttacaataattactttttggtgaaaatgcttgctgacttcccaccttcaagctgttttttacacagtggggagataataagaaacgactttatcctgactgctcaaatgaacactaaatggaatttgggttcttattactgcagatagagggccgggtatggaaatttcaacagtagatcggaagaactgcagagagatgtatctccgagaattacggcgggtgcgggttttcaattggctcccattgaaaacttaaggcagctgttgtttgcctgctgtttttggaatataatatttttcataatccttttatagttcgtgaatgccttgtgtatctcagagggccttgagtcactatctctgctttctgtagcttgctcaccaagctcctcttatgccagattcagtgccttgtaaaaaaaaaaaaaaaaaaaaaaaattaattcacatagatgactttttaaatgtaacaccttactattgctgtcaaaactggatggatggtactgtgcagtggggcttttaaaatatgcaaattacccattttcaattgtcctggtcctgcaggctgcagggtccttggaagcgaggtttttgtctgatttctcccttatccccaagacacagagtaggtgctttaaaaatatgtgagtaggctggatgcggtgactcatgcctgtaatcccagcactttgggaggcagaggtgggtggttcgctggagcccaggagttcgagaccagtctgggcaacatagcaagaccccatctctctacaaaatatacaaaaattagccaggcgtggtggcacacacctgtggtcccagctactttgggtcatacattggcaaggaggctaaagtgggagggtctctgaagcccaggaggtcgagactgcagtgaaccatgatcacaccactgcattccagctggagcaacagagcaagacctcgtctcaaaaaaaattaaaatgagagtgaaatgacgcaggaatgacggtaggctgcaattcagaatcacgtggtgttggcagatagcaggatgggtaggaaggtcgaggttttcccctcctgatccttgcaccatctgtgtgactttaaccaagtcacgttgcctgtctgagcctctgttttctcacctgggatgtagggtgtaaatttccaccccagggaccattgggagaattgaatgaagccacatgcagacgccctcagctcgctgctccattcacgcctggtatgaaatgtgttttggttcccttccacaatcctatgagtggatcagctttttgtgactcatcgttaagtcttcgagattcacgcatgtcgatatgtgggttgtagaaaaactgtgcctgggaaggcaggcacagtcactctgtcactaacgcacacttgggcgcagggtgcaggcgccaccagctgtacaggggctgtttagaatatggcccatccacctagctcctggctgtgtgtctcggggcaccgtatcttttttttttttttttttttttttttgagacagagtctcactctgttgcccaggctggaatgcaatgacacgatgtcagctcactgcaaccgccacctcccaggttcaagcaattcccctgtctcagcttcccgagtagctgggcacgcgcctggctaatttttgtatttttagtagagatggggtttcaccatgttggccaggctggtctcgaactcctgacttaaggtgatctgcccacctcagcctcccaaagtgctgggattacaggcatgagccactgcgcctggccagggcaccatattttacctgtgtaaaatgtgggaagtggccgggcacagtggctcacacctgtaattcagcacttttggaggccagggtgagaagatcactcgaggccaagagtttaaggaccaacctgggtaacatagcaaaaccctgtctctattttttaaagtttaaaaaaagtttaatgttttaaaaaagataaatgcatcatacaggatgtggccttttgagtctgtcgccagcgtccctgtcatgtgtcaggcattgtgggagaaatagcactcagtcataagatttatgttgactgtaggtctttatagaaacaaatacatttgaccaggtgcagtggctcaccctgtcagggtggcgagggtgaggggaccctctgtgcagcggggagagttggcttcctgtaggattcactgtctgtcctaacagaacaaaaatatggtcaatagaaaagaaacattacttctcctttcaaacattagcagatggagccctgtgattaaaacgatactttctgaaacaacaaggctttgctctgttccatgcaattaaaaataataataaaaaaagaaaaaaagggtcaggcgcggtggctcacacctgtaatcccagcactttgggaggccaaggtgggcgggtcatctaaggtcaggagttggagaccagcctggccaacattgtgaaaccccatctctactaaaaatacaaaaattacctgggcttggtggcacgaacctgtaatcccagctactcgggaggcagaggcaggagaatcgtttgaacccgggaggcggaagttgcagtgagatcgtgccactgcactccagcctgggcaacagagggagactctgtctcaaaaaagagaaaaagaaaagaatgactttctccccaacatgatgttctgagctcgtggattcacggtgtctccaacgcgtctgtttgctgtggcatctctccatgcctgtgcaaaaaacatgtactcaatcctgtttctttgacctgagaccatagccacaactgtgcatgcagatgtctgttggcgagtaaactatctcccaggaagagcatgcagcttccagctgtcttctacattttatttatttatttatttatttagagacagagtctcactctgtccccaaggctggagtgccatggcacgatctcagctcactgcaacctccgcctcccccattcaagccattctcctgcctctgcctccccagtagctgggattacaggcacccgccaccatgcctggctggtttttgtatttttagtagggagggggtttcaccacgttggccaggctggtctcaaactcctgtcttccaagtgatctgcccgcctcagcctcccaaaggtcttctgcattttagactcagattgagagtggagagacagatacaagccacctccagcaaccagccgccacatgtcactttcacatgcctggacctctcagggctcggacagggctttgatctcagggggcctgcctttgtctgtagtcacagcctggagcacagagggacacctgtaacagtagtgagcgcccctgtttagttctcctgggggttcatgatggcacaaatccacgccactggcttgcaaggcgcactggaagaaagaactgtacagcctctgagtttcgtggtggctctgcctccgccagcacccagaacaaaacagggagatgccacagcagccggcaccacactcggtttattagccagacagccatgatgttgaccttgctgtgggttaaaggacacaaaacctgaagagaaatctgtttatcatttgggaaattcatgccatccttgacagtatctggtgagcaagatggatgatctgccaggccggcccctcgcatgggtgaatcacgccatccttacggtacggttcctctgccggcttcagacacaaaaataacatttgtggggttttatatccagttctctggtgacccggggggtgagcagagagaagaaatctgatttgtaagattcacattgccctaaagatttatacggaccatttctgcctcttacgcttgtctcttctacatctttcaaaaaccggtttggcatgtgtttttctctttgtaacctgatttcccaggtcaaggacacagccttatgcgatggcggaagtttgtgccggttcaggacgataaacgggttgatcgcttaagttgcaaatgttttatttgaggttttgctctttctaggtatgaatacaaaatattccttgtagttggaatgtatttatggcaggttagtgtatcctggatacagtatgtccagaaaaggactcttaagataaatggtaaattgaagttaagttgctgctctatgctacattttcttttcagccaggtaacaagtattttgggctatctactatggtgctgatgttgactgagtgacctgctagggcccaagggagaagcagcaagagtaagacccttggccaggcacagtggctcctgcctgtaaacccagcactttgggaggccaagaagggaggatcacttgaggccaggagttcagcctaggcaacatagcaagacctcatctctacaaaataaaaaattagacaggtgtagtggtgcaagtctgcagtcccagctacttgcaaggctgaggtgggaggattgcttgagcacaggattttgaatcagccagggcaacctagcaagaccccatctccacaaaaaaaaattttacaagaccctgggagcagagagcatggcctgggccctcttacctggcactgtggggtcttactctgtgtcaccctcagtgggcatcaggggagagattgtgccaagacactgagctgggccaggggcagattctgccttgcaggcaggacctcagcccgaagccacatcttcctccaggacagtttctatctgcagaaattaggaaatggtctaagtctttatcccagacatcccagaactggaatccagcctcttttatcaggttttatgggctgttatcagaggccagagggatcactcaccaacagagcccagctggcatttcccactgggcacccacggcgaccccaacaaggcagaggagagtgtagactctggcttgtccacaccagcccagtcacttctgctgttggttacagcatggcttataccagcaaagagctcggttttcagaagcaggcagaaccagcaagtcccaaggttggaggtagaactctaaaatggaagagctggggaaacagggtgctcctcctctccttgcctctctccatcttcccctagagttgggtgctgtggagttctctgctcttcacaacaaaaaaacagctgggcatggtggtgtgcacctgtggtccaggaggagccgtgattgcaccactgcactccagcctgggccaccgagcaagaccccatctctaaaaacataaaagtaaaaataaaccaacctaggtcctgagacccagtgctggaggaccagaagctatagccttatgtttccgcagttgttgttttttttcttttttgagatggagtctcactctcactctgtcacccaggctggagtgcagtggcacaatcttggctcactgcaacctccacctcctgggtgcaagtgattctcctgcctcagcctcctgagtagctgggattacaggcgtgagccaccatgcctggctgatttttgtatttttagtagagatggagtttcaccacgttggccaggctggtctcgaactcctgaccttagatgatccactcgcccagccacatttcctcctaagggtcttcctaactgtggtgactacgtattgtgggcagccctcatttaaaacaatctgtctatgctttttgttctggaaaatatggacaacataactacacaagttatgatctagccaaagtgcttctgaattaccaaattatggggtttcattagaagaaatgacagcgataacatgattaataggagtttttttagcagaatgccctcatgttaagccttccgaagcctttcttttaaacccctagtttttctcgcaatgatgttatttttgttttttaatatggaagactagaggttactctcagtcaaaaaaatatgaaacagttcactaagacccacagaaaaccctaccgtctgcttctcctacagagcgtttaattagtatttcctagataaggaacgtagatggtcgtggtaaaagacagctattttcaggcacggtttctcgtgtgctttaattacagaaagcactccaaagacctccgccagctgcagccctgcccctgagtccccgatgagttccagtgagtcggtgaagagcctgaccgagctggtccagcagccctgtccccccatcgaggcgagcaaggacagcaagccaccagagcccagtgacccgccagcatccgactcccagcccacaaccccgctgcctctctccggacactcggccctcagcatccaagaattagtagccatgtccccggagctggacacctacggcataaccaagcgggtgaaggaggtgctgacggacaacaacctcggtaggttctcctctcggctgctgagtcaggaggtggcagggagtttgcaggaggagcaggtgaagggcgggccctaggccaagccaaccacagagtctcaacttgtgtaggcaccctttgagaacatgaaacatcctatagttgtgaacagtaaggagcgtgccgtctgcaggtcagtccccacctcctccccaccctgcacccccacggggaccagttagaagatgagcatggagtcagagtggactcgggaggatccacacagactgtctcttttttttctttttttttttttttttttgagacagtcttgctctgtcacccaggctggagtgcagtggcacaatctcagctcactgcaacctctgcctccccggttcaagtgactgtcgtgccccagcctcctgagtagctgggattacaggtacctgccaccactcctggctaatttttgtattttcagtagaggtggggtttcaccatgttggccaggctggtctcgaactcttggcctcaagcaatctgcccacctcagcctccaaaattcttgggatcacaggatcccaagccaggcatgagccatcgtgcctggcttagatgtatctcaatagagacagtctgagtaagtccagatttcttgaggccacagtctgagaccagcctgggccacatagcaagaccccatctctacaaagaattttaaaattagctggacatgttgatgtgcacctgtagtcccagctactcaggagcctaaggtgggaggatcacttgagcccaagagttcgagaccagcctaggcaacatagcaagaccccttctctataacagatttaaaaattaggccgggcatagtggctcatgcctgtaatcccagcacattgggaggccacagcaggaggatcgcttgagtccagccaggagttcgagaccaacctgggcagcatggcaaaaccctatctctacaaaaaatgtaaaaattagccgggtatggtggtgcacgcctgtagttcagctactcgggaggctgaagcaggagaatcgtttgaaccctgtagttttaggctgcagtgagctatgaccatgccactgtacttcagcctggacaacacagtgagattctgtctcaaaaaaagaaagaggtagacacccattagagcctggcatcctcggggctccagagctgggcagcgtccacccggcagtgccaggatggcttagtggaaggtctaacggaccccggttctcactctgctcactgagtccgtgatgctggccaggctgcctgcattctcagatccccctccacgaaactggagtaaccacgcctgcctgggagcagtgagtagcagcattttctagcaccaggcccgactggtaataatagtcattgttattttatcattgctgttcccgctgccttgcgaagccatctccatttcacagcccacagctggggcgggcagcccctggggaactcactccgtcaccctggcatcccaccgtgcctcagacctggcctcggcctggcacatgctctagccccctgggtgctcggcctgggttggttgtctgtgctctgtgtcactggtcatcagctgctgtggctgtaagaatgttacggtgtttcatcttttttttttttttttttgagatggagcctcactctgtcgcccaggctggagtgcagtggcgcaacctcagcttactacagcctctcggctcactgaatgccgggttcacgcgattctcctgcctcagtctcccgagtagctgggattacaggcatccgccaccgtgcccagctaatttttgtatttttagtagagacagggtttcaccacgttggccaggatggtctcgaactcctgacctcaagtgatccacccacctcggcctcccaaaacacagggattacaggcatgagccaccgtgtctggccttttttttttttttttttttttttgagacagagtctcaccgtctcactcaggctggagtgcagtggcacaatcgcggctcactataatcactgcctcctgggttcaggcgattctcctgcctcagcctcccaagtagctgggattacaggtgcccaccaccacgcctggctaatttttgtattttcagtagagacagagtttcaccatgctgccaaggctggtctcgaattggcctctggcctcaggtgatccacccaccttggcctccaaaaatgctgggattacaggcatgagccaccacaccagccaagcctattttgtcattttaaaccaccgtgctcctccagtgtggtgttaaccaggcagggttccctggtttaggcacgcggagattggaaacccaccctttctatctttatttcccaagggtgaaagtcagttaaaggggcagtgttctctgcagagcatgtaagcacaaccctaccgagtggttgcagtttgtctgctgctcatggaaaggccttgtgtgtcttttctttctcccatgggatgagaagagaagggaggccgagcatggtggctcacttgagaatgacaggtggcctgtaaccctagcactttgggaggctgaggcaggtggatcacctgaggccaggagttcgagaccagcctgggcaacacagtgagaccccgtctctacaaaaaaaaaattttttaaaaattattatccaggcatggtggcacccgctgtaatccctgctgcttgggaggctgaggtgggaggatcacttgagtccaggaggttgaggcagcagtgagccacggtggcatcactgcactccagcctgggcaacagagcaagacactatctcaaaaaaaaaaaattaaaaaaaaaaaaaagaacagagtagctgagttccactaaagtttgctcagtgatctaacagcctggaggttaggccagcttgtccagtggaagcctcccatccccatgtctgtatgcaacagacaaaacagaatgagagaaaaagtcatatcaatgagaccttatataattaagtcaattcataaaaataaaaatgtagctgttgatttgaaaaaatggctaattcccatatgttcatcagttattgaatcatgcagggattcctagacttgagtcatctcccacttcatagctcgtcacacatccaaggaagcagaccagttgcatcactcctgcccacctccttataggaagtggcatttcgtgtaaatgttgaaaatcagatagggtctagctctgttgcccaggccggagtgcagtggcacgatcatagcttactgcagccttgaactcctgggctcaagcaatcctcccacctcagcctactgagtagctgggactacaggcacacaccccaagcccggctattttttttttttttttttttttgagatggagtctcgctctgttgcccagggtggagtgcagtggcgcgatctcggcttactgcaatctccgcctcccaggttcacgccattctcctgcctcagcctcccaagtagctgggactacaggcgcccaccaccatgcccggctaatttttttgtatttttagtagagacggggtttcactgtgttagccaggatggtctcaatctcctgacctcgtgatctgcccgcctcaacctcccaaagtgctgggattacaggcgtgagccactgcgcccagcctttttttttttttaaatagagatggggtttcaccatattgcccaggctggtctcaaaactcctaggctgaagttatcatccatgccaccatcattgctggagttttccttgatgttggttttactgggtgaaggtttgtagctttcttcaggctctcaaatgggtctgtagccccaaaacaattaaaagtcatggctaggaaacatctaggagtcatacagataattttccaggaataatcatctgatttttttttccccattcagctgggaggcctaagcaaagagcaactagctattcatatatattgctttcccgaacatagcaagctccttgaaatgaaaatagattcttttaccatgttagcattaagtaaaattttctctttttttttttttttttgagatggagtctcgctctgtcacccaggctggagtgcagtggcacgatctcggctcactgcaagctccgcctcccgggttcacgccattctcctgcctcagcctcctgagtagctgggactacaggggcccaccaccacgcccagctaattttttgtatttttagtagagacggggttttactgtgtgagccaggatggtctcgatctcctgacctcatgatctgcccaccttggccttgcaaagtgctgggattacaggcgtgagccaccgcacctggccaaaattttcttataacaactaaaaaaaaaaaaatcataaggacttgggacatttataggctaaagagtttgaaaagcagagaaacacaggtttacaaaatcagtaaatttatctttaagttttttgttttgttttgttttgttttttctttttctttttctttttatcttaagtttaaaatgactaagccaggcgtggtggtgcacacctgtaatcccagctactcgggatgctgaggtagaacaattgcttgagcccaggagctcgagtccagcctgggcaatatagcgagaccctgtttctttagggaaaaaaattaaaaagactgataagaaattaatgtctcagcttcagtgctttctaggcagtaaacttttacttggaggcccccttcttagaagccagtgtgtggtgtttctatttcacatagaggatgtaagccacagagagaacaagccagccctctgtcgtctccctgccccggatggggagaggtgccttctgttctgtacactttatggggtcaaacgctggcccctctgatcccagtctccacttccacctaataagtcctgttcattcaagtactcccgtcaggccttccaggttatcactgatcctaatttgtatctttacaagcggtggccctctaaaccagcagcggaatggccctcagagaagtgagcctttctttctaagctcctgacaagcattgccaactcaatgcggctgtgctctccatagcgaaatgccctctgatcagcctgtgaagcgggctgcctgcccctgcctgggagaagaaaaggtatcaggaaaggggttttgatccacttccagttactttatttagcaaaggcagcctagactgcaaaagcagactttggaattggaatcggccggcctctcagaaaagcagagctgggcagctccctctcctctgtcctgctgtgattgtgggttgcctgccccgttttctcagcgagacctgataaccttgctaattgtggaaggagacgcaggttgccctctgatttgaggttgtacaagagaggtctcctgtttgctgtttggcctcctgagctctggcttagagatttcactgcctctgagaaacaccacaggtgttagcgtgacctcagcacatacaaagcctgaaggcttttttttttcctttttttttttttttttgagacaacggtctctctctctgttgcccaggctggagtgcagtggtgcaatcatagctcactgcagtctcaacctcctgggctcaggcaatcctcccatctcagcctcctaagtagctggaactataggtacatgccaccacgcctagctaattttttgtgtgtgtatttttgtagagactgagtctcactgtgttgcccaggctggtctcaaacccctgggctcaaatgatcttcccgcttcagcctcccaaagggcccttccggccaccgcaccaggctgaaggcttaagagaaacgtcactggccagatgcggtgactcatgcctataatcccagcactttgggaggctgatgggggtggatcacctgaggtcaggagttcaagaccagcctggccaacatggcgaaaacccgtctctactaaaaatacaaaaattagccaggcgtggtggcgagcacctgtagtcccaggtactctggaggctgagacaggagaattgcttgaacctgggaggcggaggttgcagtgagccaagattacactactgcgctccagcctgggtgacagagcaagactccatctcaaaaaaataataataataaagagaaatgtcattggttgtgtgtacggagaatgcaagagcaatgccaactccctggccaatggagagtattataagtctggttgaagatatatttctaccacatgtttgctgtaagctaggatgtcaccagcccaaccctgagcctttaaactcctgtgtctgattttaaccttgacacgtacttgtcccttcagatccctggctctcggtgacaatacctgtcttgcttctgttttctctctaggccagcgcttatttggggagaccatcttagggctcacccaaggctctgtctctgacctccttgcccgccccaaaccctggcataagctcagtctgaaaggacgagagcccttcgtccggatgcagctgtggctgaacgaccccaacaatgtggagaagctgatggacatgaaacggatggagaagaaaggtaagtctccctgccccgcccgggccggctgcgtccgcattcatagacaggctgtttctttcaaatctttcacacacagctgatgagggacattgacccatgaccaagggaccagaggacagggcaaaaatatttttggatggtcatcagctaatgagtacctaagagggctggaaagttgtgtaactttttctctccagcagcctgaatctaaagatttttttagcactgggagcacttttaaccaaggagagcgaaacagctctgggggcgctgcatttggtttttgtgttgtgtgggtggctgatcgggctatcacagcatttactgagcatgtaccaggtggctagaggccttcctttgttatcagagagagaaataagaaatgcattttgtaggcagggcacggcggctcacgcctgtaatctcagcactttgggaggctgaggcaggcggatcacttgaggtcaggagttcaagaccagcctggccaacatggcaaaaccccctcactactaaaaaaaaaaaaaaaaaaaaaatatagccaagcttggtggcgtgcgcctctataatcccaactacttgggaggctgaggcacaagaatcgcttgaaccctgcaggcggtgaacagagattgagccaccgcactccagcctgggtgacagaccatgaccctatctcaaaaaaaaaaaatgcattttgtagatcaggaaacagaggttcagagaggttcggtgcctccaccaaggtcacccggcctggaaagtgacaaagcaaactcctgccacaacagatctctctcttgctgttatttcccagcctctggggatttggcctccctagaggaataaccccacgtgcacccacatgtcatctcgaatgtggattcatgttcttcttgcagcctgtaggctacagcataggaaaaatgcctaaagccaggtgtgctgtgcctcttggtttgcagtttctaagcgctggtcctcgccagtgagtccgcccctcgagcaccctcagtcctcaggtcacctatggtgctgggagctcactgggcggctgaactgcatcccttaggggcagagactgggaaccagctgctgccggtctgaccgtaagaagcggcagcctccctgatcagctaacgcagaggaccttaactaagagtgggcatcccaggggccgggcacagtggctcatgtctgtaatcccagcactttgggagtccgaggcaggtggatcacttgaggttcagagttcaagaccagcctcagcaacatagtgaaaccccatctctactgaaaaatacaaaaatcagccaggcatggtggcgcacgcccgtaatcccagctacttgggaggctgaggcaggagaatcgcttgaacctgggaggaggaggttgcagtgagcagagatgacaccactgcactccagcctgggcggcacagcgagaccccatctcaaaaaaaaaaaaaaaaagaatgggcatcccaggcccttgagtggctctgccccagcccaccccacccccgtccccgccacacacacacacacacacacgcgcacacaacatctgagccaggggtgggtatggaacccaggcctgtcagttcttaattcacccagaaattccagccaagcatcgccgttctcacccaacccgggaaaggactgctgaaggagagagagtgtctggtgcctcctccaggaaccctatgggggttcctttataataatagaggcttctattttctgagaactgccctgtttgccaggcactgcgctaagactgctgttcatccacacgactctgcttagatgtccttatccaggaaatacgaacctcggtgcttcatgcagcctagcagatttcaatagctcctatcagtagggaacgggaattcatactcagggctgtcagatttcaaagcagatgctcttaaatatacatccgctgcctctgtgctgcgagctgcccccctgggatgacccaggggcactgctgctgcccactgatgacctgcccaggtggtggcctctgccccattcagggcccctctagcgagctctggcctgcccttgggcctgtagtctaagggtctgaggtaggccatgcctcttgggcagccccaggcagcgctgtaagctgcagaggcctggtgccacattgcccccctaaaagttttcaacttatttttcgttttgttttttgttttttgttttttaaagtctcgctatattgcccaggctgatcttgaactcctggcctcaagcagtcctcccatctcggcctcccaaagcgctgggattacaggcatgagccactgcgcccggccttttcaatgtcttattatgggaaatctccaacataaacaaaagtagagaaaatgctgtcatgaacccaatagatctgtgcagagtttcccgtgatcccctcacccgagcagcgtgaagcttcctgcactagccaggaggcagccctcagcccttaggagggaggaggccctgacaacccaactccctgctgtgtttctcaccctggggcccttaggaaaggaccttagtccccgcaaatacatctccagggcttcccaggcctcccatctttccctcggcacaggctcggggcgccctcttgtgttacaaatgaattactgtttctgcggggcccagacctttccaaaggtgccctagtatccaaagccgctgtggtccgatggccttctcttcactcctgggggtgccggccacaaaggctgctccctagagaggccttctccagccccctgccagcccctggtcagtcgtctgtcccctaggagggaactggagggagtccccacggttggacaatccaactcctttctctggatccagcagctttgactccgctgtttgggttttctatggggaagatttaccttctcaattgcttctgagttctcatgacaaaatggcaagttaattaaggaaatcccttgcctaagctgtttattttatttttttagagacagggtctctgttgcccaggctggagggcagtgatgcaatcatagctcactgctgcagcctcggtgttctgggctcaagtgatcctcccgtcccagctactcgggtgcacgcagcctcggtgttctgggctcaagtgatcctcccatcccagctacccgagtagctgggactacaggtgcacgccaccacactggctaatttttaaattttttttgagacagggtctctctatgttctccaggctggtctcaaactcctaggctcgagcaatcctcccatctcagcttcccaaagtgcagagattataggcgagagccaccacgcccggcgatgtccttcaggattcagtttaaacatcatctcttctaggcaacttccccttctgcctccccaggtgtagggaccagccccacagggtctgtgggtctctccccgtgtgtggagacgagagagtatagaaataaagacacaagacaaagagataaaaggcagctgggcccggggaaccactaccaccaagttgtggagactggtagtggccccaaatgccaggctgcactgatatttattggatacaagacaaaggggcaggataaggagagtgaaccatctccaatcataggtaaggccacgtgggtcacatgtccactggacagggggcccttccctgcctggcagccgaggcagagagagagaggagacaaagagagaaacaacctacaccattattagagacttttagtactttcactaatttgctactgctatctagaaggcagagccaggtgtacaggatggaacatgaaggcagactaggagcgtgaccactgaagcacagcatcacagggagatggttaggcctccagataactgcgggcaagcctgacaatgtcaggccctccacaagaggtggaggagcagagtcttctctaaactcccccggggaaagggatactccctttcccgggatactccctttcccggtctgctaagtagcctgtgtttttccttgacactgaggctaccgctagaccacggtccgcctggcaacgggcgtcttcccagacgctggcgttacctctagaccaaggagtcctctggtggccctgtctgggcataacagaaggctcgcactcttgtcttctggtcactcctcactgtgtcccctcatctcctatctctgtatggcctggtttttcctaggttatggttatagagcaaggattattataatattggaataaagagtaattgctacaaactaatgattaatgatattcatatataatcatatctaagatctatatctggtgtaactattcttgttttatattttattatactagaacagcttgtgtcctcggtctcttgcctcggtacctgggtggcttgccgcccacacccaggcctggccgaggaactcttctcagtatccccatggtctcttgcacttacttacccccaccccacttttcactctgctgggaacatctctctggatacttctctgcctcccctactaaactgttaagttgtgcagggacaggtgaggacctgacattccgtcagagcaggtccttggtgagcatgtgctggtaacagaatggctctcatcttagcgttgtttcttttgttttgttttgttttgttttgtttgagacggaatcttgctctgttactcaggctggagtgcagtggcaccatctcatctcactgcaacctccacctcccaggttcatgcaattctgcctcagcctccctagtagctgggattacaggtgcgtaccaccacgcccagctgatttttgtacttttagtagagacggggtttcaccatattggccaggctggtcttgaactcctgacatcaagtgatctgcctgcctcggcctcccaaagtgcttggattacaggcatgagccaccatgcccagcctcatcttagtgttttgagatgctctatgcaaagtcctgcaagccggcactgtgccgtcccgctagcgggactggggatttgggctgctgtcccagctgggcctgaccttagtctgccatctcttcctccgcagcctacatgaagcggcggcacagctcagtcagtgacagccagccctgcgaaccgccctctgtcggcaccgagtacagccagggcgccagcccccagccccagcaccagctgaagaaaccccgggtggtgctggctccggaggagaaggaggcgctgaaacgagcgtatcagcaaaagccatacccgtcaccaaaaaccatcgaagacctcgccacccagctcaacctgaaaaccagcaccgtcatcaactggttccacaactacaggtacgacggctggctcacagggagcgccggtcggcccaggggaaggggctgatctgtccggaggccgccatggcgcacaggggtgaggctggggccggaggtggggcgctgggagctcggtgattggtccgttccttggtcccttagggttttttttttcttttcttttcttttcttttgagatggagtttcaatcttgttgcccaggctagagtgcattggcgcaatctcggctcactgcaacctccgcctcctgggtttaagcagttctcctgcgtcagcctcccaagtagctgggattacaggcatgcaccaccaagcccggctaatttttgtatttttagtagagacggggtttcactatgttggtcaggcttgtctcaaacatcctgacctcaggtgatctgcccacctcggccccgcaaagtgctgggattacaggcgtgagccaccacgcctggcagttccttaggtgttattggaggttttaactgcagagatgtaaggccacgtcccttcccgtcactgtcacatagttagaaacaggtggtatctgccatgacccagaaagaaaatcacctctcgattacatcatttaataagggagagtgtaggcattcatggttcaaaaggagtgaaacttttgtggtttagtttatatatatctatatttatagttatattcatatttatttatttttagagacaagggcttgctctgtcacccaggctaaagtgcagtggtgcaatcatagcttactgcaggctggaactcctgggctcaggcagtcctcccacctcagcctcctgagtagctaggatgccaatgcaccaccatgcctgctgattttttatagagacaggggtctcgctctgttgcccaagctggtctcaaactcctggcctcaagcagtcctaccacctcaacctcccaaagccttgtgattatagacatgagccaccacacctggcctgaacttttatttcttagtgattttgcagtgctttctcggggtcttctgccatgttatcttccaaattagtttgattagttctgtaattaaataaatgaagtcatttaagacctttgcatttgggaaagttcatgagttaatgaagacagattgagcatcttctagatctcagattctgagctaagtatttcaccgagttatatcacttaatcctcacagctcacaaatgtatatgagataccttattcttgtcattccttttttgttgttgttgttgtttgagacggagccttgctctgtcgcccaggttggagtgcagtggcacgatctcggctcactgcagcctccttctcccaggttcaagcgactctcctgcctcagcctcctgagtggctgagactacaggtgtgcaccaccacgcctggctaatttttgtatttttagtagagacgggtttcatcatattggccaggctggtctcgaactcctgacctcaagtgatccgcctgcctcggcctcccaaagtgctgggattacaggcatgagccaccgcacccagccagttctcttcattctacagatgaaaaatatagaactcagaggggctaaggaggtcaggccccagtgctgtcttggtagaacaaagtgcactgggatgaagtgtttggagtagatggaggaaacccactgaaggatcctgagttgctgatcatagctataaccatactctctgctgctagaaaccaagaattccagggccctgatggagatccctaagctagtgccttgccattgaccatctcaggtgctgcttcccattgtccctagggcacgataacattggggtaggtgctcctggttcaaccaaggtcaccctacgtaggtctagccgatggcagtggggccctcccagctgtgcacatgacacagtcatgggcagcacaaagtcacagtcaggctggaggggaagttgtgtctctcaccgggccctccctcccccataaggtccactggagttcctaaaggggcccagtaaaccacccaggctctgaacaaattgggaaactaaaatattaggtcagagtccaaatcacacctttattgcccatagaggcaaagtcacaagatgctgctcattgtgagaactgagcgcacctgctacgtggaccctagactcaggcaaacttccccacaatggcagccctggccccgcacaggcctccccgtgttccagctacctcccgcaaggacaaaatccaggattagccaggcgtggtaacacgcacctacagccccagctactcaggaggctgaggtgggaggatcacttgaggccagaaggcggaggttgcagtgagccgagatcacaccactgcactccagtctgggtgatagagccagaccctgtctcaaaaaaagaaagtccaggagctgcacagccagtttcttcattccaaatttagcaatcagatcaaaacagaggcagagggaggccagcagttagaacagtggaggtccctctacttggaaggaaacttcaacagtaatgaagcagaatgaaggaaatgaacggaaacgtggacaggggtttcctgaagcttctctttgccaggtgccatgctatcccatttccactttctttctttcttttttttttttttttttttttctgagacagagccttgctctgtcacccaggctggagtacagcagcacgatctcggctcactgcaacctctgcctcctaggttcaagcttctcctgcctcagcctcctgagtagctgaaattataggcacccaccaccatgcccggctaattttttgtatttctagtagagactgggtttcaccatgttggccagactggtctcaaactcttgacctcaagtgatccacccacctcggcctcccaaagttctgggattacaggcgtgagccaccacgcctagatgccatctctactttctagccacagagatgcgtgcactttgaagtctcctgcaattcacatccattttagggcatgtgtgataacgctttctataatatagacacatgcaaagccctaggttaccatctgggcatagatgctaccaattatacaaaacagttccaaaagtatgttccctggccctgctggagccacgtttgtttcccaagtcccccaacaggcctcagctgcatggcagtcactgccccctggccagggtacacaccctcgggtttctcagtttgctgcttgtcttgctggtcttctgacagtcatacccgtcacactgtagtctgcggtcattgtggggatgcctcttttgtgcattttagcactagcaaattcagtggtacacctgtggcaaagatagagaaggggagagaagaagaataccagtaggacctcaaaacttagtaagtaaaatttagtaatcacaggtctgggctgggtgtggtagcttatgcccgtaatcctagcactttgggaggccaaggcgggtggatcacttgaggccaggagttcgagaccagcctggccaacatgatgaaaccccgtctctactaaaaatacaaaaattagccaggtgtggtggggtgcgcctgtaatcccagctgctcaggaggctgaggcaagagaatcgcctgaacctgtgaggtggaggttgcagtgagccatgatcataccactgcactccagtctgggtgacacagcgagactctgtctcaaaaaaataaatgaatcccaggtctgaatccagagtagacactcaacaaatgcttcctttcaaaaataactccacaacaaagcaggctgggctgagtcaaatatgggatccaagagatgagtttgagctgcagagatctggaaaaatatcatggaagaggtatgaaatgagcaggctcttgaaaggaggattggagtagagaagaattttataagcaacgaaacaggtggaaggagaaacgaggggccgagcacagtggctcatgcctggaactccaccacattgggaggctgaagcaggaggatggtttgaggccaggagtttgagaccagcctcagtgagaccctgtctctacagaaaataataataataataataataataataataataataataataataaaataaatgaaggagaagtgagcattcaaaattagcatgaagtcgcttgtctaagatcacccagcaggggcgggcttggtggttcacgcctataatcccagcactttggaaggccaaggcgggcagatcatctgaggtcaggagttcgagaccagcctggccaacatggtgaaaccctgcctctactaaaaatacaaaattagcccggtgtggtggcacatgcctgtaatcccagctactctagaggctgaggcaggagaatctcttgaactccggaggcggaggttgcagtgagccgagatcacgccattgcactccagcctgggcaacagagcaaaactccgtctcaaaaaaataaaaataaaaataaaaaaagaccactcacccagcaggccaagggcagagggcagagcagagatgcagactgagtttcttctccaacactttggttctttcactaaatgctttgtacagaccaacctgccgttatacccgacagagcttcccgacactggatgtgttaaatccctaaccaagaacgtagttttttacgttcttttctcaggggttaaacaggaaaagtagattttcttttctcctgtcccactggaaccctcagggagtaacacttggtgtcaatttttgccccctcaaaaaaaaaaccgagctttatttcctcttatcctttcactttaagggaattagaaatatctctggctaaaggcaattaaaaatatctcaggctgggccgggcacggcctgtaatcccagcatttggggaggccaaggtgggaggattgcttgagcccaggagtttgagaccagactgggcaacatagtgagaccacgtctacaaaaaatagaaaaacaggcgggcgtggtggtgcatgcctgtgatcccagctactcaggaggctgaggtgggagaatcacttgaggaggttgaggctgcagtgagctgtgatcatgccattgcactccagcctggggaacagagcaagaccctgtcccccagcaaaaaaaaacatatctcaggctgaccatttacccaggattgatgacgagattgccagaacaacatgccacaggacactgctctcccctggaaaaacaggtccacccagttaggaactcagattctgaaccctcgcagccacggcattctgcgagccttgtgtgacttccctaaaaaccacaactgctcctggaagctcatctttctaggccagaagacagtattccttagaaatatggagacaaatctaggctaaaaaggatgatgtctcacatctgtggagcacaaagcatgtgccaggcactgagccaaaaaggtttttgtttgtttgtttgttttctgattttggttttggttttggttttttgagaaagggtctcgctctgtcgccgaggctggagtgcagtggcaaaatctcagctcaccgcagccttgaactcccaggctcagccaatccttccatctgagcctcaggagtagctggggcttcaggtgcatgccaccacacctggctaattttttgtatttttctgtagagatggggttttgctattttgcccaggctggtctctaactcctgagctcaagtgatctcccacccaggcctcccaaagccctgggattataggcatgagtccctgcacccggcctgagcagacagttttatagatatatcatcttattagtccctccatcagcacccaagtgcagtgctgctggccccattttacaggcaaagtctgcacacaggggccaagctcatgagcatggaaacacaagccccatgcctaacggtgtccgctccccaccccagccttagggcttatcacagcacacaaacagcggctggatagggggaagggtgacccctttttgaatggctactttgggtcctacatcatacatttaataccttatttaatcttaataacttctctgcaaggaagataccattctccacatttttcagacaagaaataagaaaactgaagttgtagccaggcgtggtggctcacccctgtaatcccagcactttgggaggccaaggcaggtggatcacctgaggtcaggagttcaagaccagcctggccaacatggtgaaaccccgtctctattaaaatacaaaaaattagccagttgtcgtggcacgtacctgtagtcccagctatttgggaggctgaggcaggagaatcatttgaacccaagaggcagaggttgcagtgagctgagatcgcaccactgcactccagcctgggcgtcagagtgagactcccttctcaaaaaaaaaaaaaaatgaaaaatgaaattttcttatttctcacagaatgctatggctatgaggttaaataacttctccaagttgcacagctagtaagcaccttagccagatatccaacccaagtgtgcctgcttccaaaaagcctgtactctggttttgggtcgggctgggaccaaaccttcactacccatatagcctcccgcctccccaaccagaataggtggggtggagagtttcaccccaactagcagtctcactgccaaggaacttgaaagccatagcgcccaggaacctgttcacagaagccaccatttcctgggctcccaaggtagccccagggaagggggaaagacttacacaccttggaacttctggggggcttctcagaacctttcctttctgaaccagagctcacaaatctttcaggacaaggttcagagctcactgcacgcaggaatcaaataactccatagcagattcacaaccccctgcaccccaccagagttcaataccctgggctaagctacagtaggatcttccccaggggagtccccacagtcagcacaggacccggcgcagagtaggagcccagaaaacctttgttttttttttcccttgagacaggatcttgctctgtcgcccaggctggagtgcagtggcagtcttggctcactgtaacctccacctcccaggttcaagagattctcctgcctcagcctcctgagttgctgggattacaggtacctgccaccacgcctggctaatttttgtatttttagtagagacaaggttccaccatgttggccgggctggtctcgaacgccgggcctcaagccatctgcccgcctcagcctcccaaagtgctgggattgcaggcgtgagctaccatgcccagcctcagaaagccttattggccgggcttggtggcttatacctgtagtatcaacactttgggaggccaaggcagcagaatcacttcagcccaggaggtcaagtttgcagtaaactatgatcttgcccctgcactccagcctaagcaacatcatgagatcctgtctctacaatattttaaaaatttaggcatggtggtatacacctgtggtcctagctactcaggaggctgaggcaggaggatcacctgagcctgggaggtggaggttgcagggagctatgatcacaccactgcatttcagcctgagtgacagagcaagacactgcctctaagtaaaataaggaaaggaaaaaaaaaaaaagaaagaaaaaatacagaatttggtggaattccaccctaccctggaccacaagcccccaacctgaccttctgtggctcagagattaaaattgtcactttggccactatccaataattggtcctctctcctgaagtcctgatggatgcagcggttatcaggcagtttcactgatgaactcacccagccttcgttactgcacaccaggcgccagtgcaaggcctgggtgtacaaagaataaataggaccttgcctttctcagtctagttggagcgggatgggatgggatggaggaaacgtgtcactcgataagaaccctggccagaagtggtggctcatgcctgtaatcccagcacttggggaggcccaggcaggaagattgcttgagcccaggagctcaagactagcctgggcaacatggcaagactccatctctttaaaaaatttaaaaattagcaagcatagtgacacagttgtggtcctagctactcaggaggctcagatgggaggatcactcaagcccagtagttggaggctgcagtgagctgtgatggcaccactgcactccagtctgggtgacagaacaaggccttgtttccaaaaggtttttgaaaaataaaataagtggccggacgcagtggctcacacctgtaatcccagcacttttggaggccaaggcagatagctcatgtgaggtccggagtttgagaccagcctggccaacatggtgaaaccccatctcttctaaaaatgcaaaaattagctggatgtggtagtgggtgactgtaatcccaggtactctggaggctgaggcaggagaatcgcttgaacccaggaggcagaggttgcagtctgcggagattgagccactgcactccacctgggcagcaacagggaaattctgtctcaaaaaataaaaattaaaataagtgcccgcggcaatttgttgcagtggagaataggggagtggtgtcccagccctgggatggctcctggccaggcccggaggggtgggtggtgactctggagaggggctgccccgtggcccgagggtcgctggaggggcacggaggggcctccaggctggacggagcaggagccccagagagaggggtctggctggggtagcaccagaggccctttccccagcagcacccccctcacgtccccgccgcttgttgtcttgtaggtctcggatccgcagagaactgttcattgaggaaattcaggccgggagtcagggccaggcgggcgccagcgactcaccctcggcccgcagcggccgggcggcgcccagctcggagggcgacagctgcgacggcgtggaggccactgagggcccaggcagcgccgacaccgaggagcccaagtctcagggagaggccgagcgggaggaggtgccgcggccggcggagcagacggagccgccgccctcggggaccccgggcccggacgacgcccgcgacgacgaccacgagggaggccccgtggaaggcccggggcccctgcccagccccgcctccgcgaccgccaccgccgcgcccgcggcccccgaggacgccgctacctcagccgccgccgcgccgggggagggccccgcggccccgagctccgcgccgccgcccagcaacagcagcagcagcagcgccccccgcaggcccagctcgctgcagagccttttcggcctccccgaggccgcgggcgcccgggactcgcgcgacaaccccctgcgcaagaagaaggccgcgaacttgaacagcatcatccaccgcctggagaaggccgccagccgggaggaacctatcgaatgggagttctgaggggccgcggccctggggcgggcagccaggctgggccgcaagggcctggacggggtcggacggggcaggcgctgcggacaccgtggcctgggcttggcccgcggcctgcaccgaccccgggccggacctgagcccgcagcccagaccccctccacggtccgcggcctgcaccgacccgaggcccagatccaaggccgcggcccagacccactctgcggcccgggccgaccctgcggcctccaccaaccccgcggcccagacccagcccgcggcctggacccctggaccgctttgcgcacttaccgccctgcgggccacagggcaaaatcgccataggccaaggtgcatatagaaaacaaaggagcattaagcccaatctatgtcgtgttttcaaggaagaaaacggaaatgtgtggtcgagcttttttgtaccctgaagtgttttttttattgccctaagtgatttccacaggttctggaataactcttacagctttgccttgtgtcctcctgttccgtgtgggctttaaaagaaaaaaaatcaaacccacatattaaaagggggctttttatctgccatctaatggcttcagagcgataatacactattatcttcttaaaccaggaaaaaataaaagggggggtgggatttttcagaaaaattaaaaaagaaagtttttgtagctgttcagttgccactaagagattgcacagtcaaaacgactctaaacacactagtttggattcctaaatattttcaagaaaagaatcttctcgtttgaaactttgaattaaaataaaacacatttactccacatattttttaacaaaaagaaaacgtcacatcaggaaactctgattttgtggtagctgacatagtgttttcttgtacgtgaatagaatcctgacatgtagtgcacattgatgtatagctttaactgaccctgggttttgcagaccagggtttgtttaatacactccattctaggccaaatcaggacaaaaaaaagaaaaaaaaagaaaaaaaaaaaagaaaagatccgaatctaggtattttataatctgctttttaacctctaaccgcagagcacgctgatcagacctcatatcttggaggtttaggagacaagttagaactgtagcatgtacctgttaattttgtttaatttatggtgtctcaatctgtctgtgcgtctgcacgtgtgcaagcattgaaagaaaggagagagtagtccgggcgagcacagcaggcagttccagggccagacgggcccatccccaagtagatagcagtctacggatctctctctggcacagaaggcacctcacctcacaccactctcctggatacctgatgaactgagccctcccaggggaagacactccccaggcctgggcagggcttacacgcgcactctctctcttctttccctttttcttcccaccgcaagcactgatgaccctgttgaactcgtgggaaacttcctttctctgcaggagagagaacgtggcattctgggctccccactcccatccctgtagaaatggcccaaactcacaccaaaacgtggatgctcttcaacttccaaacctaccatttgcccttctttcatttcgcctcttagttctttttatgcacagttttagggcagtctaagtacaaactgaaagtctaacttgtctctgattcctcccttgtctatgtgtatatgcgtgagaatagaggcgggtgagagtgtgcgtgcgtgtgcgtgtgtgcaattttatacgtctgtgtattttcttaagtacctgtgcacacgtagagtgcattactgccacctttttcaataagctgttttatcagttacggcttctacaagtttgctaatttagacttctttattgccatatctttaaactaacaatagatgatttcggtatatatatatatttttttttgcttatttataggtgctgtattttattatctgattgttaggaagggatgaaaggggcaaatattctttagagggatagactgccggcagtattgggtataatttacaagatgtagttgtcatactgtatattactgattgaaaactttttgaccgtattgtgtatcattgaaacctttgtcttaggtcaacatctttggatgacattttaatggtgcattcattatttcttaagtttaattaatattacttttttttttatttggggggtgggagggagttataattttaaaggtatgctctggctgttccacctccgtgtgcttgttaattaacttgtaggactttgactgtaagatgtgaaaccacgtttcttgcatgatgttttagagattatttcatttacagtcttttaacctgcagctgcagcacttagttcacgttttcacaaatttcaagagtcactacactaaagacaatgccttttcatgaataagaagttttcagaaggctctagggggctgggaggcaggctgttcgtttgtcttttgttgggggtatcatttctgaacttgaaatccagttcagggagaagagaattcaaaattagaggagcttaaggggacacgggtcaacatctagctcgattcaggtgcattgagaagagtgagttcacatcggtgacccttaggacagtgagtggcagagccctgacgactgtggtgtcctctccacaaaaccctcaagggacttttgtcatcatgtgtgatgaatctttaaatatcgtctaattttcataagaatgaaaagaagttaacaggaaatagtaggctagggtttagttttaaaggcatgactgttatttacaaaggtgttaaatctgaggaaattgacaaatacagatttgtccattctagtggccaaacagtaacagtctaaaatgcagtcattttgaccctcccaagcaatttagtcatatgtgttgttttctcttttctgtttttacttcttagatttttaactaggttactgttggttcccattctgtcttttttgccagacttacatctggtgccagatacaatcagttggttaaattttgcttgcagttctgtgtattttttttcctctattatttatttttttaaaaaaaatagagatcctaaccttagatctttgatgtgaagctagcactgtctgtaatacttctaagagctgccactaaaataatacagcaatccgtggccaggggagcaccccctcctggttgggcccctcagttggagtctaagggttaatctctcatcttgctaagcagtattcaagtgccttgaacagtgtcccctcggcatggctccccttcagcaggctggcattccaagcagtggcccccgcaggcagccgacccccttcctcttcacgctctatgagtttaaaaagctgatttgtacctctcccctgggggaaacggttccatataaaacactaacacttaattacaagctccattatgccattttaaatggcttctttttgttaattggaggcattgttcataacttaaggcttttgccattaacttagctggctaagcagaggctcggggtaaaatcagtgtttgcatttagcctcttgacccggagttccggcccaagctcccttgtgatagccgagatggcaggtgtgtgagttctgtcctagacctgtgcccaactcacttccaccccagaggagtcttctgtcctcctccccaacccccgagctccctggtaacctcctcttgaacttctgtatcagtgaagacatctgtggtttctgctcaccagacctctctttagaaagggttatcagagccatggagcttagctcaattggattcttctagacgatcttaggaggcatcttggcatgaggcagcttctaagcgtctcctgggacaggattggggtgacagcccagggatgcatgcatgggagaactctctgagaaatgccaggatcgtggctcacagggacccaccatcaaaacctgctactttgtgcaagtaattgaggcaaaagataccagtcgacagcctccctggggtagatcccttgtacctccaaagtacaaatacctccctgctcagtttccttcctgtcgccatctttgttttcttcccattgaaaaaccatcctgtctgatgtggacgttcaggtctgctggttggcggtccgggcccagagtgcagcagagctctgggttaaatattcctttctggccaccgcccaagcccaggtggccagctctcataccccatctccctccttggccagggccagcatcaggcgtgcagctcatgaccagtttacacaggctgcaaagagatcgctgtgggcctcggctgactactttaagattatgccacagccaggccctaaaaagagaggggaacaggagtccccaggtgagctctctgacgggcaggtgccttcccgactaaggttggactggatgactttgttcctcctgcatgcatgtcctttgatgcaagggtgatcaatgaactctgttgacattctatgcaatgtttttcattcctctgattttagcaaagcaaatcttactgaaaaatagcagagccaggggaacagacgcatgtccttctgggagtcacacaaaagcagagagattttgaactgaggggcgacagcctttgccttaaatgcagtatgacaggcgcttcttggcagaccagtaaaaacaaaagcccatagaccttactcatcccaaggccgacaagccagctgtacagggcgagatgtagcaacacggggcatgagcggtgggcgtgctgggctatttgctgtggtactttaggctggaggtttggctcctgtgctgccggtggggggccctgtccctccccagatgtcctccctcttcttcacactcctcattgtcccttctacctcactaacctgtcttctccatctgatgtcacccagaaccacaccccacagaactgtgaggcacgtgggctggagagagcagaaaagctgccagcgcagcagacacgaacatccctctgcctggtgggccggctttgtgtgtctctccttttgtgagcgcaacacggacaaacagctgtgctctgcaaggcacacggatgtttcccttccacctgttcccaaagctccagcagctgtttcttttgcaggcagggcgtggtctcggggctccgagggtcttgtctttggtccgccttcctttctgtccagtcctgctcagctgttaagatccatcatggccattatccttgtcccggactgccccaaagttcccagctggctttggggaacactgtagctcttgggtgtctcttgtctctggcatggttttagcgtcactgcgaacactcctttgcaaacatcaaacatctcaaagacggaaaaggatagatggcttcctccagcctacacgccccgtccacagtggcatcaccctcttatcccaaaagaatatgccagttcccatccagcaccgaagaaaatcagctcctggggctggtggttggaggtgggtctgtccactgtgggggccaaagtgttcccctgctggagacagtttgcaagtaagaacctaaggatggggacagcatcctgtgcttgggcattgaccagccaaagctcacatttagaaagccctcagtgcttctgtggtttcacctgggcatcgacgacattagggaagcctttgtgaccacaagggcagggcttgtgccctgagtggcgaggtggtgacctgaggccagtgtgatgtggttggatctcagcgtgtactgaatgccagtctggccggcacactcgaacgctaagagaatggtccaatttgatgatcttatttctatttcgatcaggttttgactttttgtagatgaaaactaccagggaaaaggggaagcaggtacccaataaagtttagaaagatccagtctgtgaaacccttagagatgggctgaaagttaagtccaccaacccttgggcttaatcaggacggaagaggagggggtgtggggggcagagcgtaaaacaagccccagccctactcccggccccccagcccagtcttcccaatcccagaggccccggcggcctgtgctcctcaccaccctggtcaggggaatagaaggaaatgcaatttccgcctgtctgcccgacttccaaaaactgcctcctcctgcccaggcctctcccaccaccaccttccctccaaagataaccgtgtccatgccatccgtggcatcatctcgagttttcatttttggatgaagtgacatttagctttaacaagacatttccaaagcgcctagtctcctccaaaatgctaactttaaaagttgggcattgtaggcgaaaaatcccaaaaaaaaaaaaagacaaaaaaaaaaggctggcgagagaaagacatttggctatgcataaatgtgcacttcccccatgcccccgttcttaaactcttaagatgcctttgagttgcttttcatgaatccttttagtttacccgataatgttaagaaagcattagtctacgttactgtaatttctgtagtgtttacgctttaatttctaccacaaaatatgctatatgctatgtatcaagctttctgtaatcagaaagaaaaggtgccttatatcccaatgtcacggctacatccctatggaaattaatcagaagcacagtgtgtacggaagcattgggacttctgctggtgaaacaagagaccattcagcaagacacattgaagtggcacggagctgcttttgttttataattcttttttccccccttttccttcttcttttttattattttattattttttttgtactttgctttaaacggaaagcacttaaatagatgactatgtgtaaaagctctgtgcaattgaaatcatttttcttcattttaaaaaaataacgtattgcacaccaaatgaactcaaagtaagctttagaccaggacgattcaggttatgaatgagtttgttcactgtagttccgtttgttcatgaaccgaagggaaaacaggcctccccgactccctccagtctcccagcctgcctcttggtgaccactgtgctgggcgtgcagggcccgcgggctctggccggagccgctggcctgacgaggcaggatagggagtatccgtgattcagaagctgagacccttccccagtgtctgaggccacagccatcccttccagcacttaatcttgtcttgttgaaatggactgactgctactgacctgccggcgtgcgtgagggtgattataaaaggatgtttccttgagaaaaaaaaaattatttctatcctcttctatttattattaggttaatcatttaagtacttatcaggagtgtattgttattttgtgttttgttgtcataaatgctttttgctgtcactctagtggttactatcctctgccttcctctcctcccctactcccccagagaaccaaggcgtctgggggattgactggggggcagagggggtttccccagcaaaatcaaacacctgtctccagagtagccactcaaaaactggtggtctctatgtgtctaactttttaaatgagagtgtttatgaacaaaaaaatttaccaacgtgtgagggagttgctgagttgaagaatgctcgcttgaggagcttcagaggaatcttagcaaagccaagttcagttccccaaagcctcctagagcctctggtaagacttctgggttcatgaagtttcggcgagccgtggtcagagagggcgcggtggcctggccaagactttacctccaagcgagagagtgatttcttgcaaggcccgcatgggttgatacgttttggttggttttttgttgttgtttttcttgcgtacaaagttggtcaaaaccatctttcaaagcaacagtgttttgtagtaccaggctgtggcttgagggctcacctaggagatcataggcagagggcccctttcccctataggtggttcaacgtggaggaaggttgggtgtggagattgcttgctgtggccccaagctcagccagcaggacacccagttgttgccaatcaggtgtgaaggtgaggcgccctgccttgatcccatgggcccagcagaaggaaacttaccccaggccaaggcaagggccctgctcaccccaaggtaggctgggaagagcatctctttccatatcatcacctccccttctccaagattgccgggggccctgattttgttctctctttgaaagaaaccctccaccgaaacaatggtccccatctccccagaagcctttttttttttcatttttctctaattagtctatgcatttctctctctcaaaccatcttctgcctcttcccttgagaaaacgggcatctcacgtacccccatctgagacctcttggaaaaaaaaaatcccgtgtattctggagatgtgagaattcacccaaaattcttaaaacattggagaatagcttgttataaaataaaagtgggggtaaaaagaaggtggttttccccacatccctttgcattgaataagagacctagttctttgcgtttgtgcaataactctttgctgcttgccttgagagcgggtagcaccacgctcctgtccagactactaacagcacaagacgcactcacagggtggcggaatcttccggaaaactctctataagctcagctccccccaccccacccccactctagcgttttgtcacgtcttacattttagcagtattttatattttctgtaacgcaccaagtcttagatctttctagagcttgtttgttcatcctcacaatcacagatttttttctccaatcctcacagagacccaattgaccaaaaaagaaaaaaggaaaaaaaaaaagtcgtcttttttttttttttttgtacaaatcgctttgagatgcctctggtgtgttgctgtgtgacatctctctggtaacattttatttcttgctatttgtttttctacattaagagtcaaagttgacctggctggcgtgggggtgggggaggcacccgtcggccccttggtgttgtccctctgtctttggttagccatacgatgtttgttctcagcactgtacaacggtccctatataatacggagaagcaatatcactgtatgagactcacaccatgtattattattcactagcaccctaggtgtgataattgaagtaaatatcttttatacaaacacaagaatgtgtgggttgtttttatttaaagtgctctggcctgaggacgagcagcaaacactgtcattcgaggtccaaagggcacctcaagaatcgccgttcccgaggtcgtcccctttgcacctgtccgcaggtcctcgggcgtgtggcttccgggcacacagaaaaccgtgtggttctaggatacatggggatctcgggcactgctctgtcaatctgcatctggttcacaggaagggcttcgccagggcctgcgttcctacttgctgttgtcaccagcactgtttgcctacccttgaaccaagcccttaccctccctggcgtccgcttccttttctgtaaaatggagacaccatctcctgtcatataggcttgctgtggggaaccaggaatggtggccagtgctggtgcggcactgggctggtggtggcagccccaatcgatggcacttgggcgaccaggactacggccagtctcctctgccgtgtggcctgcagctggtcagtggcgtggcctcagccttctgtgtgggggtctcactgtgcccctgactcctgatgtaacagaaagacaagtgaaaggcaccagttaatgcttgcgagtgggacagtggcttgcgggtctctggaatgacggggctactgagaagagtctctttccagatggcgctcgggctggaggtggggggagagctctgcagaggtggctgttaggcttctccgcgcagttgtgactcagaggctgttgctcgtcttgggttggaaaagagctgtctgccaggccgacgtgtgtctggtggaagtgggggatgacttggtcgcatattaatttggagatttcagattgtgaaatgtccacatgtgatacagaatcgtaagcccctctcccaattcaactggattcaatcctccctccagtgggagaacccagagtatgggatggagacaccccccagtgccaggtgccctcggcagccccgtgtctgatgcagtcacttagggccgggggtgtctctagagttgcccaaaatgctggtcccctcagataggagaggcctgcataaaaccctaagagctggcccagcgcagtggctcacgcctgtaatcccagcactttgggaggccgaggccggtggatcacttgaggtcaggagttcaagaccagcctggccaacatggtgaaaccccgtctctactaaaaatacaaaaattaaccaggcatggtggcgggtgcctgtaatcccagctacttgggaggctgaggcaggagaattgcttgaacctgggaggcagaggttacggtgagccgagattgtgccactgcactccggcctgggcgatagagcgaaactcagtctcaataaaacaaacaaacaaaaaaataaccctaagaactctgccagtttggtatttgacagactgaagtctaacgtggttaatttttctgtttgctagtttaggtatgcccctatgtatttcatgatctgctaactaaattaaaataagaaatgttaaaaaaaaaaaaaaaagaaagaaaagagaaaggaaggaaggaaaggaaggaagaaagaacagttgggcacagtggctcattcctgtaactcctataggcccagcactttgggaggaggtcaaggcaggaggatggcttgagcccaggagtttgagaccagcctgggcaacatagtgagaccccatctctacaaaaaataaaaaattagttgggcatggtggcatgtgcctgtagtcctagctactctggaggctgaggtgggaggatcacttctgcccaggagttcaacgctgcagtgagctatgatggcaccactgcactccagcctgggcaacacagcaagaccctaaatcttggggggaaaaaaaaaaaaaggaacacttagctcaaagtctttttcctcagaaagttgagacaggatctcagtctgtcaccacctcctcctcccaggcttaagcaaccctcccatctcagcctcccaagtagctgggaccacaggtgtgcaccaccacgcctggctaattttttgcagagaaggggtttcaccatgttgcccaggctggtctcgaactcctgagctcagaagatccacccacctggttctcccaaagtgctgggattacaggcgtgagccaccgcgcccggccccttatttgttatttgtttcgtttcgttttgtttttaagatggagtctggctctgtcacccaggctggagtgcaatggtacaatctcggctcgctgcaacctccaccgcctgggttcaggcgattctcctgcctccgcctcccaagtagctgggattataggtgcccgccaccacacctggctttttttttttttttttttttttttgtatttttagtagagatggggtttcaccatgttggccaggctgatctcgaactcctgacttcaagtgatctgcctgcctcagcctcccaaagtgctgggattacaggcgtgagccaccatacccagccgcgttccttatttgatgctctgaagaaacacaattgcaggtagacagggtggcgcgacgtgatgatgagatatattagagcacttgaattgtctgcaatggtcctgtgtgcttctgttacaaagcccctctgagtggctgcctgggggcatgctgctcctctccacggtcttaacatgccagctttgggggcacacagcttgctggtgtctacttcagctcatcactgattcctgtgaggtggcagaggcctgggcctgcatgtacggacccaaccagggaactgggagggctccacagagctaccgtgatgttgcccaggctcccggccagtgggccgttgcttagcaaccgactcatgcagtgtggagtgaccggcctccacagacaggggagacacagcctgggcccagccttaggcaggcattgctgaagttcctgtcttttccaagaagttcagactcttagaataccaacaggaagggccctggtcgagcatggtgggtcacgcctataatcccagcactttgggaggctgaggtggacagatcacctgaggtcaggagtttgagaccagcctggccaacatgatgaaaccccatctctactaaaaatacaaaaattagccaggcatgatggcacatgtctgtaatcccagctactcaggaggctgaggcaggagaatcacttgaacccaggaggcggaggttgcagtgagccaagattgcgccactgcactccagcctgggcaacagagtgagactctggctcaaaaaaataaaaaataaataataccaatacgaagagcccttttttttttttaagcagaatcaagtatggataagtaatagcagagcttcccatttggggcagtggtgtggcctccagggagcgggatttgaggacaaccctcccattgttcagggaggcgtcagtgtctctgtggtcaggagacactggctgtatcaggatcccagcagcgtctcttagtggctgatgaccgtgagcaagtcttaagtcgatgctcaggaaatctttgaaagaataaatgagtttaacttcctagtgcttctgtttctgtctctgtaaaggggatataaaaagccaaactcggtcgggcacgatggctcacacctgtaatcccaaggctttgggaagccaaggcaggaggatcacttgaggccgggagttcaagacccaccctgggacacatagcaagaccccatctctacgaaaatgtttaaaattcgccggatgtgctggcacatgcctgtagtcccagctacttgggaggctgaaggatcgcttcagcccaggagctcaaggctgcagtgagctataattgcaccactgcactccggcctgggtgacagagtgagaccctgtctccagttgaaaaaataagaggtaggtggctcatgcctgtaatcccagcactttgggagccgaggcgggtggatcacgagttcaagagattgagaccatcctggctaacatggtgaaaccctgtctctactaaaaagacaaaaaaattagccaggcgtggtggcaggcacctgtagccactcaggaggctgaggcaggagaatcgcttgaacccaggaggcagaggttgtagtgagccgtgatacctccactgcactccagcctgggcgacaaagcaagactccatcatggatggatggatggatggatggatggatggataactcacagggttactgagaggacccagtgagaagacctggaaaccactcacccagcacccagtggcagggcagagcctggaaggatccaagtgaggcctatgcagttactggcagtggaagcagcagaggactggctggccctgccagggtcttgctgcccgtggccaggccccatctcctggggtctttagtctcctctaacacacatggcctctgggtttggctgtgatggggtgggactgagccgtggtagatgcttacatcagacggattgcaaagagggccagctgtgccccagcctgggagaccctgcagctgtgggaatcccggtgcaactttccaactgaggaaacagatgcttgccgcggggtagtatccactcgcccgtgagctaatacataccgaaggctgaccgtgggccgctgccttacacgctggggttattacagggcaaaccaggagctcaccttcttgtgggagggacagacagtagacgtaataaataagtgaatgagatagttgcttcgaaggtgatcaatgttataaggaggatgggaagagcaagtgaaaagggttaaactttttttttttttttttttggagatgaagtcttactctgttgctcaggctggagtgcagtggcgtgatctcggctcactgcaacctccacctcccaggttcaggcgattctcctgcctcagcctcccaagtagctgggattacaggtgcatgccaccacgtccagctaatttttgtatttttagtagagacaggggtttcaccacattggccaggctggtctcaaactgctgatctcaagtgatccacccgccttggcatcccaaagtactgggattacaggtacgagccaccacacctagcctttttttttttttttttttgagatggagtctcactgttgcccaggctagagtgcagtgacacaatttcagctcactgcaacctcctcctcccaggttcaagcagttctcctgcctcagcctcccaagtagctgggactacaggtgcacactgccatgcccagctaatttttgttatttttagtagagacaggagtttcatcatgttgtccattctggtctcgaactcctgacctcaggtgatctgcccgcttcagcctcccatagtgctgggattacagatgtgagccactgcgcccagccgaaaggggttaaagttttaaatcgggtggtcagggtaggcctccctaagaagttcacttctctgtttaatttattatctttttctctttttttttgagacagggtctcactctgtcacccaggctggagtgcagtggtgcgatctcagctcactgcaacctccacctccggggttcaagcgattctcctgccccagccttccgagtagctggaattacaggcgtgcatcaccatgcccggctaatttttgtatttttagtagagacggggttcaccatattggccgggctggtctcgaactcctggcctcaagcgatctgcctgcctcggcctcccaaagtgctgggattacaggcatgagccactattcccagacagaagttaacttctttttttttttttttttttgagacggagtcttgctctgtcacccaggctagagtgcagtggcgtgatgtcagctcactgcaacctccgcctcccaggttcaagtgattctcctgcctcagcctcccaagtagctgggattacaggcgcccaccaccgcgcccggctaatttttgtatttttagtagagacggggtttcaccgtcttggccaggctggtctcgaactcctgacctcaggtgatccacccgcctcggcctcccaaagtgctgggattacaggcatgagccatcgcgcccagcccagaagttaacttctaaacagtactggcagagctgagggaacgagccctgcagatgtgagaaggaaggacgttctaggcagtgagaactgccagttcaaaggtctcgtggtgcaaatgtctctggaaaccagcatggccgcagcaccgtgaccaggaggaagagtgggaggcgatgaggtcagagagaccaaggagaggcggagcatgggggccttgtcggctattgctgaggctttgttttttactctgagtcaactgggaggcattggacggtttgaacagagggtcctggctctggtggggaaacaggaagtaggattcattggtaggagtgagtaaggaggggtcagcacaggggaagccctcagaagctcacccaggaggccacaactggggctgcgtttaacccccacagccatgccagatgagctgcttctcagccaccacgtgggatcgatttcttccacattgaacttggtcaaggcccgctgctttgtgctgtggatcttctggcagccagggaacttagacttggccctgcatatggcctcaatcacaccctcatggttctgctcttagtacggatagacacaatgacctggccaacataaaccctggctgtcacaccctggggctttccaagggcaccccgaatacttgcctggtgcctagaccacagacagcacgaggtcagagacacaaatgtccagtggaaagaattgtctccaacgttccttagggcaacccatgtaagaaacagactgtgtggccgggggtggtggctcacgcctataatcccagcactttgggaggccaaggtgggtggatcacctgaggtcaggagttcaagaccagcctggccaacatgaagaaaccctgtctctactaaaaatacaaaaattagccgggcatggtagcgggcgcctgtaatcccagctacttgggaggctgaggcaggagaattgcttgaaccccggaggcagaggttgcagtgagccgagattacaccactatactccagcctgggcaacaagagcaaaaatctgtctcaaaaaaaaaaaaagagaaagaaagaaacagactgtgtactttactgaggaggctgctgtttgcaaccactgcaccctacaaggtcactattttttttaagagacagggtctcactctgttgcccaggctagacggcagtggcataatcatcgctcactgcagccttgacctcctgggctcaagcaatcctcctgcctcagcctcccaagtagcagggacaggcgtgcaccaccacacacggctaatattttaattttttgtagcgacagtctggctatgttgcccaggctggtctcaaactcctggactcaagcaatcttcctgcctcagcctcccaaagtcctgggattacaggcatgagacagttgcacccgaccaactttttaaaaggctctctctggctgctgcttggtgcccagatcataggttgcagagggaggccaatgaggaggctgatgccatcatcacaatgagaggtggtcatgactcggactaggtggcagcagtggtaaaaagagactggattctggagatattttgaaagtagagccaaaaatgagacttaaggcaggggcagtggctcacgcctgtaatcccagcactttgggaggccgaggtgggtgggtcacttcaagccaggagtttaagaccagcctgaccaacatggtgaaaccctgtctctactaaaaatacaaaaattagccaggcgtggtggttcatgcttgtagtcccagctgctcgggaggctgaggcaggagaatctcttgaacccaagaggtggaggttgcagtgagttgagatcatgccactgcactctagcctgggtgacagagtgagactccgtttcaaaaaaaaaaaaaaaaagagagagagagagacttaagacagattcagcatcaggagtgatggagaggagtgaggctacctcccggggtttggtctgagccaccgaagggtcgcagagagctgggtcaggccgggaagggggtctctgcctatccctgcagatgtcacctcccgaggctggactacaggggtccacacttgggcttggggagtacagacttggggaggaagggatcaggctgaaattcagacctgtgaaggttgaaatgccagtagaagatcaagtagaagataaatccaaggagaggcgtggactggagtcccacactggggaggcatcggcttgtcaatggcatcccgcatggccagagcggatgagggggcagagtgaggcatctgcggatggtccctgtgcagcagcggcaagaagcttagcagggagggcaaggaccagtcaaggaaacagggcagagcagccagccggggaaggaggcccaggagggtcggtgacctggaaactagctgctaacacagcagctcagatgagagccgaaaaacaaggacgtggcaatgtgcggaggtcattagggaccttggcaaggacagtcagcgtgaggggtggcagagtctgatgggaagggcttgaggaattggaggagcggaattagacgcttgagaagagacagcttcttcaaggagttttgccagagtggggtcaagggaaggggcgtgtgtgcatgtgtacatgcctgctaggagaacatgcttgcatgcatgtagaaggcaagagccggtgctgcaggagagggtggcattgctggagaccccattgcataggggtgggggccagcacctgcaggcatggggagccggctgggggggctcagtggtcacctgaggctacctgcaggatctacaggtgcagaggcagggaggggtggatgaggcagcagcttggccccctcagtgtcctcctagcagagataccatgtgcaccgagcgtctccaccattcctacctggcctgcaagtgatttaataagacaggggcagccgggcatgtggctcatgcctgtaatcccagcactttgggaggctgaggtgggtggatcacctcaggtcaggagttcgagaccagcctggccaacgtgacgaaactctgtctccactaaaaatacaaaaattagccaggcatggtggtgcatgcctgtaatcccagctgcttgagaggctgaggcaggagaatcacttgaacctgggagagagaggttgcagagagccgagatcataccattgcactctagcctgggtgacgagtgaaactccgtctcaaaagaaataaaaaataaaaagacaggggcccctcgcgccttcaggaaaaccgtaggtacaacaccgctggcctcgctatgataagtctctgcatttaatccttctgcagtcagaaatcatgcctagactttttttgggcgtggtgcagagagggacagggtcttgctctgtcacccagcctggagtgcagtggtgcaatcgtagctctctgcagcctggaactcctggactcaagcgatcctcccgccttagcctcctgagtagctgggaccacaggtgcacaccaccatgcccggctaagttttgtatttttctgtagagatgacgttttgccatgttgcccgtgctggtctcaaacacctgagctccagcgatgctaccacctctgcctcccaaagtgctgtattccagccgtgagccactgcaccgggccctcctgaagtcttgaccttaaagatgctttgattccctcctcccctctgtgaggtgccccctctaggatgtctttgtgggttctcccagaggatgaggtcccagtctttcctgaggggaaggggaccgtcttgggcccttgcaccacagactccttttctgagcccctttccctgtcttatgctcacttatccacccgtcgcctgtcatccctctctcccctaaacaaaatctgtccctctctcctgggtttctgggttgcagatggtccattccacacactctatgcttctcaagatcccctctcgggcacacgttactgctcttccaccagttctgcccatcgggctgtgccttgcagccctgcatgcccccaccacctcgacgacaacaccttcgcctcgctcagcctctctgtagcttctgaccccctgaccctccatattcattgaccctcctgcctcatcttggtgccttcacatgcatcctcctgctgtctcccctgcctcctgctgcctcttctcagggtctttgcgggaccccctttgtggatcaccccctgaagctctggccacctcacagcagcactgtctcaggacctgtccaccacccctgattttctgtattagctgttcttgcattgctatagagaaatacctgaggctgtgtaatttatcaagaaaaggggtttctttggctcatggttctgcaggctgtaccagaagcgtggcgctggtgtcggtttggcttctggggaggcgttggaggctttactcatggtggaaggcgaagtgggagcaggtgtgagacatggcgaggccaggaggaagagagagagaatgggggtgggggaggtgccacgctccttaaacaaccagatccctatctcagagacagcaccgcgccacaagggacccgccctgtcccccaaacacctcccaccaggccccacttccaacactggggattaattacttttttttttttttgagacagggtcttactctgtcacccaagcaagagtgcagtggtgtgatcacagctcactgcaacctctgcctcctgggctcaggtgatcctcccatctcagcctccctagtagctgggactacagctacaccaccacacccagctaattttttgtgtgggtttttttgtttgtttgtttgtttgtttgtttgtttgtgtagagacagggtttttccatgttacccaggctggtctcgaattcctgggctccagtgatcctccctcctcagcctcccaaagtgctggaattataggcaagagccactgcacctggcttgattacatttcaacatgagatgtggacagggatgaatatccaaactatataattccacccctgccccctcacgcaaatctcatgtccttctcacattgcaaaatacaatcatgcctttccaacagtaccccaaagtctttttttttttagatggagtttcactcttgttgcccaggctggagtacaatggtgccatctcagctcactgtaacctccgcctcccaggttcaagccattctcctgcctcagcctcccaaatagctgggattacaggcgtccgccaccatgcccggctaattttttttttttttttttttgtatttttagtagagacgagttttcgccatgttggccaggctggtctcaaactcctgacctcaggtgatctgcccgcctcggcctctcaaagtgctgggattacaggcgtgagccaccacgcccacccccacagtcttaactcattacagcattttggtcacaaccatcgaacaagtctctaagaagttccaaactttccctcatcttactgtcttcttccatgccccccaaacgcttccaagctctgaccgttggggccctagatctcctcaaccagcatatccagcctcaggtccacaggtccaaaccccaccacacacatgcccttagctgttcacaagcaccttcgtgcttaccagaaccgagccagccagctgcccaccccttcccccacagggggccaggcccgggcctccccacctgggttctgtacagcgatggggtccacagctctctctccagctccttctgtgtcctcgccccagagccctgtactccagaggttgaagaacttgccgaagatcgtgaaattcataaaaggcagggccagaatgcaagcccggttctggacttgacatcaagtggccaccagagatgtcaccccagcttccccacctgcgtgttccagcctccagcagagaaggcagggtgaggcagccggtgggggataggggaccctcccgtggccggtgaggccctgtccttctctaagtacatctaactgaggcccctctctggtggaagcccgcacagccagtctcctggccttcgcttcctcccagcgtggagtgacagtttcaaagcacagctctggttgctgctgggatccagctgggctctgggacagtgtccagatcctgtcccctgcagcctccagttctctgtccacccccctctacccacagccttccctccagtctcaccgtctgccagcctctgctgccctgtcttacccagcctgttctctctgcctcaccagcagccatcccccaattctgctgcccgtgcaactggcctgtgctcctatcaccccaagccacctcttcagggatggcctcccccaaccactcagccctgcaccctcagatcccctcaggagctaacccagtgcccagagcatctgcagcagcgccaatggccaggcctccaggccagcttaacacatgggccttttccaggatagcgggccaccagcttggaactggggcagcctaggatagagggtttgcagccaggatgctcacacctgcacagaatgtcacctacatacacggcaggactgtgtgcccacccctgcagtagcagacacaggaacaagtgcacggggaccaggcccacgcaccccatcatctccctggtgcccacggatggtgctgggagctgcaagttgctgccaccccagggacctgaccaagaccacactggggtggtcacagactgggggcagataaaacaggcagtgcaaggaatcatctcagcagctttttatccacccctcttgccaggcgcacacctccagggaaaagggctcactctggccaggcaaaagtcacctctgcaaaggttctccatctcagccctgtctctctgtcccccaggccctcatccctgaggtggaatgtggcttccctgagccttgttggagcttaacgccctctttttatcccaggagtctgtccccatggtcccagcacggttcttggatgtgctcctgtttgtggccaaactgaagcatcccctcccttggtccaggaccttcacctctattaatgtgacccaaggccccattagctttctggtggtttcctctccctacatctcacaaccgctgtccacctcccatcctaagcatgagtggccggctctgccatcccatcccacaggccaggacccaaggactctgtactcaggccaggagggcatggtatttatcgtctctctggacctctcccctttggggtctccttaaagtccctgcaggtggcccagggccagccccaaccctgcccccgacagtcctccctccaaggccgggtcctgccttcaggtcctgcctcttccctcatcccctcctcacttccgcagataccaccttcctgccagggacccaggggctcagtgaatgtctgaaggaagaaatccatttaggggcccagtgcggtggctcacgcctgtaatcccagcacattgggaggttgaggcggacagatcacttgaggttgagaccaacctggacaacattgctaaaccccgtctctactaaaaatacaaaaattaactgggcacggtggcaggcgcctgtaatcccagctactcaggaggttgaggcaggaaaattgcttgaaccttggaggcggaggttgcagtgagccgagatggagccactgcactccagcctgggtgactgagtgagactctgtctcaataaaataaaataaaataaatccattcggggcctgaacgaggcgagactctggtgtgagcaagggcttagacagagctgggggtggatgccttgggtttggtcccaggtcgggaagcctccgttctttgactgtaaaatgtgaatcgtcttttctgactcatctataaggacttggtgtgcagtgggaacccaggagcatgtggaggtgaggctgggctgccccatcctggcccaggacactgagcccagccagggcaggtatgacagccggtcagcaggccgcgcagtcagggatgagtccacggaggaggccgcacataccatttccctggcactgcccacagcctgcagcctttgtgcatttctgaggccacagtgccccctggcggctgtgcagcctaccccaaaggacagcgtcctgggtctcaggcctcagtctccctctctgcggccccaacagctcaccctaaacaaggtttattgttaccatgttacatgtcaccatttgggaccagaaagggggatccagtggccctgagccgcacagtcaaccagaaacagggccaaacctcaccctcagggctgcctggctcctgggtcactgaagtcctgcctggcaatgcgtgcttgggtctgggtcccttccccgacatctctcaccctcctgcagggcaggaaagtcacagtttggatgctttgttataaagatgaccctggcacctggaggagggagagacagacagggctgtgggtcgggggactccttggggaccacgccaccccaaccactgcagctggagcctctgttgggggcgggaccaagcacctctgttgtcagcccagaggtggcacccctacgcgctccactgcacccccgcggctttctctgcctctcctacccccaggcttcccactggacattatcccagaacatcagctaggaagcaacctgagcctccttgcccctgcctgacaagcaaagtgaggcccagagagggaaaggggctggccagggccccccaaacagccgtgggcagagccacgttgcaccggtttctcctaatccctgacctgagctccttctcctacccaggggatttcatcaatccagagagtgcttggggccaggagtgcctctgacagtcagggagggcttcctggaggaggccctaggtctaatggggtcttctaggcagtggtgagttgggagggaatagccagcactctcacagcatccaggcagccctgcttccagaccgtgggttggagaggcagaaccaggggagggcaccaagggtcccaccaggctccctctgacggccatgtcttcctttggccacaggacgctgtgcagagctgcaagtccgtatcactgaggctgtggccacagccactgagcagagagagctgatcgcccgcctggagcaggacctgagcatcattcagtccatccagcggcccgatgccgaggtgagcccacccccctgccccatgcccatctcgctacctgcccaactgacttagcctctgcaaacactgacttcccagattagcctgtgtatcaggcagctggtgacaacccagaagggctgtcacctaaaaccattgggttctccctgcttactccatgaataccaccctgcctccgatttggggtgacaggccatggggcagaggccacagggcttcctagcggtagcacagaggcccgtctttccaggcactgccctgagagcagaggcagaggcaaggccaggaccatgcacccatctcccagctaaaggacctggagcccagagatcacagcaggctgggacataaacagcccagggagagcatctcctcgcccacctcccattctgtagagtccacagtgggactccgggagagaagtctgggctgtcccaggtcacgtggcaggctggttgcagggccagggaggcccaggtgtctgatgcatgtcaaagctgagtggctgcgaggagagctgcactgctgctgaactctggcctcaggagtgacttagggcccagccatctcttctttggtagctcatgtcacgtgtccaggtccgggccctcctgcagccagcctgcaccccggatggccccacccactccttgccacacccaccctgccatttgccttggccatgctgaaagggaatattccgtgcccattgtgcggaggcacctcctcatcgcttcctgtcacctgcagggtgccgctgagcaccgcctggagaagatcccagagcccatcaaagaggccactgccctattctacggtaaggagaggcctgacccatgggaggagggaggaggagggaagaggagacaggtgataccgcctaagaacacagatccccaaagagtagtcccttcctctaagaaggtcaggcccccacgcctgcaatgcagcagcaaccttcaaagggtcgggtaaggctaggtgtggtggcgcacacctatagtcccagctactttggaggccgaggtgggaggatcgcctgagcccaggaattggaggctgcagtgagctatgatggtgccactgcactccagcctgggcgacagaccgagaccctgtctctaaaaaacaaaaaggtgaatgagccctcaacctgcctttctggatcttagactgacaccccccaccttggggccctgacccttcagccctgccggtggcctgtgaaaggctggtgagtggtggtcagccaggcctcactgccaaagtgcagccggaggtccgtgcagtgaggggaaggcagcctccttgggtattgaggacagaaactgaggctgctggactgggatactgggggtgtgcccatgcctccccagttcccctcctgcccctttgcttccccaggggatataggcctagtctgacagctgcaagggtctcagattcaaggacagagtgactgggaggggagttctgggcctggccctctgacagcgcagacgggggtgctgggcccttccccagcgtgcgtattgtcaggtcagcccctgccatccattctcacgctccccggttcccctggctgtcccctccccttccccgacctgcccagcaccagggagtcagacaccatgtggcttctaccccatggcatttggcagaaatcccccagggctgggggacccaccccaaagggccgcctgctgggttccacctcctgccaccccccaagccaccctcctctacctgctaggacctgcagcaccagccagcggtgccctcccagagggccaggtggattcactgctttccatcatctccagccagagggagcgcttccgtgcccggaaccaggagcttgaggccgtgagtcacatccttctctccctgatgctccttgggcccaaggacacagttggggaacacacaggctttcaggagagagatgtggcacagaccgtaaacctcagggggaagagatttgttctgtgcagtcagggagggcttcctggaggaggtcatgccacactgggctttgaaagaagactcagatgctcacagtagaggagacacgggggccagtgagccagaagggagcatagatcattccaggtgaaacaagtcgccaggcaagtgccctcttgccaggctgggaggcatggccttcaatctgcagggaggggcaccaaggaaggatttaagccaggcagtggcactgcaagaatgcagggtgagccaggtgcggtggctcacacctgtaatcccaacactttgggaggctgaggcaagtggatcacttgaggttgggagtttgagaccagcctggccaacatggtgaaaccccgtctctactaaaaatacaaaaattagccgggcatggtggcgggcacctgtagtcccagctacttgggaggctgaggcaggaggatcgcttgaacctgggaggtagaggttgcagtgagctgatgagatcgtgccactgcactccagcctgtgtgacagagcaagactccatctcaaaaaaaaaaaaaaatccttcctttttaaggctgtataatattttattgtgcatatagaccacattttgtttatccattcacctattcatttacattgcctccaccttttggctgtggcgaataattctgctgtgaacatgggtgtataaatatctctccaagtctctgccttcaattcttttgggtatctacccagaagtggaattactagatcctatggtaattctatgtttaacgtttttagaggaagcgtcatactgccatatacttttttgtactgctcaagttttggttgtgtttgttttttgagacggagtcccgctctcttgcccaggctggagtgcagtggcacaatcctggctcactgcaacctccacctcctgggttcaagcgattcttctgcctcagcctcccggatagctgagattacaggcgtctgccatcacacccagctaatttttgtatttttagtagagacaggatttctccatattggccaggctggtctcgaactcctgacctcaggtgatctgcccacctcagcctcctaaagtgctgggattacaggcgtgagccaccgcgctggccactgcttgaattttgaatagtgtgaaagaaacacttattcaagcatttgaataaattgaaaactgagattccatttcacgttgcctttagattggcaaatattaaaaccacagcgtgtgattccatgaatacgaacattcggtataggcaaatccatagagacaaaaaagagactgccggttaccaggcagtaggggaggagggaatggggagtgactgctggcaggtttggggtttcttattggggtgattttaaatgttctggaattaggtagtggggatggttgcataacattgtgaatacaaatgaccgaactgtacactttgaaatgctgatgtttatgttatgggtattatatctcaataatagtttttaaaaggctaataccaatgacaaaaaaaagtatgaagaaatctgaccaggcatcgtggctcatgcctgtaatcccagcacattgggaggccgaagtgggaagattgcttgagcccaggagtttgagaccagcctgggcaacgcagtgagaccccgactctgcaaaaataaaaaagtagctgggcatggtggtgtgagcctatagtcccagctacctgggaggcagagatgggaggatcgcttgagtcgggaggctgaggctgcagtgagctctggtcatgccactttattctagcctgggtgatagagcaagaccctgtctctaaaatatatagacaggggccaggcgcagcagctcacgcctataatcccaacactttgggaggcagagatgggtggatcacctgagatcaggagttcgagaccagcctgaacaaaatggtaaaaccctgtctttactaaatacaaaaaaactagccaggcatggtggcacatgcctgtaatcccagctacttgggaggctgaggcaggagaatcgcttgaacccgggaggcagaggttgcagtgagccgagattgattgcgtcgttgcactccagcctgggcaacaagagcgaaactccatatcaaaaaaataataaaaataaaaataaaaaataaaataaaatatatagacagggtcttgctctgtcatatattaaggttgatgcaaatgtaatcatggtgtttgccattacttttaagggcaaaaaccacgattacatttgcaccaacgtgatacatatgaagaaacctgacccaagatccctgacttctgcctgtggtggggccacagtgggggaaggggcagctttacagagtcaggcaggtcaaggagaaggctgtgggcacagaaggggctccaggtagacggagcagcacctgtgccagcacggaggcctctcccccacccctttccttgcccctccccccccaggagaaccgcctggcccagcacaccctccaggccctgcagagtgagctggacagcctgcgcgccgacaacatcaagctctttgagaagatcaagttcctgcagagctaccctggccgggtgagggccctcccctggcctcagctccaggtggaccaggcagggagagaggccgatcagggctctggagatgggagggtcggggaccaagacctgctgggcagcactgggccccagagacccctgaggccttccgacatctccccacccacccacctgcctgctagctgccctccctaagccggcagaagctcacagagtggagcccctgtccagattcattcataaaaactggccagaaggaccaggcacggtggctcatgcctgtcatcccaccactgtgggaggccgaggcaggagaattgcctgagctcagaagttcgagaccagcctggccaatatggtgaaaccccgtctctactaaaaatacaaaaaaagtatccgggcatggtggtgcacacctgtagtcccagctactcaggaggctgaggcaggagaatcgctggaacccaggaggcggaggtttcagtgagccaagatcacaccactgcactccagcctgggcaacaagagcgaaactccgtctcaaaaataaaataaaataaaaataaataaaataaaattaaaataaaataaaataaaataaaataaaataaaataaaaaaataaaatataaaataaaataaaatataaaataaaataaataaaataaaataataaaatagtaaagtaaaataaaataataataaataaaataaaataaaatagaaaagaaaatactagccagaagggccaggcacagtggctcatgcctgtaatcccagcaccgtgagaggccgaggcgggtggagtttgagaccagcctggccgacatagtgaaaccctatctctactgaaaatacaaaaattagccaggcatcgtggcacgtgcctgtagtcccagctactcaggaggctgaggtgggaggatcacttgagcccaggaggtacaggctgcagtgagctgagatccagccactacactccagcccaggtgacagagcaagaccctgcctccaaaaaataaaaataaataggctgggcatggtggctcaggcctgtaatcccagcggtttgggaggctgaggcgggcggatcatttgaggtcaggagttccagaccagcctggccaacatagtgaaaccccgtctctactaaaaatataaaaattggctgggcgtggtatcatgcacctgtaatcccagctactcaggcggctaaggcaggagaatcgcttgaacctgagaggtggaggttgcagtgagccgaggtcacaccattgcgctccagcctgggcgacagagcgaaactctgtctcaaataaataaataagcaataataaaaaatgtaaacagaatttggtccacactccaaaaagcaaccaagagagtggatcagaaactcacttgccgagtttttctgggctagggaggcctgtgcgtggcttctctcagcccccaggcctcccaggggccaccccgtgccaggaaaccctttctatgagtgagagaagagcgtggggcatagtggggcagggattcacctctccctcttcctttggggcccagcagcccccagccctgtccccacccatcagagccgctccttggccaccagagggcactcagactctgcaaaccagcctggctctgggtggccagctggggggcgtctcctctcccagctgcctgcctgctcgcatgaccaccccacactcccagcaaacccaccttcctgcagctgcgcccggccctgcctgggcctcagttccccatctgtgcccggaggcactgtggccctgaccccatgggtaactccatgcccctgtggcaggaggcaccagccacattcacattgtcaccccagcaccctctcctcccgcctctgagatctagggctccctcccccacttcccttttttgcagatgaggaaactgaggctcccctgggctcctgcccttcccgctgggccccaaggcactgactggttctcttcccctcctgtctgtgcagggcagcggcagtgatgacacggagctgcggtactcgtcccagtacgaggagcgcctggaccccttctcctccttcagcaagcgggttcgtgagcccagcctgggcaggggaggggaggggcatcagcccagggaagcccaggggtccccccatcacttggcccccatccctgagcactcggccttccctggctcccctccacctgccctcgtctgggtgctctcggccagccttgccacgccagccctgcacaccctggcccctcaggccaggagcccccccaagacagcctccccaccgcttcagtgcaatgtaggcccagggcccattcaggaacacctgccgaggactacccgagggtgtgtggcagtgaccgggttaacctggagtgcatttgcgggacaggcagacaaggaaaaaccagttacagctcccagaatcgggcgatccattgtggggaccccaccccacaactcccctcccccacccagactgcagaagttctgcccgtggagtactttcccatgggcagaatggacggctgcagaggcggggaggggctctcacagatgtcaggggagtccagaatgtcacactgagtagactgtgcacccagggaagcccctggcagcaccctggcagccccctgggggtctgcaagaacagcgggcagggtgtcctgtggctggccaggccctgctctctgccacaagccagggcctgtgaggtcctttggggtcctttcctgactgtccctccctgtgcaggagcggcagaggaagtacctgagcttgagtccctgggacaaggccaccctcagcatggtgagtccctgcccctacccaccccctccctggacaggcctgagcctctgtctccaggcacctcttcacctgccctgcagcccaggctggaggagccgccagccctgccaagagtggctgtgtgatctgggacagggtctctccccttcccgggcagatcctctgagagcatggttcacagcatggttctgaactgggctgtagagggggcattcctcagaattcctgcagcctagagtcagacatggtggctcacacctgtcatcccagcactttgggaggtgggaggattgcttgagcccaggagttcgagaccagcctgggcaacacagtaagatcctgtctctacaaaaaataaaattagccaggcgcagtggtgtgcacctgtagtcccagctactcaggaggctgacggaggaggatcacttgagcctaggaagtcaatgctacagtgagctgtgaccactacattccagcctgggcaaccttgtctaaaaaaacgtttttaaagaattccggtggccgggcacagcagctcacgcctgtaatctcagcactttgggaggccaagttgggcggatcacctgaggtctggagttcgagaccagcctggccaacatagtgaaaccctatctctagtaaaaatacaaaaattagctgggcgtggtgacgcacacctgtaatcccagctactcaggaggctgaggcaggagaatcacttgaacccaggaggtggaggttgcagtgagccaagatcacaccactgcactccagcctgggcgacagagggagactctgtctcaaaaaaaaaagaattccagcagcccatgtccctggcccataatgatggaataggggccccagcttcctgtcccttccctccccttgccaccctagggccctttctgtgaagcccaggcagccctgcaggggtgggtgaggccggccccatccccactcaccccctccttgctcccaggggcgtctggttctctccaacaagatggcgcgcaccatcggcttcttctacacactgttcctgcactgcctggtcttcctggtgagtgtgcacacgggcgggccagaggcacattcaccatccccagccctgacctccagggcagcaggggcctgttacggtggcctggcccctgggcctaccccaagctgcatctctagcttgcgaccatgcctctccccttcgagagccttggcccaccccagggacgagaaggacccaccccattgggacctctggccagggcaccagccgggccgctccgtgaaagaggcctggctgatcacatctgggactggtcctggacgggcttcataggaagaagggatggagtgggaagggagcaggtctaatgaactccaccaagggacagtcacgaagactgcacagagaaggggcgtcttgaactaacctccccagctgtggaggtggcgttctagttagcggataagggcctccatgtctgccaagttgggggagaagaggggtggaaggctgtgtctctggaaggatccagccttggggtctcctgtccccagcacagtcaagatggcccctacagagctaacctgggctcaagttctgaccccagggtccagcggctcctggcccttccaagggttggcccacagtattagaggaggtgcctccgtgtctgggcccatctgatcatctgcagaagcagtgggtgcaggaacatgtctaagacccacccgccccggagtctggggctcgagaacctttatgttccaggccaggcccaggggccatgggtgggctgcaggggtggccttgaggcgaacgggcagctcaccgtgtctccacctggccaggtgctctacaagctggcatggagcgagagcatggagagggactgtgccaccttctgcgccaagaagtgaggacccccacttgggccccccctcagccccacagcgagctcccagcacccccgcaacacccccgagttcctgcctcatgtcccccactccttagccctccatcacagccccccattctggccctccccctacccctactcccggtatccactacctcctagccccaccccatcacatggtacacaccccccttccccaacacacacactcggcctcagcaaagcttcccgtgtcccccaggttcgctgaccacctgcacaagttccacgagaatgacaacggggctgcggctggtgacttgtggcagtgataccccggggcctcccccgtgacagtgacggctgcgcctccaccccgactgctcagtgcatctaatcacttagactcccctgaagaatcccccatggaaactgcccttatccgctgtccagcagctgccagaggccccaggtcacctcgggtccccttgaaagaatgtctcggtcacatcaggcccgctaggtccagagagcgagcccccaatgcccggccaggctaagccgcagagaccctctcagcccccacctcaggttagggctctgcccgcagcctgacctctagccctggtggcagaggtccctcagctgcgaggctaattgggtgaccaccgattccagctgcggttaatccagcttgggcctgtctgcactgcgatcctcttgggctctcctaggatccccccatgccccgtaagaggtggaagacgcttccttccaggacagcaggctttgagtccagcacccccagcctgcctttgccaccagccccaccctgcagagtatatgaggcttgacagagtctgccccctcccccactgcaccccaagagagagagccccagccagcggaacagtttctattaccccctccctgcccccagacccatgtgatttctgctttcttctttagcaagatattctggtttctagataaggaagagtctctaatgagcccccgagccccagtctcttcagactcatggattggtctgaggggtctgaacgtctcctagccaatcagaactggctgtggaccaccctagcacggccacctctcagggccactggcaggccttcctgagttagatttgtagttgcatatttagctttgcacatttgaaataaaccacggttgcagcca

SEQ ID NO: 2396 - DNA, 468068 bp, Homo sapiens; identical to SEQ ID NO: 2392
